United States Patent 11,001,841 (CCCTC-BINDING FACTOR (CTCF) RNA INTERACTOME) - sequence listing, part 29

SEQ ID NO: 70760 - DNA, 1048 bp, Homo sapiens
ctctatatttttaattgtaaggttaggatatgtgcaaacaaattaggaaaccatctcatagccctgtgccttaaatcattaaatctcattatattctgagatttctttttatgattcttaacatctcaggtttatttttgatttatatcacattatccaggtatttgagttcaaaccttgtttcaacttcttctgtaatggctttcagtacctgtttctttcctgcatgttccatattgctacaatctgttttaagcattcataaccaaatcactctaaaggtatgtaacttgacggagacaagactgaagacagggagactaggagtcttaaaaccgagcatgttgtctttagacatttgtgtctagtaccctatgtttaatcttatttacttaatcttactgctaatcagcttttgactgctagttaatttaatctcctgatattttttcccatcaaaattactaggcgttttttaattgtaaagtgactttaattagattatcccaatatatatcctaataaagagcttggcagagaaaccccagagactagtttatgtgtataaagagaaattttatctgtaggccttgtccttgtagatgtatcatcttgctgaattttaaatatgcctatgtgtcatcacttatcattcaacacatatttatttgatatctacatatgtattttggattaatgtgagtcattttcaagtgttggtttctggatgtcagtggccatttctttctttttgtctgtctatctgtccatctgtccattcatccattgattcattcattcattctcagcttgttttccctagtcagaccatttcattttaaacctcatttaatatatagaaggatgatttactaaatatttcacagttcttaagttacagcagtcaaaagaatgggactcattatgaatttaataactgggggtatataacttcttcttaaataagtttttattaaaaggtataaaacacattttatttttatttttattttttatttttctgagacagagtcttgctgtgtcgccc

SEQ ID NO: 70761 - DNA, 1063 bp, Homo sapiens
ccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaa

SEQ ID NO: 70762 - DNA, 1034 bp, Homo sapiens
cttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctcc

SEQ ID NO: 70763 - DNA, 1296 bp, Homo sapiens
caggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactggatatcttaccttattttcatgaagaagttgaaaaatggttttgtgcctggcaggaaacatactatgtatatccaaacagcagagccaaacacaaaagattgctaggtgtgcctcaggaagagtttacttgtgg

SEQ ID NO: 70764 - DNA, 1068 bp, Homo sapiens
gatttgccctggagtatgcggctttgagtcacacagattgcacgcttccctttgaggagcggcttccactttgggcaagttggggtaactggcacagattctcttctcaggaaagcaagaggtcgcggtgcagcgggcacaaccctgaactaggaattggaaaacttggggtccactctggttctctgaccttgggccaaacattgaatctctgttatctgtaaattgaagagcctggagccttcaggatttttggtcccttccaaggaggtcccatctgcccagatgtgatagtacattggggtgagagtgctcagaggagaggcaggctccacctatcagtggagtctcagtttctacgtagattgtagtacagattttacctctatgctataatatattctcatttattttgaaaatatacttccttcttaactctgggttttgtttttttttttttttttcacagccagctgttttttatcctggttagaagaattttgtgttttcttttagctatggatctttgaacattaccctatgatcgaagagttttgagttgggtttttagatgttggttgtcatggagaaacaggaatctggtgtatgccagccatcatcatcatcatcataaccctttggatgaattttcattatcaagggatctggaaggctgtcttcgctctgcttcccagctaacaaacagatgtgttcccagaagatgatgggcatagggtgtgtttttgcaagtcatttttcccatttacgtagattattcttatttccaattgatcctcaatagataagagtgccattgagctttattttcatctgtcaggcaattaagaaaaaagtaaaggaaacaaaaaagctataatatactaaggaaattcttagattctttggtaaaattaaaagaatcttggtgcatgaatgatccggccctaatctatccatcttgcacatttgggttttcctggatctctcttaaagtggggcacatctctggtcttgatagtcaaggaggagggttggggtaatcagatgtctcaagcagaggtgcatcat

SEQ ID NO: 70765 - DNA, 1132 bp, Homo sapiens
ttctgggcaggcagtgccttgcagtctgcgaccccatcatatatttttcacagttgatgttgaatacatgactgatagatttcaaaggcatttcctgttttgaggtcaccatgtacaccatattctagttacagaaattataccaaccttgacattctgggaattttttttttaaattcccatgggttctatcatttgtcttctcataaaataatacaaaatgtgcaaataaaaaaatccatatgcttgggcttcctgattgtttttattaaagtgagtttagtgatggtgggttaaataatgctgtaatcttaagccagaaattgagaatatggatttgaaatgtccccattccctttttttgtttgtttttgttttgttttgtttgctgttgcatgttcttggcagcagtggttgatgtcagtattgttgcccatgttgtagactgcagatgttgcagtgtagcttagtactttggttcgcttgctgaaattcctcactgtgcttcttatgaggtccaggaacatatagatttgcagtctgatgtattttgatgattgccagataaaactgatgtctggcactttttccaggagaaacacatgtagacgtttccaagttgatttgtagggacttagtgttattagaactttgtggcaaaactttttctcaagtggcagaagaaataaaggaacttcagttttgagggctgttaacagcacttccattagtggcaaagctgagatggttgacaaagtactggattgttgagatggaccttccaggccgggtgtggtggctcacgcctgtaatcccagcactttgggaggccaaggtgagcggatcatgaggtcaggagttcgagaccagcctgaccaacacgatgaaactccatctctaccaaaaatacaaaaattggcctggtgtggtggtgcgcgcctataatctcagctactcaggaggcttgaacccggtaggtggaggttgtagtaagctgagatcgcgccactgcactccagactgggtgacagagcgagactcagtctcaaaaaaaaaaaagaataagcaagtactgtatttggacttttaagcattactgatacagtaaaatacagttttagctaccgacgca

SEQ ID NO: 70766 - DNA, 1402 bp, Homo sapiens
aaattgttttttgaaataaaaagggaagaacaaatcggtttctcagttcaggttgtttttaacacttcacacacatccatttttataatcccaattcagaagacaatgaattcaagttaataatgtatttaaatttaaggataatgcagagaatgtcaaaatagaaaattgcaatagaacagttgagctgaactctgaggctccttttcttattttgactcaagttgaccttcaatattatagtactttcatttttacagctctttacatattctgtaaaaaagcttttaaaaagtgaaatgaagatgtttcttaactattaaatttctattgcctaactcttttaattttttgagtccattaagactttagaagatattctttctcaaatgtgtcatttaattaacaatttgctaatggccttgataggatttttccatttttgttttccaaatcaagaaatctccatgttccttttattattttcactttgtttctttagatataattcttgtttttcctggataattagtatagaatttatttattgtagagaactctgttctgacagctgataatataaatatatgtttgacccacattactagaaagaatgttatgtaagggagtttgtcagggaatatcagctctcgaacactgggagttcagggaaagaaatgaatttgtaggtcattgatctttgtgttttaaataagaattaaccaagaattttatggttacataaccagtacatgaactagtttttactacattttgttaatacatcgaattgaataatccaattcaaaacatagggtaccaattcctcttgtcagcaatactttgaaagtagggatttattgagagttcttttattgccttgacttccttacgtttgtaaactatgtgatgggtattacacttagatttattagggtacttaaaatcttgccaaaatgaaacaatctctttttgtcataagtattgccgacttaaaagcatttgtgaggggacggggggtgattttgcttttggagtcttactcgttactgaaaataaaatatgctcagctttttctttttctagtagacatttattttactgagttccacactgatagttaactttaggaaatgcttcacatattttaactaattttatgatttaatttttaaaaaggaggtacattttagaattttttcccccttttagatacctgacttacgtgtttctgaagataaattgcagatccagtcactataaattcagttgaaagaccaatctttctacccttctttgttgttctgatttcagaattccaggccagtttgttgtcaactttaatgtaccttttgagaaataaattgagtctcacatttcttgcatgtgtttgtgcccctag

SEQ ID NO: 70767 - DNA, 1135 bp, Homo sapiens
ctgagagttcttggcctccttgggattaccatacctcatcagtgtttgcttgatttcatcacaccttttaaaacaattatccagcaaggcactttgtggtgtgttctttagagttgaaaacaagcacacatttaattgtttttgtttttgggacagggtctcgctctgtcacccaggctggagtgcaatggtgcaatcttggctcactgcaacctctgcctcccaggttcaagtgatcctcctgcctcagcctcctgagcagctgggactataggtgcccaccaccacacccagctaatttttgtatttttagtagaaatggggctttgccatgttggtcaggctggtcttgaactcctggcctcaagtgatccacatgccttggcctcccaaaatgctgaccttacaggcgtgagctaccacaaccgacccatttaattttgttcaaggaattctgtgacacttatttagcagtgggtagtacatttgggtgttgcctaatcagaactggggacctagaccagggaaatatcattctatagtttgattcagattatacctggcttctggttaggctagaatatgtgctcccaaaatcttttaaataaggacatcctttaataaaatatgtgttctttttctataacatctttttctgagccctatcttgagaccatagactatctcctacatattaataaaagatggcagattttctaggaatggttttatttgaaggagaaaaaagtagcattgaaaccagcttttgcttttctacatcctccaaccactggcatcttccatgaaacacaatttgataagggagtgatcccttttttccactcagagtacaatttccaagagatggcatgtgctgaaaacaaaacttaaaaagggaacctggttcctgagagttcacatttgacatttttcaaggtcatgccagataaaaaggatacaccccaggaagaagaacacaagatacctgctgtagccctctgcctttggaaacgttaaaattgaagtcattgcatggtgcaatactggagtaaggaatagggtgaggcaaatgaggcattcactcctgacagcaaaattcacaggggtgccaagcaaaattcacagggatgccaaa

SEQ ID NO: 70768 - DNA, 1077 bp, Homo sapiens
ccatatcactcctctcataaacctcaaaaagtaaggcagatgacatgaaggtttagagagtgctgtaacacagttgcatacaaggtacagtggtggatgaaaagttctggtgctatttggaaaggtaagaaggctgtaggggggttaaaacaaaaaaagcttgagttgagtcttgaaggatacgtaggggttctccaggtggatgaggtggagaagggcattctgggaagagaacagtatgttcagaggctctgatgtaaagtatcctgacctgcttggtaattgtgtgattcgttaggtatgtctggattttaaagcctgttgggaggttgcagtgggggtagagggaggccagcaagataaggctagtagggtgagctgtgctaaggggggaggactgagcacattcagcaaaggtagcgttctattgcatttatggctgcattcagcagagaccagacattaccttaagaagccttcaaggagtacattgttaagagagaacggcatctgtgggataaatagaaagaggctcattttactttaactacaccccagaaagatctaagcaatgatctcaggctggaaagaaccaaacctttggcagaaccgtctaaaacccaggcgctgaggatttgccgtggtgtccaccttgggtcccaattgcttctgttgttgcttttatcaggcctttttctcatggttactgagcacccagtatttgcaggcctgctttaaaataacaagatagagtatcaccactacctcagttagtctcattattgagggatttcagatacagggttctgacgcagagcaactgaaggtagcaaagcaaacaacacaatgtgctaagagagcagtttcccttttacaaaatagtaatgatatggaattattttcaccaagtaattctctttttttttttttttttttttgagatggtctcaccctgttgcccaggctggagtgcagtggcgtgatctcagctcattgcaacctccgcctcccaggttcaagcaattctcctgcctcagcctcccgagtagctaagattacaggcacgtgccaccacac

SEQ ID NO: 70769 - DNA, 1022 bp, Homo sapiens
ccgacctgcctgcaggtaggcctcagaaagatcactttgaaccagctccaaaatgttgtaactatgctctttgcttttttgtttatttgtttgtttgtttttgagacagagtcttgctctgttgcccaggctggagtgcaatggtgtgatctcggctcactgcaacctctgcttcctgggttcaagcaattcacttgcttcagcctcccgagttgctgggaatacaggcatttgccaccatgccctgctaagttttgtatttttagtagagatggggtttcatcatgttggccaggctggtctcgaactccgtacctcaggtgatccacccacctccgcctcccaaagtgctgggattacagacgtgagccaccacacctagccagaactatgccctttggatttgaagttgggatgtaaggcaggacaagggtcaatggttgatgaaagtgggtaaggatttgggactgaagggacatgacgttggaggaataggatcaggaggtggcattaggaagtgcagggaaggaagaatgaaccgtgactgggaggtgagggagggagctcagagaatgcatttagaaatgcttccaggaaacctggcatgtcacttgggaagcatgttctcatcagagagccaggtcatatctcagccgttggcatcaggagccatttggaaagtgcagatgggaaagcaggcattcggcctactgacaactgatttgtgaggtgccagagctaccagctggaaaaggtcagattcatggaggaggagacagcctctaggaaggcatgccctgcacctgtcccctgggctgtcctgtgtggccaaaggggattattttgaaggctgacttagtttgtttttaaaggttattcgtttaaagtgtcctttttagtttagctttgttcagacactggagtatttaattttgcaaagagcaatagtttggggagggtctcagtttaatttgaaggagaattggaagctggagaagagagaaacagttctggttctgtta

SEQ ID NO: 70770 - DNA, 1058 bp, Homo sapiens
ctaattttgtatttttagtagagatggggtttctccatgttggtcaggctggtcttaaactcccgacctcaggtgatccgcccacctcggcctcccaaagtgctgggattacaggcgtgagccaccatgctcggccataaccccattatttcttcagattcattcagagagttagaaagaattaaggcattttttacaaaatgatgagagttacagagaagctgaggaaaaatagctttttaaaaaagcaaacagaatgaagcagtacataatgggaaaaaaattgagcatatctgtgtagaagtttagaaaaataaggtttttctcaagatttgttaattctgtagaaggttggctctggaacaaattcgtacagtcatcttaattgttttactttttactgagtaacactgctattgaaaaaaacattctgaagtgagggtttgatttatatatgtctttgaataccttccacggtgacaatcacataaactcttttaaaaaagacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgtta

SEQ ID NO: 70771 - DNA, 1033 bp, Homo sapiens
ggaccccctccctgttccactgtgttggccctggctgtgggtctgggtgtctgccatgattctctgccttttgccccagtcttcctttaagcttgggagtgtttttgtttttctctcctccgttggtttgattcatgctttatgtattcttagccatggcgagagtgaagaacagagctctgggaacacagctcggtgcctccggcatcagcattggatgtctcaactcttgagcctgttggaatggctgtccctaagctgacacttgcttcaaccttctctgggcttgatcttgtcctccccatagactctgtgccctggactccctggctgctcttacaacagcagtgcgcaggactggctagtccatttcccctctacctgtgggctcaagggctctgcctgccccttgtggcgccagccttgagtgacaacacagaaccacacctgccgccctcctgagatacattctagctctgagttgcatacttggatgcatctaaagtcactgagctcttaatggcagatattttagatattgtgatgggtttattagagaggtttctagcttgggattcttttcataggttcctccaatcataccacgtaattgaccttgctctgcatgtaagttcagtgttggtctcagtgtatctagcttgcagtctatccatgtgcttccactgtgactgagtagtgtttgcctagtggcgtcctgtgtgctagagtgagaacagtgggtcagtatccatagcaagacccttccctcggtaaagggagagtctgcagagggcccaggtttctgtgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggg

SEQ ID NO: 70772 - DNA, 1051 bp, Homo sapiens
tctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagcaaatgaataaataacatttggtggtgaagagcgctatgaagagaagcggtatgtgtggtggtgggggtggtcagggaaagcctctctgatgaggggacactgagcagagaactgagtttggctgcagagttgatacagggaggagagctttcagatagaggggaccacaaatacacaggaagtcaagtgggagccacaggtgacaatgtggctaataagacaccttcctccctgggatgaatcacattccacatcagcagaggctcagtggctaccttttgttttgctctcaacatgtgagatgtgtgtgcagccgtgatcttgtgtggctcgtagcatgactttagttgatacgtggatgtgggattaagtaatattgaattacatgatgagaaagttatttcctttctatttctgtttcagttcggtaagaatgataggaggtcctcatgcttaaagccttctgtgggcaacagtatttagctagaatctagttgtattgctttttttgtgtcaacttaatgggttccttccatttatggcaagcaaaacttttctatttacgaagttccttttaaaaatacatgacttttagagactagaattgtggttattagggactgggaagggtatgagggaggcagggatggggaggttggttaatggatacaaaattacagctagatgggtggaataagttctaatgtcctagcactgtagggtgaatatggttaacaggaatttattatgtgttttcaaaatgctagaagagaggattttgaatattcccagcacaaagaaagaataaatgtttgacatgatggatatactgattgcccttatttgatcattacacattgtatgcatgtattgaaatgttac

SEQ ID NO: 70773 - DNA, 1463 bp, Homo sapiens
atccaggctttgcaactcttgatttaggactttttctgctgcgcaatcttggcttcccactgagtttgaaatggaattgtattatgctgcagtgttaataattgaaagaggctttttaaaaattgtactaatgcatttttttttttttcattttaagaggagaatttccaagggcctttagaggtatgctggaatgagatttcactaaaatattttatttttatgaatgctaattttaatcatttaaaaggaaatgatgatcgttcagtactgcattttgtcacaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgcctttttttctcccttctgtggatgtatagaccgttcggctgcatcagacactgtattgaacatcagggttgatttaactcattgttgctcagctgtggctatgctttggaatcacctggggagcttttacaaaactactgatgcccaggctctactccaggtgaatccattacacaatctctggagggtgggttctgggcaatgggatgttaaaggcacacacgggcatgcccatgtgtaagtcaggcacacgtacaaatgcttcgtgaggtcatcttaaattgcagccggggttgagaaccttgagctctgaccagctggttaggagcgtgcctccttcctcactcactgcttccaagtcgtggcttcccaaagctgtgtacttgcttgaagcattgttcttattttcaggtagcaccagatggaagggtggtaggaatcagggtgtagagggatattagtttgcaaatccttttattccttgaatttcctgagcattgttgctcaagaatgttccagaatctcagaccccatacagggggtgatgctgctaccaacattaaaatccattagggctctatggggatatataggctacacacatgaggcaacaattggaggagtttgaattgctagtgaatttgaatttgggaattatttttattgctattcacattgtttggtacagtcattacaaactacatgcagtaccttgtgctctgtagatcaggttatgtccaaatggagacagagtctcctgctgaagaacgagttggatgctcctctcagttaaaaagtgagctgaagatggctcgaggatggaagagagaaggagagacaaatggctagttgggaagagtgggactggcttagtctgtcagactggctgtctgtctgctcatggtctttattcataattaaaaatgaatttcaggccaggtgcattggctcacgcc

SEQ ID NO: 70774 - DNA, 1051 bp, Homo sapiens
gggggaaggctagggtctaatggaagaccatacggtggggaggggtcatggaacagagcccctgaatctctcccatttcaacttgctactttgagagtaaaaaaaagactaaatctccttggctgtgatcaggagatagtgtgttggctcccctgatactggaatccagtcccacttttgcagctcttaaatcttgctatctaaagccctcagttccaataaccagcttttctggtggtgcagcttcagagtttcaccaaatgcttagcaaggtagtgttctctttttatgggtgtagttcaaacttgtaggctgctgttatagctagctgtgggaatgtttgctttacataatgttaataggcagctgtgtttatgcttgttcctcagtttaagcagtaaggagtgtatacatatgattctttgagggcatttcccccagactaaaaaaaagaaaaaaaggtatgttgtgttttttccaacagtaaattttaattgaaaaggaatgtagtttctagaagaagtttggggcaggttttactcctaggctttattttgttaatgttatgaaagaaactttaactccttctaagaagtgccaagttgacaattcctggaaatgttcatgttctatttatgctcagcaccatagcagacagggtggcaataccattaccaaaataataccgccgagatgtactaagtgacaaatgagaggcttctggttttataacctaaatacaagactttaaaagcatctcccaattctaccatttgttgataaggtctgtgggtgctgagtagtaatggtgaagttgctgtggagaattatagatcaagtagagcgtatctgcagtgacttgtcctgttgctagaactatagaaggttagagttggaagggatcttagaaacactttatagatgaggaaacgaagggatatccaagtctaacagcatgcatatgggttcttctgttcaaatagtagaacttcatgtaacataaaaataggaatttctctgaaatatattgggtagttcacaactttgaagg

SEQ ID NO: 70775 - DNA, 1021 bp, Homo sapiens
cccaaagagatggttaaacttgtgtatttttatgctaggtttgatggcatgtggatggttgtggggaaatgggattggaaaaagaatatgagctctaatgataatgaactagggtaaactttgctagggctaggtgttcctgttctctctgtgatctgcatcttccgaaataaggatgctcctttcctctggggatagggaaggcattgcacatgagagtcaccttacctgtttcaggggaaggtcagaaaatcctttctagggtttacaacctgctttaagggagaatcgggagaattgtgggagctgaggggaggtcagagtgacctgcctgcttatgctgtcttctcagattccaagtgccatatcttgggccagtgtgtcttgaatcccatcattactgttggaaattccgtttcagaagcccactctttgctaaactccagttacttctagaactggacactgctgctgaaatctggaatttcttatgtgatgccaaaaaaaggagaaaatttagaagattacgagtatgtgtgtgtttaacaaagtatatatacttttttcttcagagagtaaaacctctgaatcaacttgaagtagtcttttcaaattgttatcaaggcatgctgctatttcaactattagagagatagcaccggacttaaaagaccttctctaaatgactcttcaggaactaggaagagcatttttcactctgctgtttaaagtattttgtttgtctttctatgagtatactgtttcaaagtgtttcactagattataacctgatttttttcagtgtcttctgtttgtatgcttttaagtttctaaatcttttctcttcattgtttttccccaaattgttggactctgagtaagcttctgccagtgtcattttaaaatatatttatatccttcagatgctaaaaatagtttgtgcacttttaaatggttgaaaaagaaaagaagattacatgatgtttgaaaatcacatgaaatgcaaatttcagtgtctata

SEQ ID NO: 70776 - DNA, 2037 bp, Homo sapiens
cagagtagaagggagactcagagagaggaagacaaaaaggaagctaacatgaaaaagacattttcgtcaaatgctagttctttgaacttctgggaagaaaagagtttctaggagaccacaactttttactgctttgaagattccaaattcctgagaatatgattcagttagtgagtaacattctctatgctggcaaaggaggaaattacctggatctggacctatctttggaggatgagagaggagctgttatctctcccccactgatacaatgatgttgtaatgtcttttcagtaggcatttgcctgagctcttttttttggactataatttccccccaccccactttctctaatctctgcttctcaaaatcttatctattcttcagagcctaattcctttcttttcccagaagcttttccacattctcctcatctgggatttttttttttctttgaacctccacagatttttgtgatgatctttctccatgttttaacatagataccggtaaacttatctaacgcttccctagctccctctcaccatcgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgttggatgatcttgatatctaggctttgaatctgggcttggcagggtaggtgcatgagccctgaatataagggagctggcctagggagagaaaaaaaaccatcacttcaactcctgtcttccagggtgttgacatcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacactgatcacactgttccaccacccccaatctttacctccattctctctaccctcccagcccccaccaaaacacaattcttttcaggcaagtgcaccatacaggtgctctggtggtcccgtaactgaggatgtagttgccagccttttagcaatatcaagagttctctggaggctcttgagagctgtggccttggttaaattggacagaatcacctttttggtaaattcccttccgattcatttcacaaatggcttaaatcatttatgttgttttgttcaatccagtcaggaaatgaaagcattgccattttaattgttttagaacagcattttacacctaatatagactcccaaagccagccaaatgcagattttggctcctagatcgctgactgcatgctgactgtgttcttgagtgtggaagaaaacagatccagccaaagactgattaccttccaaaggtcacaaaagaagtttctctttatctaagaaagaaagtaggtgccattaggtgttgattttttttaaaaagtccttttaatttaaacaatatttgaataaaaattatggtatagtcaaccacaaatcagttgatgaagtctcaaattttggcagtctcccttggttctgtgttcttgggcaagtttactttctttttctttttcttttttttttttttttgagacagggtctggttctgttgcccaggcttgagtgcagcagcgtgatcttggctcactgcaacctctgcctcaagcattgctcaagcaaccctcccacttcaacctcccagttagctgggactacaggcgcatgccaccacacctggctaatttttgtatttttttgtagagacgagg

SEQ ID NO: 70777 - DNA, 1673 bp, Homo sapiens
tcagaagttaatatgtttttcttctcttattctggacttgtcttataaaaaatacatgtactcgtatagctgccaatgagacaagtgttgacattttggtttcttttgttatggttttattgttgttattgctaatgaatgatttttgaagcaaatatgtactttcaagcaaatatgtgcaaatatgaagttggaagatgatattttctcttaaaagcattttaccattttcacattgccatgcccttagctttcagggtgttttcttgagtcattattttcttttgttgattctttaaaatgtaccaatggtgagtgtgaattcatagtatgaaaaatgtgggtgatagactatgattagacatagttcaagataatagtttatatgaaaaattgatgctctaaagcatttgctaccaaaatttgtttttttgtgtgtgtgttacctttactcttctccctgggtccacttaatggttctgtatttttttggagagccaaatatgtcttgaaggtagtcggggagagggaggaggagcaacatgaaatgagtgtgctgttttatcagaagccacttattcacagggcctgaagtgatagctgttgggagaagtgatattcatactgatgggggtaaaactgcctactcattttggggagcttttgttttcataataaaaattgtttgtacaaataaaggatgttctaaaggagaggactatttgcaattgagtgttttctattctggcagcatccgattgaaaatcatttcagaaattcttagtattgcatgcaatcattgtttagtagctagatctttttaactttatgatagaattgtgcatttcatttctgttttaagtcctatccatgtatttaagtagtgtaataaattattttcttgccagcagggtgacttgagtgaaaaaatatgtataatttggccaatagcctaattctgtgacctctacaatccaaatggatgccgtggcttttactttggttacatttcaaatgactttaattggcctgaaattctattagtatgattgattcaggatacccattcaaagtcatctcatttgtctgtgtcatttgtcatggatcaaatctctgggcaaagcagtcattgaaccttggttaaacctcagactgtgtccgtctgtcaattttataaatgattgggaggaaggcactcttgtgagttctggatcagtagtgatataattctgtttctgttttttgcttttttaaatctactgctacataataaaccactccaaaacttggtgccttaaaataaccattttaccttggtcatgattttgtgggttaggaattaagaaagggctcagctgggcagtttgtctctgatccacatggtgtcagctgaggaatctggggataggggatccacttttgagatctcagactcagatgtctggtgccttgactggggtgcgtggctctgggcagggggcttagctggggcccagcatgtggtctctccatgtggcttaggtttctttcagcatgggagctgggtttcccaaaatgtgaggatggaagcttcaaggctgaaggtttctcaggatgtagactcataagtcccagaacaccagttctcctgcttattggtcaagtaagtcactaaattcaacccagacttgggg

SEQ ID NO: 70778 - DNA, 2359 bp, Homo sapiens
agacaagacaggaggagaaggaggttgggaatggcatttgtgtcagccaaaaagaacagggtctgccgcagatagttttaggtgtgactgagggcaccactcccaagtcaaacatcaagtgcttgggagttgagacatcatccaatgtcctttttttattaaaaaaaaaattctttcactaagtggttttagctgccattgatgattgtagccttggatgagttttattaaacaattctttctttttagagaagaaaaaattgaggacccgagaagttaacgcctttgatttctattgaaattactcatagggtaagagtgagagttcttgctttgccctttccaccttcctgacttcatcagcaaagaagagaatcttggttttatttttcattatctgcaaatgatatgtccataacagtagttatttgtcacaaaaatacttcacaagaacattggtaaacacatacaaatgttagcagttctgaacaggcatttattgtagaggaacctgtttatgatgagaaatatgaaagaattgagacagtgggcctctaccatagaggagggaagaaactagttgggtgaaatttagtgttaggatgttttgtcaaaaaactatttttgggaggctgaggcaggaggatggtttgagcccaggagttccagaccagcctggacaacatggcaagattccatatctacaaaaataaataaatagaaatttaaaaaaatttttttcatctttagcattaatggcaaatatttagagctatatttaatggaagtatatgtgaattggtggtataaacagatttttccaaactctttttacttgtaatttctgtggctgtaacaacttttactagcctcttaggagtttcttaaatcctttttccccattttctttggtctatgataaagaagtaatctgaagtagaaaaaaattatttaggctgggcacagtggctcatgcctgtaatcccagcactttgagaggctgaggcggggggatcgcttgaggtcaggagttcgagattagcttggccaacatggtgaaatacaaaaatacaaaaattagccaggcgtagtggcagatgcctgtaatccaagctactcgggaggctgaggcatgagaatcgcttgaatccaggaggcggaggttgcagtgagctgagattgtgccactgcactctagcctgtgtgacagagcaagactccacctcaaaaaaaaaaaaaaggaaaaaaattacttagatgagctaatttttgaagatggtcttataaagtttattttttattaatacactttattttttagagcagttttagattcccagcaatattgggtggaaagtatgaagaattgctatatactcccttcccctgcagatgcacagctcctcccactgtctacagttcccaggagaggtgtgacatttgttatcattgatgaacttatattgacacatcgttattacccaaagtccatagtttaccttagggttcattcttgatattgtacatcctatgggttgggacaaatatataacgacatgtatccacatttatggaatcatacagagtattttcactgccctaaaaattctctgtgctcttgattgttcatccctccttccacacaacccctagaaaccactgattgttttactatcgccatagttttgcgtttctagactactatatcgttggaatcatgtagtgtgtggcctttgcagattggcttcttttacttggcaatatgcattgaagttccccccatgttttttcatgacttaatagctcgtttccttttagtgctgaataatatcccattgtctggatatcaccgtttatttatccattcacctactgaaggatatcttgaatgctccaagttttggcaattatgaataaagctgcttataaacatctatgtgcaggttcctgtgtggacatgcattttcagttcatttaggtaaatatcaagaagcatgactgctggatcatattttaagaatatgtttagttttgtgaagaattaccaaactgtcttccaaagtggctataccattttgtgttcctaccagcaataaatgagagttcctgttgcatcacactataccagcatttggtgttgtcagagttttggattgtgaccgtctaatgggtgtatagtggtatctcattgtgttttaatttgtgtttccttaatgatatatgatgttgaacatcttttcacatacttacttgccatctgtatatcttctttggtgagatatctgtacaggtctttggccattttttaaatcaagttgttcattttcttgttgaattttaagagttctttgtctatttt

SEQ ID NO: 70779 - DNA, 1135 bp, Homo sapiens
tttatcttttactttttgtagtttgaaacgatagcctaggtatagtttttgttggcatttatgctgcttggtattctctaagcttcctggatctgtggtttggtgtctggcattaatttgggggcaattctcagcctatattgtttcgtatattttttctgtttctttctttttctccatctagtatttccactatacctatgttaaaccttgtatacttgtcccacagttcttggatattctgtttttcagtctttcttctctttgcttatcagttttggaggtttctattgatacattcttaagctcagatattctctccttagctatgtccagtctactaataagcctaccaaagacgttcttcatttctgttacagtgtttttgatccttaacatttttttttcttaagatttctatttctttggttacattgcctatgtgtccttgcatgctgactatctattagagcccttaacaaattaaccatagttgttttaaattccctatctgataattccaacatccttgtcatgtctgtttctgatgcttggtctgtctcttcaaactgtgttgttttgccttttagtatgccttgtaattttttcttgatagctgggcatgaatatggggtaaagggatcactcttaagtaggcctttagtaatgtagtgatagaagtgtgggaggagaggaagtgaaaccatctttgcaaaaattatgaccatgagaaaaattttggcataggaaagttatggcagtgaaagaaatctaacctaactgactccatgttgcttctcacctccaagctgttcctattcattcctgggcataggccaaacaaaatataggaggaatttactttatagtttaattttgaagcaaagatgataacagccccttcctgagacaaaccccctctttgcttagggattagaccatctttgtaaaactgaaacgttagccacaagattagaaattctggctcaggagtcatgtagccagaggccacaagattcctaaacttcccaattgctcctatagataacatcactattgtaaaacctaagattggtgtttgaggtatttttctgaccctgcattctgatgaaccaaccagctggtgccacccaga

SEQ ID NO: 70780 - DNA, 1057 bp, Homo sapiens
aaactagctgggtgtgtggtgcatgcctgtagtcccagctacttgggaggctgaggcgagaggatcccttgaacctaggaggtcaaggctgcagagagccctgatcgtgccactgcactccagcctgggtgacagagccagaccctgtctcaaaaaaaaaaaaaaaaaatttctgctccagtatgttgtgattctctgtatctgcctgtctgttgcttcaatttcagaggcatcagtttaccttgtgatctcacttttcttacagaactaagaagacttgttgatttttcagtttgttcagcctttttacttgttaggatggagtggcgacttttcagctccttaaatacagagctggaaaccagaagcctcttgacttttcattttttgcctttgaaaaaagtcaggtagttaatacttctctttcagggtgctgtttgaaaattctgttatgcaaaaacataatgtagataatttgtattcccaataaatgataaggcacattggatataattgttactgttttgtattttttagcatagttttagatgttttattttgctacaaaggaattttgagcagaagattgtgacatatatctgtaaagaacagacttattattattattattatcattattattattattttgagatggagtctcgctctgttgcccaggctggagtgcagtggcgcgatctcggctcactgcaagctccgcctcccgggttcacgccattctcctgcctcagcctcgcaagtagctgggacttcaggcacccgccaccacgcttggctaattttttgtatttttagtagaggcggggtttcatcgtgttagccaggatggtctcgatctcctgacctcgtgattcgcctgccttggcctcccaaagtgctgggattacaggcgtgagccaccacgcccggcccagacttattattttttatgttcatccccctgttaattatctttcactcacaatattccctttgcttttcctttttaccagtggtccagtatgggtatcagtggaacaatatatgtcttaagaat

SEQ ID NO: 70781 - DNA, 1047 bp, Homo sapiens
tccagcaaaacagaaaaaggataatatatcattaccaaatgggatttatcctggaaatacaagggtttagcatttgaaaatcaatgtaatttattgcatttattgaaataaaagagaaaataagagcatagctacaacaggaagtctagaagcaggcttgagtatacatggaaacctagtacaggttcacagtcctttatctgaaatgtttggggccagttatatttcaaaatttagggtttttagcagtatctcataatcaaattcatgtaaatttccacagcagaacagattaatacggacactaaatgggatgataaagaccagaaatagcctcacattagctcaggtcaagttttgccaccaaatgaatttaagcaccaaaccgcaaaaaacaaaagactctgttttcagagctttatgatttcagaatttcaggttaggaattatcaactctttaatgccagggtggcacatcaagtcagtgatgagatttgtaaaaggcattgggattacatactagtcatttagaggaagaaaaggataaagttaaattcctacttaatagcaatattgtttatgtttaaagattttatgttaaaaaactaaagaatctataaaagcacaaaatatatacttaatctttatttataatcttgtggtagcagagatctttgtaagcatgataccaatagcagaaactaaataaattttaaaaagagatcttacagccagccacggtggctcatgcctgtaattgcagcactttgggaggccaaggcgggcagatcacctgaggttggagtttgagaccagcctgaccaacatggagaaaccccatctctactaaaaatacagaattaccctggcgtggtggtgcatgtctgaaatcccagctactcgggaggctgaggcaggagaattgcttgaacctgggaggcagagattgcagtgagccgagattgcgccagtgcacttcagcctgggcaacaagagagagactccgtctcaaaaaaaaaaaaaaaaaatcttagattactaagcaaa

SEQ ID NO: 70782 - DNA, 3147 bp, Homo sapiens
tccatccatccatccgtccatccatcttctaggtcctaggtatagtagtaaaatagtcaaagtcccttccctcaaggagcttacattttagagattcaaagcattttcaaatgtattatttcatttgctttttaaaacaagtatgtgaattttgaattttttagtattttcatttgctagatgaggaaacaaaaatattttgagattaaatgacttacttgggataataatgctatgaataaaacccattattttttatttagaactcttttatctataccacttttgtattctaaacaagtttttcattaatgaaacatgttttcacactgtgtttttctcaatacttcaatcataggtagccaagggaattttaaagaacattaagtgcactcaactgagctgctttaacctttcaatatgttcccgctgctcttagaatgagatttgaaatccagaacaccactgcatcatcaggccagtgcttccttcccagctctgtctccggaccccgtccctcgtattgcctgtcttctgcaaatgctagccttctttcctgacctcagaggtattgtgttctttccagcttcagccctttgtatgcactgttccctcagcttggaatcctcttctctgtttccctccttgtccgtcttccccctatcttcaccaagctaatcccactcaactcacagatctcagctttcatgccacttcctaggggaggccttcctcatccccctgccaaggttaggtccctgtaccatatgtgctttctcatagcaccctgtgattttccttaatgactcacctatcacaatccaggattttgttgactgtctgcctccccttcctgtaaaggttagagggtaagctccatgggggcagaacactagttatgtcattttcaccgctgtttccctggctagcactgggcctcctgtaggccctccaaaatatgcaaataaatgaatgaacaaacaccctggcagcatggaaacccagagcggcacaagcgagttcaaatgcttatggtttgttccatctcacttccctctaggatgtgattttagcagtgtaggcagcttacgaaatggggcaggtttcttgtgttttactaatgtgtaaataaagatagagtaactcttaagatatggaaagtttgtaaagtggcagcaaaaagtgacaaggtgtggggatccaaatacagagcctagggaaaatagaataaaccaagttgtttttatgtctcttttccattagactgtgagcaagctgaagtcgagtcccagaacttatttatgtttatatcctcaaagagactatagtgcctggttcatcgtagctgtggaataaatgttgaatgaatgaatgatacacctcttacctttgaagctgacttcttgtgttcttcatgctgacattagaaataggaaaagtcagtcgagtacagtagttcaagcctgtaatcccagcactttgggagaccaaggcgagaagatcgcttgaagccaagagtttgagcccagcctgggtgacaaagtgagaccccatctctacaaaaagaaagaaaagaaagaaattggaaccgtattatttgtagaaaaaatactagatctagaaccagagacacctaggttaaaactgatttaaaatgagaataattattcctaccaagtggagttgttgggagggtggtatacatatagatggtgtatataaagtgcatagcaagctggttgtggtggctcaggcctgtatttccatctagtaggaggccgaggtgggatgatcccttgaaccctggaggcggaggttgcagtgagctgagatcacgccactgcactccagcctgggcaatagagggagactctgtctcaaaaagaagtgcatagcaagcaccaggcacatctaacagctcctcagaacatttaagctcccctttttttgcttctttccctttggtataattttagaaagacttttggggagcatgacatataaatcattaaaaaagagagagcctcaaagcagaatcatggcaattgagctagatttgtatttatcaaagcaagcatgatgctgggatgcttaaataacagtacagtacattgcaaaggaactagggaataatgttcctattatttttgtccatggtcagcctattactagaaaagagtgaccacattgatttctaaagtccttatattcaaaactttctgtgctgaccaccatcatttatgtttttcccatctctacttaaaaacgtcaactagccccaacttttcctctagttatttcttttattagatttattctgttctccacaataaaatctatcttctgttcccatccatgacaattcaagtagttataatgggtggatatagggtatgataaatgttggtaaatccactgagttccttgagttccacattgatgtcttttaggatgtgactaggggtaggctaaatattttctagtttctcagatcctacccctggtctaattatgatatagaggccagattagtgtcaccagtttttctttctcttctgaatgtagagcaagagcaaatgattgcagataacagcatgagaaacttaggatcaaccaccagcatctaagtgagtcttgtactaggctcattccagttaaaagctgtaaatcatttcatagccacatcagtttagttctcttttatagaactcattatgtgatacaaaatatgcaaggcactggagatacaaatacaattatttcctcaaggaactttgagttgagcaaacatggtactgtctggtgagaccagacatatgagcaaacatagtacttctctggtgagaccacatagagaaatgtacaaggggtagaggaggcagtgatgactactggtctgggatagttgagggaaggtggcataggctgcctattgaagaataaattagagtttgctatgtgaacaaggttgcagagggaatagtatatggaaaaacagggagatgtggacccatatattttgtgcagagatgtccaagtacttagatattactatattgcaagtatgaagaaagctttttttgagatctgacaatgccaaggtaggttatggactctctttggagtccccaaaataaaaataaaaca

SEQ ID NO: 70783 - DNA, 1022 bp, Homo sapiens
ctgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgtaacctttggttattcttttttgtgcgtaaagtgtcaacctcctgttttattctcataaataatggaaatcttaacttcatttcagaaaatcacaaaagataacagggaccctattcaaacagaataaaaataattagtaagtcacaaactctgactagaaagaaaaagagaagagagagagggaaggagaaagaaagaaggaaagagagggagagagagaaacgaggaaaggaaggaaggaagaaagtgaaagaagaaagtcctcttgttggtgttaaaatgtgtctttaaggggaaacttatcatttaggttactaatggtttctttcttcatcattttaatttccattaataaaatgtgactttgaaaggatgcagggagtttgggaatagagagttttatttttatttgtttattttttttccccttctcccagcaaaatacacaggtatctgactatgtagagacacgaagccacctatcctgaccaaacttggcagtggtcaggggataggaggaagtgtagtgccatgggatgggcaccagccctgatgaactcgactttctttccatttctctcctgcatccaaatgttgaggagactttgagtagtagtgtagcctcttttccttttaaaaatctgcaccctgcttatttccaa

SEQ ID NO: 70784 - DNA, 1086 bp, Homo sapiens
tgtgtcattagaacagaaatatttagggctgctaactcccggagttgtgtacttacccttattacagatgcaatgattttgtctgactgcattgctttaagatgagttttattgctttcatgcttaggcaaggatatttaattttatttgtgtttagagtatcttgttgtaatatacttctcccccatcttgtgctcctaaatttgggataagcatagaatccttttaagaatgtaggttattttccagtttactagaaagcatgacacatataaattagcgactaaggattatagcgtcctttcctaaaggttatcatgaaaaaaagttaaaatgtcaaagaagatcctactccagtaaaaacaatttactctgtaaaatcctgatacctcataggaagctttggatcttgttctcagctaccaaaattctttaaatatgaaagttaacatgacaggaaagtggaatacactctgtgctgaagacccactgttcaaggtgtgtggttattaatctgggtttgaatttacaaattatatggtctgattaatttgtagataggggtcggtggaggttagacgatgggctttagaacaaagaggctgataaaatactactcacaagcctttctgcttgtttgtgactctctggaaatgccattagatagttctcatagctatggtcaaaataagtaggcttagaaataaaagacattttctcccctgtaaaaggaggcggctggcctgtgctctttctaggctcttcccagagacagcaacctcggcttctgaacccttagtgctcattctatgctccaccgcgtctcctctacacgccatgatctttgttatctgatttgctagccattgttatggaaagttctcgactgtaatgcaaaaagctcagccttgggtccttgctaatgtcagcaacccaaaggcgcccctcaaaccacctcgaaaagaaaaatcctttaaaagatgtcaaactctcctttcatgttagcccaaaatgaagttcccgagcagcatctggcagagcagggtaattcaatctattttaatgcaaagattttccaagaaggca

SEQ ID NO: 70785 - DNA, 2672 bp, Homo sapiens
ggctgcctctgcgggccccggctgcccagcccagcgcggggaggcggcgccgactgccggggggcgcctgcaagacctgtttatttgcatttgtccaatttggctcaagtgaaaggtaaatacggagcgatcagcttgtcctcactccagcaaaaccagggaaactcagctccatctccaggaaacaaacccaacccaaacctgagtgaaacgtaaatcttgcataaacaaacacgttcttttgcttctgggaaggaacaccggagaaatgggcattccttccgactgcccgcctcccactgtcggtaaaaatgagccgtcacaggttgccggcaatttcttgttgtgtcccgagccattccgcggatcttgttttgaaggggcgagtcaggtgtttgtgcggctccagatcctgaacaggttatgcgctgggtccttccttatcaggaggggggtcaggctgccctcccattctcatcttccgccccagaccagaggctacaccaaagttcacttttgaaaagaaatcctgcagaattaaaaataaatgtctgccctttaaaatagtttcgttttagtattatgcatatttctgtttaggaacttgtaatgctaataatttatgttgctatgacaattgtcctgcatacctaatattaaatttaatgaattaatgtggcgtatagagtaatagtaacttaactagtactccgataatgccagtattccctgtgttactaagttaatggaatcagaattttggagttacaatatagaggttttttaggccaatttttctatgggattctagggatctttttataacatttctgcttttcgaagcagtctataccattgctggagagccgtaattactaggatgctatttctttttgtttgtttgtttgagacagggtcttgctctgtcatccaggccggagtgcagtgggtccaactcagttcactgcaaccaccacctcctaggcttaagcgatcctcccacttcagcctccccagcacctgggaccacaggccctcgtcaccgtctggttaagttttgtattttttagtaaagatttggtttcgccatgttgcccaggctggtctcgaatagaacattattccttatagtaagctgaattccctgtgtaattattcttactgtcccttcaataataaaagcctaaaattattcttactcatatattttagtgagggtggtgcatgcttgaagaccgtgatgagtgttctcttcttatattcagggcaactatgatcacatattgggctccagatccttgctttatgcatcttcttttgaattgtttagaaacaatggcaaaatttccaatttcaaggtagtgcttgaaattatgcaataaaatgttatgttagcaacatttttttttattttaaaaattcctttgattatttcacacttatatcctgttctctgttatggtagttttgttttctattttatttttagtttctatgtaatttattgtgctttagctgaaatcactaaataaagataaatgagtttaacagactcttatgtgctcatttttggttcttttttgctttaccccttgtattcgttttctattacgggcataacagattaccacaaatgtagtggcttaccatatccatttattttctcatcatttctgtgggtcagaagcttggcacaggatggctctcctggcttctgtgcccagggccttcacaaggctgaagtaaagggagcagcaggcctggacttgtacctgtaggccttccaggggagaatccacttccaggctcactggcagaatttagttccatgtggtagttgtactgggggcccagttgcctttcttggagagcactaactgctggctgttaccaagggtcttctagaggttgcccatctacatcttcaaaggcagccacagtgtgcagaatttgctttagatttccctgccttcccctaatgtgtttctcttctacttttaaagggcatgtgattacagtggcccaactggataatccaggctaatctcgctagtcaacttattagtaaccttaatcacacttgcagtgtcccttcatagcagtacctagttaagtgcatgattgaataactgggtaatgggacttctcgggagagatctttgacattctgcttaccatacccctctgggtaccactttgttgtgatggtaacctcataagcagccatttaaaagagattttaagcatcttaattttgaaaattttgcaaggtaaaattaaaataaatccaagtaacatcaaatattacttatacataattctagaggtttaataaaaacaataaacattcaccataagtagttgttgcttttaaaacccaaagtttttctaccttgcaaaatcttccttgattttcttgttttgttttggtatcacaatagatcagtttctagtaccaccactatataaaataaaaataataattgcattttaaaaagaatggttttcctctgcactctgattttaaccatggaaagtttttggtatattcaaatataattctattagattccaattttgaataagaaactgggttccctgacctagctgccacttactcatatctaaaatgtacttgaatttgcagcttccaagttgggcacatgtaaacc

SEQ ID NO: 70786 - DNA, 1104 bp, Homo sapiens
attaagtatacaattacttatttgcctatttatcccttctccaccttattacaaaaagatattgaggaaacttacacacatacacacactattaccaccaccacctaaaatgaatagatgaaattaaggtaaagggaaaataaggctaggagaaaaataaccatgctaggatgaatagggttagggcaaagaacatgtaatataaaattctatatggggctagagctaggctgtaaatttggctctggattttctagcagccaaaacaaaaagagagaaaattaatgagctacaggattcaccatattcataaaatgattaaagaagattgggattttcccttgaacccatcttgtttgaagtgggggcatttgatgctttctttctgctagaaaggttaactctgagttgcaataaaaatcataaaaacacaactttggcagaaacataaatgaacagtatgacagaatggaagcagttcacaggatttctaatattacctctcttttcctcggtccacattctaatattccaatatgctcctcagcacacagagtggtccaagaagattggccattctttccggaagttggacttccctgaagattatgtgggaatgggacgtggaacctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgcgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttg

SEQ ID NO: 70787 - DNA, 1490 bp, Homo sapiens
cctgccagaaagtcatattgttggagcttcatgagcaaaggggagaggatccaggattgagccagaccttgctgagccttataagtcctggacaggagaatggattttattcaaacaagaagcccctgaaggtttttaggacagggacatagtttgcacagaagagtccactttgcctctctagtggatgtcatgctatattaaaaactggcagagtgctgggcttcttcagtgatactccagcctttcccttgtttttaactcacttataaataattttaagtcacttttcctctttattttttaggttttctcttcaaatccaattaactatcatcattaattaaagaatatgtgagcagtcatgtctgtagtattgagcaattctcctgttatctgttttttgctttctattatgggttttatctatttatctcccaacacgcccatcatttgctgccagcactggcatgctttctcttttaagcttttctcttttcctccctgtttcagatttgtgatagactctttttgtgtttgtccatttatttcaagtccgttaggggcattttctcttgtctgtgctgatttgctttatagaacttggttcagtacaacaaacctaaaacagctccttgtacatagtaggtactcaggacatgtttgttacatgaatgaataaacctttaggggcaagatctcctgggcttttgtgaagaacatgcagactaatacattatgttcctgcccttaagcagactactgttttagcagggctacttcagaacctaaagccaatgtttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcattttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatatttgcatgtggattatacttttaacattttgaaaattatattttgacattcatattcagtaaagtctttagacatgaatgtacatgtca

SEQ ID NO: 70788 - DNA, 2506 bp, Homo sapiens
tgctctggaaaattgggctcatcagacatgtggcttctggagaaatgaggttttaataacttgtcgtttttctgttccaaattttgagagtagcagtatatcactgcttaaaatgtgctaatttttgagataacttttcttagcctggttctcattagagcttaagaaggagacaatagcaataggacattgtttgctcagcctctccatttctgtaggaaaagaattgttaggaggaggaagggtagggaaaaaaaagtgcaggggagtgtcatcatctggtagatagtttaaaaaaattcctctggctttggagtaggaaaattgattgtagaggatccaggaggaatcagagaggctgttgaagaggctatggtagctgtccatgtgagggacaatggcttggacaagggtggcagtggtgcagatagaaaagggtggttggactcagcatacattggaagaagagggcacaggaccctgtgtcagatattttggtatattcctcctatcattagagtttagtcatgtgtattcacaccccacatttgtttcttctaagaaatgaagtctatccgttaaggaaatgtcagttaatcctcattgctgctgttatcatggttggatttgctccaaaaggtatgttaccatatatagaattaaaaccagtctctaccctgtggggaagtaatgcagatgttttgagattagagtttagaatctattccaaagatctgccagaacacatgtttaacaatgagcatgagagttttccccattgctattcttactatgttgtttatcaaacaaagataatttgggggcttgtgtagaaactccacaatatttaagaaaataaacacaaatctctgagtcaataactaaatgtttctgatggtatactaagaaatataacttattttattaatggttattaatataaccatgacttttaaattaatattaatattaactgatattaatattaatgtaaccatgacttatattaatggttattaatataattatgacttttaattcttttaattaaaatatttgtggttctttatagttcaccacagctttgaataaaacaaaattgttttcatgttttaaatgcagtggaaggttttatgtttggtgttattcaattggtaaggcaaattgctttgttattagcttgatttacgtgaaaatttagatttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacattctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaaaaagagttgcatatatgaataataataaaaccttcacccagctttcttgaaagtttacaaacttcctttctttgcttagaactagctcgagaaaggaaaaaaaaaatcttctcttagattctttgcataaaaaactaattcctttatttttctcaccggttctcttcatctttcattttggtccccagagaatactgtttgactattttgaaatcatttctcttctccactttgttgcactttgccctctgggatcgtttccccagctcactcttcttcctttgtcctactgctccctttacccccacctctctttctatagccaagaaagaaacttgttaaccatgactttttcttttaggaaccaattcaaaaatccctttggtacacaggtttacaggcaccctatctcagtctgattccagaaaaaaaagcaccaggaaatacaggaaaatatgtagctattaataaattccacagataggcagaagttgccaaaggaaaatgggagaacaacaaggactgttcattggacttccaggaatagaaattgttgggagtctactcttttcaaaataaactgacatggggctgaccaccttgtcagttactcccatctgatggtggggtgtggcaaacaagggcaaaggtattgtttggttttcaaggtcaggctgctaattgtataattggattaaccca

SEQ ID NO: 70789 - DNA, 1009 bp, Homo sapiens
tctgtgagcagtgaattggaagtgacaagactaggggcagggagacctgtttggaggctatcgcactaaccctggtgagaggtggccatggcagagttgctggagggaagggggagaattctagaaatgtttagggatacaagagaacagggcttgatgtgggagatgagagagaaggaggactttagggtaacttcaacatttcttgtttgtgcagctggttggttggtggcgctttttggttgacaaagggtatacagaggatgatttcttagtcctcttattgatagattttaatacaataaagtcatctcgaagtttcagatacatttcttcatgctctttctaggtttttctttcttttacatgtttcatgggtgggggagggtttaagagtctcaattgctctggaaattgaccttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttggggaaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaacattattttatcacgagttgcctgcagctcagagagtaaagg

SEQ ID NO: 70790 - DNA, 1010 bp, Homo sapiens
aaagcacaactccagtcacacctgtggatggtaacaagatgctagactgagcacgataggctatttctcatttttttttcctagtaaaatttatttgttctttgttctcatgtcttctgttagcattctttggaaaggcattagttagtgccacaggttttagaaaaaaactaagggaaaaatactaaagctgagaatgttttattaagtttttttttttctgtgaattagtaaaagactgtcatgtatgattttagcagaataccttgatccagattgaggaactccaaccagtaatcctgggaggcataatttaagaaccgctaacagaagcattttgaaagtgattgaaattgacattccttaaaaaggtagtttattgccttctgaggaacatttgtttagctctttaaattattcatatttgaagggaaagcattctacaagaaatcttatttttgagatatagctggtaaatatggaaaactcaaaacgcctgcctgttctacttgtcatcgttcatcctctgacagcttacaccagtcaagttactaagtctctggttatttttgagactctttctccccaagcgttccttagtgaatcttaagattctgggatttagcttagcagacaggctgtgccaccatgcagtgtcttctttggccctccctgccccattgcaatgtcttttactacaccttatttagccaaaaatgtgcagtcctttagtgatgagaatgtaataatggaatacttaaagtaattaaagatactgctttttctgattgaaacaaaagctaatagacttccaattgtcacctgtcacagtgtacttttttggagttgccctttgagctgtgttatctgatttgaacttttcaagcttcctctggccacactgggatttttctctggctatgccctgcagtccctttactgaattggcagtgctcctaatgcttttctctagctttcatttgaccttcagtagaggttaaaattaactt

SEQ ID NO: 70791 - DNA, 1006 bp, Homo sapiens
tatcattttaaactctctcccagagttataataggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacgtttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttcatctgtatagtgggtgcacttatacttatttatcttccaggtctaagatgagatcatatatgaaaagcaatagtgcaaacagtgaaagttataccatagaaattataatgccaacaaatatagtgtaagtgtggcaagttgaatgtatgctttatttaaattatcgtcttttgaggtaacctaatttataaaatattcagcctaatggccatcattctgagtctgtggtttgtgagtttgtactaatttgcatgactccttttaaaaagaaatggtttgttgtttgaaaaaatcaagttgacatcctttgtgactgttcagagtgtgtttgtggtttattggcttctagggcattaggtttctgtctcccatattgacagtctttatgagctcgttagccactgttctggtaaaagccatttt

SEQ ID NO: 70792 - DNA, 1789 bp, Homo sapiens
agaaagaaactgacaaaaacccaaaatgatgatcaatgctcctgtgagcatttggtgctcacatttaccattcatcgataattttgtcaagtttttaccagtaaatgattaataaaataaccttccagatacagctcaaacatcaataagcaatattttatcacatgccagcaagttttagatccaatgtgcccagcaatttttggttaggtacagacccttagaatttgtaggggcaggggtaagatgcatgaaataacagtaaactaagtaccagtatgaagaggaagacacacacccgtgtagaggatgtgcaaacacgtatataggtttgcattaggaggcctggttttcagaaaggtttctgtgagatgtactatttagagctgagttttggagggctgatggacatgcttaggagttggcatctcaagtatagttactaaatagtggtgaaagagcacgggttactctatagtctggtgtagaggatttttggagaagggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagaggactctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaagcacacacaatatatcctcttttatctgagagaacccatttaatatatgcattttctgtaatttgatatctttaattaatatatggaacagtctttcatacaattatatagttctactttattttattttaatcaacagaatagtggtccactgtactgcttttctgtgattcttatcgaacagtatttaaatttattttcttaatgtctgcatttattatgcactgtgttgcagagaacatccttatagcgatctgcaaacttgtaaaggggttatttgtaggggacttgcaatggaatttctaggttgaagagtgtgtgtatttaaaatttttttgaagactgtgtgtatttaaaattttgatagatattggggaattgtcctccagaaaggcagtaccattttcattgtatccgcagggtatgtgaatgcctgtttcctaaggctttttctttttaaagaggacttgaagccagagaagaggagacaaagagcagagtgggtactaaaagtaagtggcggccaagagaaacagaaacacaggttcacacaaaaacttgtgcatagcagcattatttatagcagccaaacagtggaaacagcccactgttcatccagtactgaatggataaacaaaatggggcatatacatacaatggagtattattcagtaataaagactacagtgtggataacctttgaaagcatgctgctaagtgaagtaagccagtcataagataccatgcatacttatgtgaaatatccatgtaggcaaatccatagagacagaaagaagatagtggttg

SEQ ID NO: 70793 - DNA, 3420 bp, Homo sapiens
ggtgggggaaggtgttctgccaggctatgctgagccaggtattcaggtggctgatgacaatcagctctaggggtggatggtggagttttttcccctaacagaatagagacaagaggcagttgatgccatgccctaggcagggtcagaactgaggttagtacactgaatttcttactcgttgttcttgttcagtccttcgaatacacagaagatactgttctcctggaaggcagtaatagtttcctttgctgacctagaaatgcctgctgtgctccagcatttggaaaaggaaggtcagagagaggaagctgagctcagctgctgagtcaaggaaaagagaaggaagacctaggggtcaccaacgaagatgaggccctcatttgtgaataagtgtagtcagttttaaatttagcaattaagctctttctatatagtggaagtgactgttcttttggaatgtgtttgctagtaaatatcataagaatgtttaaaaggaagttatgattttaagtgacctctgagttgtgctgatggataaaatttagctcaacggaatgagggttaatctcacggtatactcggaaagttaaagggaaatcaacacactttttcaccaaagcccgtttttcctggtgcttgcggctgtttgaacttgctctttgcttctcattccccatcatcgtggctccgtggcatacattaaatcaaaccatgacctccatacattaaatcaaaccatgacctccgaatcttcttagttattttcaggtacaaggttttcagcttcagaaaggacagaggtctccatggttccattttgaagatttttgggtggctactgcttgtttaccagcagtttggtatagaagcccaagacagtccatgtgtggttcagtattgacctaatagcagaataaatttggaccaaacagaagtccttttctttgtcactgtgtttgattaactatcctggatatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcctaaggcctggagctgagtagggagtaactaagcttagccatacttattagacttagagattttactttgtttatgtcaatgtcaaggcctttgggaaaactttggtatgcttagctgatttcttgaaatacaatctttctctcatgcaatttcctctcattcagtacgtgaagaataaaatgttgacaggttaaactgcaagacaatctaagttgctgtttatttttgtctgttagccaaatcttaactcactattcatagccacacagggtgtttttttttggttggtttttttttttttttggtttcagtttgtttctcctaaatacattttaaagataattagttattgcctgtattagaatttctttttgtgttcttgtgttaggattctggaagtagcaatgaattcacaggagaactcaacaatgtaagagcaagatgtttccaccacttactgagttgagggtataagattttatcctttgccagcccctttagaaattgtgactgtgaactgccatgatttaacttcaaaacacagcctgttctcttgtcagtggagccaaagcgttatgcctgaacaacgattataggttagtatagacaagtgaaaaagagttttattttgctggattctgatactacacatacttaggttcagctaaatatcaaaatcgccacagccaagatgtagtcattgatgaggactttaattctacccaatgtctgatcaatgtttcattccatagaaacatagatgtttcaatccagaaaagcctttctattttttaaaccacagattgaggaggcaatgagatggaaatactaccctgaacttagttctaactatctagaaaaattttttattgaagtagaattgactaaaaccttgggcgggagtaaccatgatagtattgtttggtaacttcaaaagaaagaaaagttggacataaccaaatagtagtggtgattttaggaaaatatatttcaaaggaaaaaaacatagatttttcaatatatagagggatttttcaacatatagagacttgaaaagagtacaaaaaaataaaaagaagaaaggaaatagagaaataaaaagaaagtttctgacagcaaaatcatcttttgagggaatgaggaaaaagaaagaaccttttttttttttttttgagacagagtctcactctgtcacccaggctggagtgcagtggtgcaatctcggcccactgcaacctccacctcctgggttcaagcgattctcctggcttagcctctggagtagctgggactacaggtgcccaccaccatgtctggctaatttttgtattttttggtagagagagtttcaccatgttggccaggctggtctcgaactcctgacctcaggtgatctgcccgccttagtctcccaaagtgctgggattacaggcatgagccaccgcgcctggcccaggaaccattttaagatcaaggaatttttgatgggcttggatattaagagaacatgtatagaagattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctctattaaagacaatgatgttcaaactggaatgtgtaacataaacatagttaaggataaactgaagcatgcacgatagataatgataataatagttgtgactacaatttcctgagtttctattcaggactgagtactgtaaaagagaatttagttgctttttaaagtacttactggcaggcgtgcgcggtagatattactgttatcaatcccatttacagatgagaaaaccgaggcacaggaagatttaatgacaaacctgaagttacacagtcggtaaatgatgggctgggattcagatcaaggtctgactaacttcaaagcctggctcttttcactggactccctgattcccatgcctgtcacatctagtgttttcaacaggattgca

SEQ ID NO: 70794 - DNA, 1160 bp, Homo sapiens
ttgttacgtgggaccagccatgaagtaccgcactgcaggtgttttggaaagtcgcactaaatctaagcagaggatgtgaaccccgtgcaccctgcagcaagagtttggcgaggtggcttgctactcactctcttccctgactgatgtctggttctgacatccagagcatgacacatgacagatgacagcgacacatctgcacatgcccaccagcacacccaggttttacaaaagccaatgtcattttttcagtaagtaaacaaaatagtggcacaagggatgtgcagaatttcacttgttcatttgctttgacatttttagggaatttcttgtgatagtcctaaaaatattttacaaacacatgaaaaatgaaattagccatttttctcaggcttcgacttctaacaaaaaagattatcaaatataagcttttgaagaacaagcataaataaatgttattttatggcttaaagttacaatttataggcttttactcttttctgaatatgaagaaagttgccacacattttgcttttatcactgcttgcctttgatgaaatctttgtaattgttacagtaacaaccataccttgcatctttctcacatgcaaaaaacacaaatgctactccacttgatctatcttaatttactcattgtttaaaatttatccataaacaaaattaaaaataaaaaaacttaaaaattataaaatcagaggactactcctgggagccagcataaaataaaacaaaagagctcagattttggacacaggcagacctggatttgtgggtgagaaacttagtcccttctctgctttgatttcctcatctgtaaaataataataataataataataataataataataataataataatacctatacctgtaacttggaaggctgatggtaccaggacagtccctgggggaaaatgtggcccagcaaatgatttcttaagaaatagaaggaaagtaaaaaggaaaggaaagaggcaaaaaaggagggagtagcagtgactctccccaggctatacaaattgggttataacccaggccttctgccaaaattctgcctctcaaatagaacacttgactgtttttattatgtgaattttccatacataacaaagtagaggaaagtgtaaagaaccccca

SEQ ID NO: 70795 - DNA, 1021 bp, Homo sapiens
tgtgtgatttcacttgcacgtggaatctaaaagagttaaactcatagaaacagagagtagaatggtggttaccagggctgggggttggggtggagggcaggtggaggtgaagttagtcaaatgtacaaaatctcagagaggagaaataagttttgagatctattgtacagcatggcaactgtagtagttaataataatgtttacttcaaaattgctgagtaaatccaaatgttcacaccacaaaaatataagtacacgaggtgatggatatgttagttagttgagttagctagctaactaaccataggtataagcataggtataagcatataaaaataccacattttatcccctaaatagatacaattattatttatcagtaagaaataataatataacataaatactatattgtttcaaaatagagggaagaaaacatgcaaatagtcctaatggattttttttttttttttttttagtctccaggctggcttccagacaaggctgtatggtggcccagactggttgaattttttcacttaactttttgttgatctgccttaatttccaataactagagattctgataagaactttaagaataggaatacttctgagaatcttaagatgttattagccatatataagtaaccatacattttataaaagcatttttctcttcacaatagctggaagtggaacatcctagagaataactcatttttgaaaaatagaatgtcttaggggagaactggcctgctaagtattacaggggaggactcaggacaaaatcaagttatcagatacctggggcttagaaagcaaggagttagaaggtagaagaggcttacagaaaggaggaaagaagatgctggagaccctctttcatctattatagaacattttctatggctggcctgtattcagagaaggatacctatcttgctgctttctgcaccaaatagttccaagatccaaaattcaagctagtgctcttagtgaatagtttggttatattacg

SEQ ID NO: 70796 - DNA, 1161 bp, Homo sapiens
aagaacgaggcagccagccctccagctgatgaccagagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccaatgagtacatccatcagtcagcaagtatttatcgggtgcctgctatgtgctaggcactgtttaggtacttggtttacattggaaaacaggcctggggatcttacattctaactgggtgagaaggggtctgacaggcaataagcattataaataagtaaattacctggtatgttagaagatggtaagtgttatgcaaaaaaaaaaaaaaaaaaaagtatagagcaggctaaggaacagaggtagcatgggggtagtgtgtgattttaattagggtgggtggggaggcccccattcagtgggtgtcctgggagtgaagacttgaatgaggtggaggagtgagctgtgtagaaggagctgtgtgaagggagagctcaggctttcgctctagctctccctcacacagcctgttctcatgctgctaataaagacatacctgagactggctaatttataaaggagaggtttaattgacttcacagttccacatggctggggaggcctcacaatcatggcagaaggcgaatgaggaacaaagtcatgttttaattgctggcaggcaaggagagcctgtgcaggggaactcccatttataaaaccattagatctctcgagacttattcactaccatgagaacagtatgggggaaaccgcccccatgattcagtgatctccaccgtggggattattacaattcaaggtgagatttgggtagggacacagcaacaccacatcagttctcattttattatcccatgagaacatccagctcccctttattgcagcactgtgcccacccagtttctcaaggaagccaatgagactagcagacattgtcaggtcac

SEQ ID NO: 70797 - DNA, 1002 bp, Homo sapiens
acaaggcaatgtgtataaactaactgactaactggcataaataaatagtggacttcaaaaaaaattcataatcctagcactttgggaggccgaggtgggtggatcaactgaggtcagaagttcaagaccagcctggccaacttggcaaaaccccatctctactaaaaaaatacaaaaaaaaaaaaaaattgtattctaagttccaggaatgtcatttagacatagtttcttttggggctagatgtatcaattttcattaaaggtgatattattatttaaaaatccagctggttgctaaatgagaattagctaccctttataaccagggattgtttcaaagaaatgtagttattttctcccctgtggcctatcttgtgcaaagttagtaatagtttgttgccaaatccaaggaaagcaaactctggctcaggcatgagatttatttttctcaccatgatttacaactggtgtaaaattcaggtctggacttggttagttataatgctatcgcaatataccgcatcttgagttgattttgccatatcctgtattgttatgtaaaatgctaactttaattgagaattgccccagtagaatatccttatttgtcctgcatgaagtttctcctcttttgtatcaattttttgtatggttcaaattagtgcgggaagaaaaggcaggaaatacaaatttaagggatatgtgttatatcataaaagaattgtatcacaaagcattaagacaatgcacagaaaactttgccaatagctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgca

SEQ ID NO: 70798 - DNA, 1056 bp, Homo sapiens
attaaaacctagctgcacaggccgggaaattgtcaaatatcagagagtctacagttgaagcagcttgggaacaactctctgcagtaaaaatgctgagttgtggagaacacagtgacccaaactgacaaaataatgaaatacatggcgtttccccagtgaatggaaagctgctttttaccgtgttccaaaacactggctccgtttggtgtgtgttttgtttttatttgtaataccctactttgatgtttcctggaaactctcctttgagtctgtgagttttggtgtaagctcagtggcaatgttaccctcacctctaggctgctgtaggacacaccccggtctcattttcagtgtctcagcatactttccaatgcttccagtaatggattgtgcaaaacacaaagccaaaagcagatgggacatatgtagataagctgtttcatttttcatccctataatttcctaggtttgatagcacttcaattttctaaccataaaagctgcttctgtgctctttggaaaacacacacacactcatacacacacatacacacacacacacacacactaccaggaagcaggctaaaagaatattacatggggtttttgtgttgttttgcttatttctttccttttaaaagaagtaccttgctgctggaaaagaagtcaaaaaattgctttgaagagtatatttactagagttcagtttacttagggaactgtcgtgttaacaccgaagaatgcattagaatgcatcattctatgatacattatccgagctgaagctgaaacctagccttctgccgagtggtattcctgaagccagtcactcttagaagtgataatgtttatttaccagaactttaaatgctgattgtggtgtctgtgtctcctgcccagggggaatggcccttctgtccatggaatgtgatagcccagcaggaggtaaaagctgcccctggacagagtgaagcatgcagagggaggcggagtgaattacagctgtctctttggaccacccgtctttttgccaattaaatgtttacattatctttt

SEQ ID NO: 70799 - DNA, 1032 bp, Homo sapiens
ggtctgtagcatgacttggctggcagagattgaaagcaactgagaatatttgttctggtggtcagtgaattctctctaagcctcatctacatagctacaaccccctgtgcagaatttggaaataccacccagtgggtggaatagtacctgtattgtcctcttaggttttaagcagaccacttcttcctccacagttttgctgatatctatgtggtcttccacatcgaggcccttatcaaagctcccaggcccttttggtggctgacaggaaaaagaaatgagccagtcttctttctagtctgctgatgagtagatggttgaaaaaagattagaggaagagctgtttaataagttcgcattggtgctgagagatgagttggacacagttcaatcaacatgaaaagtctctctgacatggcacagttaagacgtggctgaaggaactcagtgcctcatcctctctgcccacccaacatggccccagacgattgctgggcattcttatgcttggtgatagtgcccccatgccatggtttaaagtgaggaaggcttgtggtgttccttcagtaggtgggacttgggggtcactcccaacattacagttgtcatctttttctttgtcatgatttaatagctcatggtcattcgccagcagagtgcaaatgtacactggagggtggagtggaacgtacaagaaaatgactctttactcaaagtccaatgactgtctttaagctaaataagagcattcactctgctttagggagggatgagctattgcctaaaaagacataacatagcatagcatagcatagcatagcatagcatagcatagcatagcatagcatagcatagcatagcatagcatagcatgccatagcataatataatgtcagatatgtttaagagactgcgaagtctaggacatcaccttagcattctagcaccacacttctcagagagtatgtttagtgtcatgaagtttctctcgagccttttctccaaaacattcaccaaaaccatcagtggtta

SEQ ID NO: 70800 - DNA, 1030 bp, Homo sapiens
gttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttaaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtg

SEQ ID NO: 70801 - DNA, 1039 bp, Homo sapiens
tgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcaacaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgc

SEQ ID NO: 70802 - DNA, 1398 bp, Homo sapiens
tagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttcaagttgagtttaaagattgttaggggcaggcgcggtgactcacacctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtga

SEQ ID NO: 70803 - DNA, 1095 bp, Homo sapiens
ttaattgtctctgttattagcataattttatcatgtagactgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatagaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattag

SEQ ID NO: 70804 - DNA, 1062 bp, Homo sapiens
acattagggaaaagcaacgtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgaggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttct

SEQ ID NO: 70805 - DNA, 1041 bp, Homo sapiens
tgctttgtaataatagttgttttcaaggatggttctattttcatcacactatgctatgttgggggtattttttgtttctgtgactttggtgttataaacttttacctatgctatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggatcctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttg

SEQ ID NO: 70806 - DNA, 1057 bp, Homo sapiens
gaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatga

SEQ ID NO: 70807 - DNA, 1040 bp, Homo sapiens
tttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagggaggtgaggagagggctcgggtgtgaggcttcacatgttggttccttctaggcactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggagg

SEQ ID NO: 70808 - DNA, 1047 bp, Homo sapiens
ctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggttta

SEQ ID NO: 70809 - DNA, 1047 bp, Homo sapiens
taataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaa

SEQ ID NO: 70810 - DNA, 1067 bp, Homo sapiens
attctcaccattgacatggatagcctgtcccagcatgattgggggggaatcagggaagggggagttaacatttgtttggaaacaaagcatctgatgaatgtgtctgtttgaatttccaaagaaaaaaacccagattaaggagaattaatcataaaggagaatggtttattgaaatagtcgcttaagttagaaatatgtcataatttcatataacgattgaatacagaatctaggcaatttaacaagcttagctttcatttttagcaaattacaatcaagcataagctgaccccatttaatagggccactacttactcatcaaagttaacttgagtcagggtggctgtaggccccatgaactcaaatgtaaattcaggctggtccaaatgtgggcagcatgataaaactgtaaggggggcagccatgtacagggtctggctcagtgccaggatcccccatctcagacaggcttcctggcttccctttctggccttttgggatgccagagctgttctgaaactgacagaatgctataaccacatccttgtgcctgattcaaaggttaaaaacaatgttatttaaaatcttacctcatcaaaatattttacgatgtatttgtaaatttctgtcaaggccacttcttcattaaattcattttcatgtttctaaaagaaagacttgttgagagattctgaaatgacgtaaagtaaccaaatataagcttatttctgctttctaatgataccttagattcctgagttaaaaattcttccatttctgaggatgacaatggaggcaaatccctgattgctttgtaataagattttacttcttctttgtaggttgggatatccttggcatagagaagcttattagttggtgcttcctggggaaaaaaaaaaaaaaaaagcaaccatcaccaaaagagtaaaaaaaaaaaaaaaaaaagatggaggaatttataatattccaatgtagctgaacccccaccaccaaccagttttacctcttgctaacaaggcttcatgcagtaggccttaaatgttgttgactgaatgactgactgc

SEQ ID NO: 70811 - DNA, 1585 bp, Homo sapiens
caagcccctgaggtattgaaggaatcagattgattctttttcagaagatgggagtattaataagtaattatgttttataacataagcacagaagattttaatcactgaattgaatctcaggccaagtgctttgtttataataaactgctgttaaacaccagtgttgttggaaagttaccatgtaagtatacctgggccctgcattagtattttctaattcactccctggtgaattttatacctagagaagaacagactacgggttttgcttaaggctagagcctgaggcaggagagaagcaaaactagatggtagtttagcccatgctactgtttttagactgctacagtggtcagcatttccttgccagatgttataggcatatataaaagaggcagtccaaggttgctacctaacagtttttctaatagtttcttttgctatgctttctctacatcattttaaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaatttttttttaatcgtgtgtttaattttacatcaaccatatagcatatatttagcaatatgacagtctactgattttggctttgttagaatagagaataagtgcaaataattaaatcctatggctgtattaacaagggggccattgattataaaacttgaactcaggtccttttataaacattgttggtatttaactttacttcccattactgtggatctaaccaaataattatgtgttttgtgtccctaagtatgctctcattttttttggtctacacccattggaagcctttttaatgtgacatcttttagaggaattctgctggaataatttcatgttaacgaggctaaagctcaagtctcccaaattaagtggaatgttcattatcccaaggtgttcatagtcaaaagtcccagttgatagtgaagaaggccaggactgtaattgagcagtccttagcaccatttagcaaactaggtttacttactaca

SEQ ID NO: 70812 - DNA, 1033 bp, Homo sapiens
tagctaactgtagccttgaactcctaggcttaatccatcctcctgcctcagcctcccaaagcactgggattacaggcatgagccactgtacctggctcagttctcttaaacacatgctatcttctggaacaatggagagctcattatttcttaccagatgtacaggcagactcagtagtaaaatttgactccttccctttgtagattttttttttgcagcaattattgataacagtttttttgtttggcattcataattaattgtcacattgagaatattagatagatttgtggtttattatctttgcaattttcagtaagagccatgtctactaacctttgtttctagtattcactgaaaacattcatatctaaacacagtttttggtgagtaaaatattttctatatagttttgttcaaataagagattatgtattaacatacttgttcatatttctctttttagagaaaatctcttcatgaaaacaaattgaaaagactacaagagaaagtagaagtcttggaggcaaagaaagaagaattggaaacagaaaatcaggtcttaaataggtaatgtgtttgtatgtgtatcttccccatgtggttattttgatgtcatagaactttgtctctaagtataacgtaccttcttttcttttaaaatatacattttaaagatttctaaaacagcttgataactcctaatgtactatcctttttttaccccctaactgaatgtttctttaaaccaaaaggtctctgtcacataccaggtgtttgccttatgattgggactaacagaaaatgtcactggctttggtagcaaggagtggtgttagttgttgctgctgtacaagacagttgtagctattgcatagttctgaaaattgtgcctacaactttgaatcaaaggtcagttttggtttcctggtgtggagattttattgagctgtagtttcgggttttgcagtcacattcaagcacatctgataatcaggatcatcagcatttttaaagcagagatttgtcata

SEQ ID NO: 70813 - DNA, 2002 bp, Homo sapiens
aaaataacttgggtactaggcttagtacctgggtgatgaaataatctatttacctataaaacaaacctgcacatgtacctctgagcctaaaaaaagttttaagaataaagaaatggacataaagagtagacaggaatttaaaattattcacagatgtcactgtgcatgcataaaagtcaaacctatcaaactattaaaattaatatgaatttttaaaatttctaagtacgaagtcaagtaacaaatactagttatttttctttacacacacaattagaaaatatttaaatgccatttacaatagcataaaaatacctaaaatacctaggaacaaatctagtgaaagatgtttatgacttctacactgaaatacaaatactgctaagaaaaatggaaaaatgcctaaagggaaaactgtaccatgttcatgacttggaagattcaatattaaggtgtcagttcttcccaaatttatccataagttgaatgcagttctaatcaaaatctcagcaggtttctttgtagaaattagaaagtagattctaaaattcatctgaaagtacaaaggactagaatacccaaagcaatcttgaagaacaataaaactagaggacttaaaactaccaggtatcaacactaaatataagctacagtaattcagtgtggtattggcataaggataaacaggcaaatggaacagtatagagtccagaaataggtttacactaaaggtaccactgcatttcgataaaggatgttccttcaaatagtagtgagtcaatagattaaactcagcctaacctcacaacatagataaaaatgaaccatacacctaagtgtgataggtaaaaaaaaaaaataaagcttctagatgaaaacttgggagaaaattttaggatcttgggataataaagataagcaggatgcaaaaagttcctactataaaatacatgattgatgtaattgattttatttaaattaaaatctttttattaagggatactcttaagcaaaagaaaatgacaccacaggctggagaaggtcaatctgcaatacatatatatctgacatacgattcatatcttgaatatataaagaactacaaatcagtaggaatcaggttactcaaaagttttaatggacaaaagactaggatggacacgtcacaaagaagggatatccagatgactaacatgcataaaaaaagatgctcaatacctttagctatcaggaaaatgtaaattaaaactacagtgagatactgtatttcaccaaaacaggatgcaaaagctaaaagaccgaccataccaagtactggcaaaaatgtagaacagctagaactctcacatattgctggtggaaatgtaattggtaaaactgctttagaaaactggcagtatctactaaagctaaaacatgtatacactatgacccattcataggtatatactgaagagaatgaggtacttaatctgcgaaaaacatgtttaggaatgttcgtaaaatatttatgatatccccagactggaaagaatttaaattttcattaacaggaaaatgtataaaatgtggtatatttgtacaatgaatgacaacattgcaatgaaaaagaagtactgtgacaatacataaccatggcttagtcatatagataaaatgttgagaaaaaagtccagatacaaaagagcataaatttatgatttctttcatatgaatgggtggatggatagacagatggactccttaactgcctataaattcataaataaatacttatggtgataaaaaccagaagagtggttcctttgccagggtagacaggagcataaggaagccttctgagatgttggaggatgtgggacaatcaaagcatgagaatgaatgctcgtagcagagttatttgtaatagtcccaactggaaataatgcagataacccttaacggtgtactgagtgaatatactaggttatgcaataatcgtaagtggaatataatatgtggg

SEQ ID NO: 70814 - DNA, 1049 bp, Homo sapiens
agtattttagctgtgagaagatgtaagtggagttatgataatggattgaagaatgtcagttgagtagaaagataaaaaacacatgtcagataggaaatgatggcagtgcatccatgtagacatgacgtagactcttaagtaaagatattatataggtaactagaaataatagaatgtgaagtacagagatgaataattcaaattagagaaatataattagaaactcaggattttgcagatcactgaagaatactaagtttacttagaacgaggagctaggtgtggtggtgaacagaggtagaagctatattgtgatgttatgggaaccaaaggtaaagaaagttatcaaagataaatggtcattaacatgatcattgaaaaaaagttaattggatttgactagagggtggtaaaaggggaatcccagccttaattcttatatctatattgttttaattgttctattagtcctttgtgtcatattgtttataacactaaggcatcgatttgactatcctgtgattgtgttggaccactcaagtaaaaattagaatcattcctttccactaattttacctctggactttgcatttctttcagtagaagttattcttccagtcacttaggcttcaaacctgtgattcatcctgaggtctgccttatctccaaatttagtcaggcactatattagtttcctagggctgctatgacaaattaccacaaaccttgtggcttaaaacaacaaaagcttattctctcacagttctggagcctagaaatctacagtcagagtgccagcaggagcatccttcttcaaaaggctctggaggaggatcttttttcatgccccttgtgtagcttctggtagttgctggtaatccttggagttcttgggttttagacaggcacatcactctggtctctgccttgtctttacatgatggtctccctgtgtatctgtagctctgtgtccagatttcactcctgttatgtaaggacaccagtcatagtggatttagggcccactcgaatccaatctaacttcatct

SEQ ID NO: 70815 - DNA, 1011 bp, Homo sapiens
tgtggagaggagagaagatctgaggtgagaggaaaatgcttctaggtgcaggaaccattatcttaatatctgtttattggaaaggttaactgtttatatttggataagagaaaataactgtagatcgttcagttattctgaatttgaaaaccacacagcagttcctagacccctttttatgtaattggatatcactgccaaatgttgctgatggttggagtgacaacatgagtagtctaaaagtcattccttctctactttcttggtctctgaatattacttttatcttctcataatgctagaagtagtattattggaaaaacagcatttattatatagggatcccagtgttttatacccaaatatgcacacttgtttgtttttctgtatatgtcacttttcttcctttctgtcgatgtaggtactgaaaagtgtatgaatattaatgggatttcagaggattgttttatgacctatgaactcagaaatcctactgatttttgtttgcactgtgtttgaagcctagaaacatctgaagccgtgttacagcaagaaattttaagagctaaattttgaggctttaggaataagtatcttacagatcaaattctaattattaaggttagtttgggttgaattcttttgaagcaaaagtgacacccagtggtgagattatcagctaatcataagtataccagaaggagtggaggaggttatatttttaaaaatctacaaaatatagccagaccccatctctataaaacatgaaaaaactgtgcatggtggcacatgcttgtagtcccagctacttggaaggctgaggtgggaggattgcttgagcccaggagttcaagattgcaaagagctgtgatggcaccactgccctccagcctggatgacacagcaagaccctatctcaaaaaaaaataataattaaacaaaaaaaccccaaaacactacaaagtaacatttcattagtattgtgacaggatgaatttttttttctactga

SEQ ID NO: 70816 - DNA, 1120 bp, Homo sapiens
tgctgatctcagggtatgtgggaagaggaggatggatttttttttttagctgctttcccagctgacttgcttttaaaatcagttttttttcctaggaggtgaggagaaggctagagtggtaggagactcactctaatcactggattcccttttctcatctcactgctaatccccctgataacccttctctccattcccaatacctctcctggcctgcatattttggaaagaagagggaggggactcagtgactgaggaatatagttcttgatagtctctgattataataagaaatgctcctgggtgctgctatttgttatttcctttaggggtcatctccaaggacacaccagcttgagggagcatttgcaaagggagatgcttagtatcttctgcttctctcataccttaccgcatttatttagtgggctttaatttatcttctttcttctcttttaagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagtagagtttgctctttatgtacaaactattttttcttttttctatataacatgtacttattttagtaatgattccaatgttgattatattttagaaactagttacaaatacactttaatagtgtacaatggtctactgaggtaataatgtactttatgtttttatagaatgaactatactgactcttgaattgtttttaaaaaaattaagacattaaaattctgacagtatagtattctgaaaaacctcaaagaaaactttttttattcattgattaaaccaaaacatttcttcaaaaatctattcttctgaatgccagagaacagaatgggttttttgttttgtttttgatgtgcaaaacttaattccttgaattagaactatcttggattttctttgaaaagctaatttatttgttttttttttttttttttttggtcttaaaatttgttactagtagacagtatggagtaaaactggtagggataaaatgattgtggtg

SEQ ID NO: 70817 - DNA, 1131 bp, Homo sapiens
gtggggtgtggtggcagccacctatagtcccagctactcaggaggctgaggcaggagaattgcgtgaacctgggaggcggaggttacagtgagccaagattgtgccactgcactccagcctgggtgacagagtgagactctgtcttaaaaaaaaaaaaaaaaaatctagagacaagtttgggtctagttcacatgctcatccctggacctaccactgcgaccgtggtatcaggcactctggctcagccaaggttatatgcccatgtctctgtgtggagtgggtgaaggaggaggaagtaaatgatatgcagtttgatataatagcaaataaccaaggggaatagcaataaccaagggaaagggaagctgaacatttatgatatcctgtagtcaatacccccttaatttattttttgcatggcttaaagccagggctcttatttcccatttggggctttctgtttttttcttgagcttttaatgaacgtttacatttcatcagtttggatttctttgctgccagtgttggatatttgcttttttaaaaacaaaccaaaaaactatcatttaatatatccacctttctacttagactccatcttgaaaagaattatattggcccattggacacattttctcccaagaatttaaactgtgaagtaagggatgaaaggatatgtgtcaatgtttgaaggaccaggcagggctgtggcatgtctttgcctgtgattcctatcaattattgtatcctggtttcagttttctagttctcttttgagtgggttcttatattctttcaggaaagtttatttttgctaataatggccagtgtcaatttccagtgctcacaagcaagaaccatgctttcagaaggttggtataagaaggctactgccattctcatgagacttgtaggactctttgacagtagagaaatcacagtagaaaaatacaacttctattgtttgccctgtatgttgcttccctttgatagcagggactcacattaaatgaagccaagaagttacattagagcctttgctgcccaatatgatattactagtcacagatgactgttgaaacctaaatttaaattagaattttaaaaaattaaaattcagtttcttcagt

SEQ ID NO: 70818 - DNA, 1048 bp, Homo sapiens
atcctcaacacttggaaatgctttatgtctgcttttcaaattctaatatcttagtgacgtctctaattatataaagtttgagtggcttttaaaaatcatgttcattaagtggtaggctatgttttgagacagagttcttgatctgcattacttaggaaagaattacttcaggcagaggtatacttattacttacttaggttttataactttatttaaattgttagtggctgtgattctaaaagcatgaatctgtaatagattttaagaaccaatcttgtctgtccttttgcttttagatgggtacattttttaggacatattcaagacaggtcgtttttaaatctctctttgacagtctccagaaagtaggggtagaccctccccaggcatcctactctaatgttttatcctatgataatcccacagtttggccagttagaatcttttctgttagaatttaagcctgtttctcctgctttgggtttctgttgccatagtgataaaatgttcagcattctgtcattacttgaacacaataatgaacttgacccttaggttttgttttgttttgttttttagttttttgctatataaaacagctttcattcctttagcttttcttaaatgtgaataattttctattctgttagtcacattgataatttttctttgattcctctggagtttcacttacaatgtgtaaatgacctcaacttattttaaaataaagacatagtaaccaacataaaatctagcaggattaaattcacacgatttgcatggctttttttttttaatgttcaacaattgtggtattttttccttgacagttatgatttactgatttataagtccagctacatcaaccaggtctattttgatcattcattaaaatggtcataattgcagcacctcctatttagataacccgtgacagattggagacttatctgtgaagcaaaaggtcttactaaggaaatggaaagtataaatcatgcaaagcagaaatatccatttatttacaaataatatatatctgtgataagt

SEQ ID NO: 70819 - DNA, 1787 bp, Homo sapiens
tgtctcatcagatttcctcattatttatgttgtttctaacttgaagtatttaaataagcttacctttggcctgtagctatgcttgagttgatctgtagttgaactcatttcagacagagtttatgatgaatgcctttcatgttttgaaatggggtctcaccatgttgcccaggctagccttgaactcctgggctcaaatggtcctcctgcctaagcctcctcagtagctgggactacaggtgctaacaccgtgtctggctgctatgaatgattttttccaattgttaatttctatttattgactcatggatttccatagagttaagaagtaaatttttttaggaacttaaagaatgctgcattttgttttcactttgagttagatgtgaatttgctttagttattccatctgcaaagtatttgccatttcattgcaaagatttctgaattcattgtacaaacttgaaagtgtccatgttatttatacttctgctagagatctagcaattctgctagaatcaataggttttgaagggttttgtgatttatttcactctgctatcagccagctttttctatgaggcttaggtcacagaacctctttagaggtgaagtaagtaaacctctggttatcatccagtttgatctcaactctcaatgttcgaatgagtaaatgtatacagcttttattaaagtttttatatgtgtatgcactaaataaacagtgacaggaaaatttgctctgagttttagcctgtttcattcttattttaagagtgtttattaatgatgtgagtattgttgagaatatatatttgtagagactttctacattcatttgtcttaccagcttatgaatgcttgctgttaaatgtgatttttcatcttaataacattgaatatagtacacttttctccttgaaaaacactaggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagtaagtacttaattaccttagtttgacttaaatatccttgcaaatgaaaacattttgctgtcatatcatctttattatagttcttgtaacataattatgatctcttgttttaggttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttatatatacatatatatttaaagtttttcatgttgaaataaggtcagagttaacaaaatgatgtacaactagtacaaagaattcccatgtgctcttcaccctgatctcccaaatacaaatacctatgtaaccatattataataatcaagattaagaaattaacatgaatataatcaggaaatcaggcattactattataaaatctattaactgtacttaaattttaccagttgtcccactgatgtctttcttctggtctaaaacccaattcaggatcacatgttgcatttagttacttttaatctggaacttatgaacactttgacaaatacttgtcagtattttgtatatcctctctcattttggttttgtattgcatttttcatggttaaattcaggttaggcatttttagcaaaacatcaaagtcatgtgtcctcagtgaat

SEQ ID NO: 70820 - DNA, 1025 bp, Homo sapiens
agctatgatcgtgccactgcactccagcctggatgacatagcaagaccctgtcttttagaaatattaacaaattttaaaagtttcagggttttttcccctgcagattttccaatcattgagtagttgattttagatacttgtaattaagtctttaaggcaagattaagccaaaggaccatacacagatattcgtaaagaaatgcctctgttctgttaggaaagaacagtattttcttaatgtctccttacttgaagtactgttgcaggcactgacacttctttcttcttggaagatacttagactctactttactaccagagcgttttcttgtttccacttatgttttggggtaagtattgaatggcaagaaaatgaccaatagtaatttcagtttttaattatcaacaggtaaaagaacttaaacattcaaacaaactggaaataacagacatcaaactggagacagcaagagctaagagtgagctagaaagagaaaggaataagattcaaagtgaactggatggtaatatgtgatttcccttgctgctgctgctgctgcttattttcagatatgaactcaaattattaaaatagttgaatctgaatttttatttccaaattttcaacttaatttagttttaattttggagtacatatgaaatgtttattatatgttgagtgttttgttcattgtaagatttaataactttaaaaaaatcagtcttatgtttttatcatagttattggatacataaatgaattttgtaaatgggatgccatacttcctgatttataaattttaaatctatttatggtgtagttattagtcccaggacattttaagtctggagaatgtgaggaagataattgggttccaggcttaatttttttcaattaaaaagatttttttatgtagacctcaggccagttcattgtagcctagtgcagagtaggcttatttatttattttttatttttattttttatttttgagatggagtctcgctctgtccccctggctgg

SEQ ID NO: 70821 - DNA, 1573 bp, Homo sapiens
accaagtataatacttttcatgcagtacattttacctgagctccctagctcacctgtgtgctgaccctgatttttcttctttttttccatatatatatactcttccctattgctctttcctcttagagttagagcctaggtgatttctcctactccgctgaagaaagaacagcaatctagtatagtatttatttctctgtgcttgtttattaatacacattgctaagagttgcctgtctttttaaaggcacacttgccttattttgcatataaatggagtattaaataccatccttcaactttaaacaaaccaagtttcatttgaagtcttgtatgtaaagattccattggaagggtagattttaaaataatatttcaaacatgactgccacagttttctttgcaacttgaagttttcatcaacattttgcaattctagcaaatggttgtttgcagtgcaaaggaacacctggggtgtgtttgtcttagttactcaaattcataaatgtttgtcagattttagaacaaagttatgtcagtgtgagtatcagtgtcttggattaaaaggtattaccaaagatggcctgaaaatgatgaccttaaagagatttcacattcagtgaggtaaattcttctagttccctcataaggtttttcattttcagaatgccaataaaaggtagttttaagaaagccacccaacagagttgtccttatttacctaaattaattgggtaattacatctcagaactttgaaaaagatcaagatttaagtaccatctctttggaatctgtatccagagcttcttaggtaatacatattgtcaattatatttccatttcttgcttatttatgctgtgctcttgtgtgtctttctgtgagtatgtgtactttaacagatactgaccccctgtaaaatgcccagttttgccagttttgacatttattaaagttttgttagtaatatctgaatacttccattgtgtcaaaacataaagcaaattcacaacataaaggccagaatctatatggcaaacattctgtgaagaacagggtgacttggtccagtggagctttaggagaccatgaattgcttgaaattttatgcaacattttaacatgagcattttatttaaaaaaaaaatccctaattttcctaggatttgggacttgatcacaaagaagattaagaaccaaggatctaggggcagaaagaaactttactgtaacatttggaatttggttcagattactcatagaaaagtgctattatttgtcattactgggtaatacattttcatacgttaagtaaaattccttttagtatatttttaggaaattaacagtgttcatataagtgatgcatcagtgatgttaggataatagaaataaggcaataaagaaaaactttagatccataaatgagtacatttgaatgcagagaggacaggtaaattgcttgagcatataccactggtttaacagcaaaagtaggcctgaagacagacctcacttgttgcttgacttcctattcggtgttctttcagtttcaataattgtagtttagttaa

SEQ ID NO: 70822 - DNA, 2113 bp, Homo sapiens
gatcaaacagttgtttcttggaccacttttgcctaaggttttggagcatttctttagttttttctgtttttgttttttgtttttttttttttttttttgcagggccggggagcttacagtgagtctttgatgttcatcctggctacaaacaacctcttgtcctgttttgagcagtggttttcaacttcttcttaacaaacaaaaaacccagctgaatcatttacttaagttgaatcatttgaagaaaccccagaaagagactaaaaatagaagcgtatggttaatgccagaaatttggtgggggtggtggtaggggatagatagttggggagatcaggaaagggaaagaatgagttctagaccctgattgcttgcccctggtctccagaggtgaggagcttctgaaatgcctcagaggttaggaaacagtttgaaacccactgatttggaggcccacgaagtccagcagtgataattggcatgaatgacaagaccactggtgtctctgctctgcaagttccccagtgactttaacacctgccctggagtaatgatttttcaattcttcttgaatctaagaactaagaactaggccatcattacaattaggactttaataaactctcagctatcatttaaaaactctcatcaatcacatttgcttttatgtacacagacaggcagtttttgtgtgaattaagttgccctgacatagataattttattagtatagactagctcaagaattacagtcatgtgaggaaaagctttggagtagtcagagttttggtcatgaacccctataatgttatgatgaattttaaaatacttgatgtatgtttagtacttacagtattataattttaaattttagtcagcaactgattaagccctgttctagacaccacgtggagatacagggaaaacaggacacagtccttgacctcacatttgagtcccactaagaacaaaaagatagtgatacttaaaattttttcctttgtactttgtttcagcacctgagctttgattttgtgcattttttaattttactgacttgtaaagcatgttcatgactgaaaatttaataatttaaccttgtatgctttctttaaaattattattagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggtaagattctaattacttcccagtagagtatggcatacttttttaaagtgcagttgacaagcctttgatttttagagcataaatgtatgccccccaagctaatgctgatgcatttgtgtaatcccaagagtatttattcttttagtaaagaagaaagctattgattcataagcaatacgtatgctaccacatttacaaaggggtatttattctttgggagtcaagtcacctatctgaaatgtcttaactcttaaaatgccacataatagaatatgcaaaataaaaatatatgtatttgagtttctgagcgtaaagtcatctcaaaccagaaagaataatttctttcaagatagtacattccttacactgggatttgaggtcttaaagtcacaaatcctgtttgaacagaaataccatactgatgtatcttacgacagcttcttgccagagtagtaaaatccaactgtaaaggtatacatgcctttacagaattatttccctgggttcattagagaaagataagtgttggcagacctgactggtactcctacgggtattgccttatgaaaattcttggtttccattttattcagatacacttattcttcttagttcttagtgcctaacttgtagcaaacatacctgtttaattgtttttatttattttgtatagttcaaagtgtttctttttcctttggaatagttataaaatgatttgggtgggggggacatta

SEQ ID NO: 70823 - DNA, 1621 bp, Homo sapiens
ttaataaaggggacaggataagactgcagataacaagtatattagatacttggtagacattttatatatgttaccttatttaacaaatatacctggccttatacatacaaatgattattgtccccttcaaaatgggcccctttggagagctgtagtctagtgatgcggtaattgcccaaaacagttgtagaatcgtcttttataatggcttactggcttgataatatgatctttctaatacagtcctaatggcaagccattatggtttgggagtaggtttaatttttgtaaataaacaagatcagacccaagataagtgaccaagttcaataaaaacttttttttttaaatcaaagcaaagtatatctgcagtaaaataatgaaacccattttcttggtttacaaactggcttagaaatctttgaactaaagatttatggtgagctgggtattttaggagacatgctttccttgttatcgaatttcctgttagtgtctcctgtatctttctgctttgtggcctgagtttcttgttgggtattcagaatgccagcagctttcatagagtactgttaggaagcaggatgagaacactccagggaattgcatgtgttcctggttagtcagtagagatgatgctgcacgtattcttcaggttggtctgttgagttaaactatcattgtaatatttaattagatgttaaaatgctgtactaaatattacaataaccttacatctcttttgaatttgttttacttatactaaattatacatttaaaaaatctatattttgaaaggtgtgctacattcttacatgttattttatttaagtccagagatcaacactttcctcatactatacactttatcataatgagaaccagtgaagaaataagattaattgaatggtaatttactttttggatatcttttcaggaatgtactacttctgtatgtaggatacttgttatgaagacctttccaaattcatttgtatttctgttaaatttattttttacttttagagtggctatcattataatgtaatttaaaattatatttgtaaaagtgactattggagtgagtacgaattttgtttataaatctatgataaatgcattctccctttaggaggtagaaaagtatagagctgtatataataagcttcgctatgaacatacatttctcaagtcagaatttgaacaccagaaggaagagtatgcacgtattttagatgaaggaaaaataaaatatgaatcagaggtaagtgattgattatacgagtttctttgttattgttctggtcaacacaattttataattatatatttttaaaaatttcaaattagagtcgattgtatagttttattcattaatggtggagtattcatcatgattttcatcagcttcgtatcaacagtttttttgtgaaagttctgttttgggtgtagatcttttaaattctatttatcctttattttgtccagccaatggagatagacaactttggggagtttcattgtacaaagtcttttgtcttatgtagccacagagatggacttctctctgcaaatatagttagtgtgattccttacttagcattgttctttctgcttcttg

SEQ ID NO: 70824 - DNA, 1803 bp, Homo sapiens
tccgtctcaaaaaaaaaaaaaaattagccgggtatggtggcaggcgcctgtaatcccagctattcaggaagctgaggcaggagaattgcttgaacttgggagtggaggttgcagtgagccgagatcacaccattgcactctagcctgggcaacagagcagactcctctcaaaaaaaaaaaaaaaagaaaaaaaaaagaataataaaagtgataaaaatatgtaacattaaaggaggcttacgtttactgatcgcaaattatgtaattatgtttatttctctgtgcaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggtaaattacttaaatctagaagtggggtttggttttaaaaagttattggcattatcttggctgaatgtttgctatagaatatagtataattttgttattttgcaatgtatacatttaaaacttttttaatatagtaaaatttttactttaaaattactttgttccaaactaagtatgatatcaagtgggttatgaatttataagccttattttgaaagtagcaggacgtataagattaaatgtatccagatggctaaatgtgttccccatctcccaccaaagtaaaattgcattccaaaactacagtgttaataattaaatgaaactctgtaaataaaagatacttgtgggtttaaaggaatgtgtgatattggtcttgtttttctgtggtgttgattgactttacataaagtaatgcaattagaaagaaaggatttactcaaaattgaattctctttaaaaaaaaccaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcaggtgagaaaatatatttgagttttgagttagtataaaagcagtcagatacgtagtggaagtaagtagttttggtgaatatggcaatttctgtctatatccttaatgattactttgctgtatctccaagtggtacaatttaatcttctttcatatattttagaatgttagctaccatgtaagggagccatgaaactgttattttatgtaaattggtattatattgcctattctgatataaataatatttaaccattaagaataattagggaaaaagtgagtttgaattgataaaaattcagaattaaagaatttttttaaaagagttactagtatttgtatatgcattataactgaaagctaaaaaaggacagctattcttaaagagcttcttaaaagagactgtaaaaacagtatgtgaacataatttatgtgtacattgtaacacaaatgggtttgtaaagcaaaagatagttgtctccaaagtgctgaagtacagtttctttagatcattttcacgctattcattttttcatttgtctggaaaattgagcaaagccagactttaaactccagtcaaatttcctgtaaatttcagattagtaggttctcacgaataatatt

SEQ ID NO: 70825 - DNA, 1228 bp, Homo sapiens
taaatacaagagaaagccattgtattagttacttgtggctgctgttacaaattaccatataataggtgtctcaaaacaacaaaaaaattattctttcaacattttagagattagaagtcagaaatcaagttgttggccaagccacgttccctctgaaggctctgggttagaatcttttccttgccttttccagctttttgtggctgtaggttttccttggcttatggctacatctttccagtctctgtctccgtggtcacattgcctcttcctcttcagtctcaaactccctctccttctctcttagaaggatacatgtgattgttttggatacataatccagcataagcctctcctcttaagatccttaatttaatcaccccaccctttttttaaaagtatataaggtaatattcatagcatccagagattaggaaatgacatattttgagggctagcattcagcccactattgtttggaagactgtttctgaatttggaggagaaaagtgaatcgaggctaaagtagcattagaatggtgagcacattatttgttcatttgttatttttgagctcttaatatgtgcctgtggttttttaggtgttgggattatgaacatgagtaagacatgtttcttgtcatggacaaagttacattccatgtgttgtatatactaaaatgcaagataaaacacagaataatgaactatttgggagggtctttacttcatggaggaagtaatgcattcctgagctgggttttgaaggctgaataggaattcactagatcagaatacaaagagatggaaaaagccttctgagcaaggaaattagcatttacaaagccatggcggtagaaaacagcagtatgtgctcaggaagctaaatggtaattagtgcaatgagacaaattttagatttgttttcatttcttttttttttttttgagacggagtttcgctctgtcacccaggctggagtgcagtggtgtgatcttggctcactgcaagctccacctcccaggttcacaccattctcctgcctcagcctcccgagtagctgggactacaggcgcctgtcaccacgcccagctaattttttttgtatttttagtagagatggggtttcactgtgttagccaggatggtctcaagctcctgacctcgtgatccgcccaccttggcctcccaaagtgctgggattacaggcgtgagccaccgcactggc

SEQ ID NO: 70826 - DNA, 1137 bp, Homo sapiens
tgtgccccagcgtgagctccctctctggagcaatgctgttgtgcactcttcatgcagttccctttgttagtttcagggcctgtgagggtccagggcctctactgtggctaggattgcaagtatccatggtgggaatgtggacccctgggcatctctcatttaccctttcccctgactgggaattctctccaggctcttagctaatctcggataagcaggctgcctcacttctctctctttccttgatttaggtgtttcctgtcacctctttgttgaattccttaatgttttacaatttaaaaacttcctgaatttatgactttgtataggtaatatgtgcacatggtaaaaaaattttaagtccagaaagtttaaatagtccattttctctcatccttattcagtcagcaattgttggttaacaagtatattccactgaccatcataaactccttgaggacaaggattttcttttatttatttctgtattcctgtatccaacaaagtgtctagcatattaaaggtacttagaaaatatccatggagtactctgaatatgggcaggctcttctttcctcatgagaagtgtgcttgacttgatggtctgtatattttttatatctctcaaaacccttttactgtaagtagaccattcagtaaatgtggtatagcagtcacttaataaatattggttgtttaatcagttttttaaagtatatggttttaacattaacctgtgtgtcttgaggatggcttttatttatctcctttttctggctgtgaaaaattttatacttgctttgtgacagattcaaaataatgaagagaatgtttgtgttaactgcagtaaaatatcagttaaactcagttttaagtatcaatttctctttaacttttcagattacggcataaatctcatagaagtaaaattaaatcaggatttatttaaaaaacaattttcaggatatgctgttgcatcagtagataatctttattgtgtattagcagccatattatgggtagccttttctatttcagaagaaaggtgggactgtgagcaaagaagaatatacaactcacacagaggtgctaagtgctcataaatcttctggaaagtccccatgttattgtaacaga

SEQ ID NO: 70827 - DNA, 1072 bp, Homo sapiens
ttcagaaatggtatgcttccaatttaaagcaaattttatttctcttatatatgggtttaatcaatatttgagtgcctattatgtgtctcatgctatgctaggcactggggagattgtgaataagacatagtgctaagtctcaagcaccttattctctgatgggagaaatggacaaagtaattagtaatttgtaataaagcatgttaaatgctataaggatagataagaatgtgttttggggcatgtaggaagaatacctggcctagaactagaaagaatacacaaaaattgaggaatgtctctttagaatcttgtaagtgtagttgtagggtgtacagagcagtattcaacttggcccggaggaagttagtcaaagaaaactaggaaaacaattcttgaagttggagagagagaagagtcatcaacgttagtggtagttgaaataccaggtatagatgaggttcctagtgagagttgtgtagaatcagaagagagcttgtgaacaccagcatgtaataggaagggggagaaagaaggtaggaaaaccagagtagggtaacgttttggaaaccaaagaaagaatgcacatcacatttagtttattgattaaatggaaattgttgctcaagaaacattgagtgtgtagtcctataaatgtaaacctatctaaataaagatgccctctacaaagatctgaacttgcaaatgggggtagtttaagtccttgtttagcagcgtaacagaggaaagagtatgtactttggagcctggatcctgagagtgaaggttagattactagctgcgtaactttttgaaccagttacttaattttttggtccttaatgtatggattaaaataaggtaagctgtaaacttgacttttagtgggcattgttgatttttatccttgccattattaatgactcttctgaactacatacccttcttttccttccccatcccccgtcatattctttcatccttcaagatccaccaaaattcctgccttttctttgatatcttcctctatggatgatattacaaattttctgtaatggaatgaacatgtcct

SEQ ID NO: 70828 - DNA, 1035 bp, Homo sapiens
ctagagcatcaataatcttatcacagattcacccctgttctttctcgtttagactctgagggtcccacttcattgtcaatttcatttgcagtcacaggtttagcataacagctaaccttatttttagttgatgatctggaacccttcacctgacttacaggcaaactcttgtgtattttttgttagaaaatcttcatatcgccattagcaaatgctgtactagtttgattacttggccattagctgcttctcaataggccaggttgggaggcattttcttggcatttttgttttgtatcttgagttttggaggtgaatcactgccatttttaatggatgctggaggcattttgtcaaaggattcctttttggttccttcatctttgtcatctgcttcatcttcatcagtattatttcctgatatttctgtaactttagaagcattttcatctatattgtcttcttcatggtttcctcaactctatttttcctttctagtccttccagcaggttctctgttgaacctctcatgttctgggagtagcttttctgattcctctggacctcacttcttgagggaaaacttagacaaagggggttattgggacaaaccataatccctgtcactcagttggtttcaaagctgcaactgctacttatcttcctcttccataccaatttcaagttctcctctccttcagcagtcacttccacagatcttagtggtgtaacctgggtgtgacccaaatcctcattcctgatgagaaatatatatttattggcaattacacatacctcatgtgattgttgtacatgtccttccacagttacaagtaagtctcaaaagactcccaagtggatcacctaggggctacatatttttctctgcccattgtgtaaaagaagcccttctgcttcctgttgatctaggtcagttacccctgccaagatggggattcctcttcctgcctgctggcaccttgacacaaagggtccaaaatgcccaaacagttgccatagcttgtagttcagtgg

SEQ ID NO: 70829 - DNA, 1047 bp, Homo sapiens
ggctcaggtctgttctatgtgtgatcattattgggttttttttttaatttactttttaaatgtttacaatttaataaatctcttcattgcagacatgtatggctgtttggtagtattcagaaacatcacagcaatggcagtttttccaattggtgtgtagtcctcaataattatatataaaattgctgtcaaatcagtaagactgcatttatgcatgcatcattttcaggattgttagtaacctgggcataatttccccaaataactttgcctccttgcatcacaaggcccaattcgctcatatttacttcaatgacagtacctttggtaataacatcgaaagttgtatacagtggggacaaggggctcttctttacaccaagtattcgtaggcaaaaggtggctttcatttcaggatgtgttacatgggctttcttgaaatgcaagcccattggcctgatgaatctttcatatttaggtggttttcttgtaaacccatctccaacaaagcagactttagtaaccatcctcttccatgccttcttctttctctttcctgttcgaataacttttaatacttctgtttctccctgggcacgtactttaggcagagggacttcccattttcccactttctcttttcgtttctgtttaatcctattggaaagtactttagctcgagattgttcctctctgtccagcagataggcaggtactgctccctgtggagtcttttcatcattcttttgtttgatgtttctcttttcatgcatcttgatagtcttttcatttgtattttctcagcatggcgctgtttatggtaaagcttagccttcagaccaatcattttctttcccttctttgaacattcatgagcctctcgactttccttctttccctttttctcatggtaatccaaatggtatccatagtgtttacagtgtaattcaatatattcgttctgtggcatggtgacagccacagagctgccaggagcagtccctggggtgcgaaaacgctctccatttttgggtctcagagacccac

SEQ ID NO: 70830 - DNA, 1058 bp, Homo sapiens
tagtggtgtgcacctgtagtcccacctacttgggaggccaagaggagaggatcacatgagcctatgagtttgaggttatagtgagctatgattgtgttcctgcactccagcctgggcaacagagggagacactgtctctctctctctcttttttttttttcttttttcttctctttctttttctttttgagacagagtcttgttctgtcacccaggctggagtgcagtgttgctatctgagctcactgcaacctccacctctggggttcaagcgattctcctgcctcagcctcccaagtagctaggattacaggtgtgagccaccatacccagctgttttctttatttatattttgttttaaaataaaaagtaaaaacaaaaccaataatgctttcctgtcccggcctgtgcggcgtgggctcgtgggtctctgagacccaaaaatggagagcgttttcgcaccccagggactgctcctggcagctctgtggctgtcaccatgccacagaacgaatatattgaattacactgtaaacactatggataccatttggattaccatgagaaaaagggaaagaaggaaagtcgagaggctcatgaatgttcaaagaagggaaagaaaatgattggtctgaaggctaagctttaccataaacagcgccatgctgagaaaatacaaatgaaaagactatcaagatgcatgaaaagagaaacatcaaacaaaagaatgatgaaaagactccacagggagcagtacctgcctatctgctggacagagaggaacaatctcgagctaaagtactttccaataggattaaacagaaacgaaaagagaaagtgggaaaatgggaagtccctctgcctaaagtacgtgcccagggagaaacagaagtattaaaagttattcgaacaggaaagagaaagaagaaggcatggaagaggatggttactaaagtctgctttgttggagatgggtttacaagaaaaccacctaaatatgaaagattcatcaggccaatgggcttgcatttcaagaaagcccatgtaacacatcctg

SEQ ID NO: 70831 - DNA, 1098 bp, Homo sapiens
accagtcctgcaatggccccatgctggtgggcagcccccaggagggcatcgacattgaagaggtggctgcttcaaacccagagctcatttttaaggagcaaattgacatttttgaaggaataaaggacagccaagctcagcggatggcagaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaatgcagaattccaacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtaggaagccagccagcttcttggatcttggaggtggtgtaaaggaagctcaagtatatcaagcattcacattgcccacagctgatcctaaggttgaagccatccttgtcaatatttttggtggtatcgtcaactgtgccatcattgccaatgggatcaccaaagcctgccaggagctagaactcaaggtgccccttgtggtttggcttgaaggaaccaacgtccaagaggcccaggaaatactcaacagcagactccccattacttcagccgttgacctggaggatgcagccaagaaggctgtggccagtgtggccaagaagtgatgtctttgtcctgatccgatggagaaacaaagccatttttccataaaaagggatggttcatcattgtgaaagaaatggttatctcgttggggaggaaaagggggggtgaaggcaagaatcactgaaaaatcttaaatctgtgttttctggaataagctatctagacagcctaaatctgattttagtctttataaaaataatatctcgtattctcatacttttctgtcactgtaagcctgcccagtaggcagtgttttgcagactttggggagcggtc

SEQ ID NO: 70832 - DNA, 1331 bp, Homo sapiens
atgcttcaattaaagttttaaagtccttatttgtatttgtgtatcttgttgcacattgatactcggaaaaaaatctctgtttagttgaatcagtttcaaatggtgccagatttattatccaggtattgggaagccatcttcacctggaattgtcagggctatgcgagcagaacttctgaggtgattttttggctcaatggaaaggtgtcttaaatgattccagggcagactccttggaataaagaatgatggcactttggttcagtagacaaacatttattgacagcctcctagggaagtacgtgaacttcaagttaggtacagctatgacatcatgcctccccaaaggagcttgcagtctgcagggggttaaagtgcatgggtggtgatcaaaggaggagtcaggaagtgccacaagacaagcacagagcaacaggcatgtcacagaatggagagggggtgttccactgggactgggaaaagcttcatggcagaaggggcatttgaaatgggttttgtttgtttgtttgtttgtttgagacggtgtctcgctctgtcactcaggctggagtgcaatggctcactgcaacctccacctcctgggttcaagcagttctcctgcctcagcctcccgggtagctgggactacaggcacgtgccaccatgcctggctaatttttttgtatttttagtagagacagggtttcaccgtattagccaggatggtctcgatctcctgaccttatgatccacccgcctcagcctcccaaagtgctgagattacaggcgtgagccactgcgcctggcccttgaaatgggttttaaagaatacgtaggattttgataagcatgagtaaatgggtggcaggcattgtgaatatcatgcatatgagaaaatccatagaaaattcatatacattctgggaatttaggttgtaagatattcttaaggggtccttcaggtgaggtgacgcctgaaaggtgggctagggccttatagccctataaggtccttcctaatgcctgctaaatgaaatgatgtgccaggttatattatttcatttagtagccattaggaagccaaaggaagtttctaagacatagagtagcatgatcagatataatatctccagcaaaatcaaatttttagcctcagtgattgtacagttaccattaattacccatctgcccaaaataaacattttctaagtttcatgcattctctgttgctataatttgaacctgttcctgtttgggtccactaatgagccacagatactagattccttgagcttcctgtggtcgaccctctaggacttaaagattgttgt

SEQ ID NO: 70833 - DNA, 1020 bp, Homo sapiens
ttcctatagtacttattacttctttttttttttttttttttttgagatgaagtctcactctgtcacttaggctgaagtgcaatggcacaatcatggcccactgcagacttgacctcttaggctcaagaaatcctcccacctcagcctctcaagtagctgggaccacagacactaccacacgcagcattttttttttttttttttggtagagatggggtctcactattgtgccctagctggtctcaaactgctgggttcaagtaatcctcctgcctcggtccccagagtgctgggattacaggagtgagccactgtgcctggccttgttacattttttaattctgtacgcctccctgccccaagagtgacctcttagggcagagcttatcatatttctctgactccagttctttcagcacaggacttagttcacaaaagatgcccagaaaaacattttcaagtagcaattctgtattttagggggcttggtttgcaacctaaattaatcagttccattagctatcataaaaacaatttggtctaagtaagcaagccctaattgtactttgtgtgcttttagttaaattcagcctcattgagaaacattggctttctaaatgactattatgtaataaaacaaggcattagcaatctggatcaacatggtattaggattttgctgcattttgcagaattctaaattgcatatttttatgtctaaatctgatgtattcagttaaaccacagatattaatgccttgctagtagtacacgtgtggatttctgctctttttcattggctctttagtattctaaaaacaaatatttatgagacagtgtcatgaaagtttgggaaactttaaaaatgttaaagagctgacaaaatgcattacaggttgacatgctaatgaaatttaagtggttttttttcttgctagaattgagcaatactgtatgttaacatttattcattgtgcatttgtaatgttacaggtactataaagataatagttttgacag

SEQ ID NO: 70834 - DNA, 1064 bp, Homo sapiens
tactctctcaaaaagataatataaaacaaaaagtatctgtgtctgcagattcccagtcctattccccagaggtaactaccatccacagttcttaagacagcttctagaaatgttcatacacatagagtatacaattgtacatatctatcataaatccctccacccctcgtttaagcacagatgagcgtgcacagtaggcatagccctgcgtcttgcttttctctcttaacagtttagattgaatagcttcccatggtagcccattcagatccgtttccattttagtggctgcatcatttcccattgtactagaattttaaaaagaggttctctattgatggatgtctatgctgtttgcagaattggcagcagatggggtggttggtggtggtggtggtggtaggggtggcagactatcatttttttagaagcagcatagaagaatcagagaaagaggcagaagacttgtaaatattttcatctccatttctgttctttatatctcttgaaaaaaaaattttttttttttttgcctgccttaaggtgttttcagaactatatggaagcccaaaagggctagatggttttttcttcctagcccttctttccttgtggtgatcatgatggtgaaggagattatgatatgtaaccaaaacactggggaaaaggaatgtatttacacttggtggctaaagaaggttccgattccctttcttctacctccagtgcaaatacactctatggtaactggattatttgtttgtaacctgattagcaaggctttctaatgataatctatttggatgggggagttttccttatacagagtaggtcgttgcataatatccattcgaggtggtgtttgcaaaccctgtggagtgcctttccaaacactcttttccttccctttctccctggctggcagagcctgttcctggagtggaggccgaaaatgttatctgctgcctccccagcctcccttgcaactagggcatggacatgggactcagccccggccaaagggacccctgaggagcttctggaaaatgttttccttcctaata

SEQ ID NO: 70835 - DNA, 1041 bp, Homo sapiens
tataacccacattcaattaagatgtagaatatttctatcaccccggaaagttctctttcgcctctttatagtcagccttctctctgcttagcacctgacagttactgatctcatttctgtccttacagttttgctttttcataatgcagtataaatggaatcatgtgatacgcagcctttttgagtgtggcttctttcatttagcataatgcttttgcaattgcatgttgttgcatgtaacaggagttcattcctttttattcgtgagtagtgtcaatatacttttaagagtaatgcatctatgaacagagatgaagaaggctgaaatcccacacctcatctgtttttctgaacttacctgttttttcatgttactactgcagcattatgaaaagtttggagcgtcagtttccacagttagaaagtaggttagtttgtaatcctgttactttttaaatgttgttttgttacttcagaatagaaaaggttatacattaaacactgctatatatattacatgagattagggccagtgttgtcttaacctaatgtgataatttgctagggctgctttgacaaagtatcccagactgggtagcttaaacaatacatttattttcatgcagttctggaggctggaagtctgagatcaaggtgttggcagagctagtttcttctgagaaccaggagggaaagagctgttccaggcctccctcctgggcttgtaggtggccgtctttctcctgtcttcacatcattttccctctacgtgtctgtgtccagattttctcttcttataaggtcatcagtcaaatggcattagggcccaccctaatgatctcatttgagcctaattacctctttaaagtccctatcttgaaatacggttacattgtgaggtagtgggggttaggatttcagtatgaatttttaagagtacacaaatcagcccatatcccctaggctttgtggatttgatgtgtgtgtgtgcatacgtgcatatttctagggagaggttccatagctttctttggaatgatt

SEQ ID NO: 70836 - DNA, 1134 bp, Homo sapiens
gatctgtactgggaaatttaagttggtttgtcacttatgttaggatggcgaatataacaagatttctgatttgtaggtaacgatctgtttccttatttggcttaattcttacttgtatgttactcctgtgccttcctaaatatcactagatgcgcttgtgttaattattgaacggtccacctgccttgtatctctgcatctgacacagaaggaggttaaaactgggctgtgcccagaaactaacacttaacattttataacctgattcaagagcatattaagagtggaatgaatatgctatttacatgtgctttcatttgggaaaggcaccatgcttgtagaagcctcctgacttaagcaaattatcaagtactatgtgttgcataaagccagccaaagcttacctcatgtgctgggcaatttagaggcattcacagaattggtgtctgttaggcatgtgggcaccaaaattaaagtgagtctctttcattcaggtggctcatttatgccctacctggggagcagtagggacacttacttatgcaaaatcagcatctgtttctaccacctagaaatgcttttattgtttgggtaggtgggagcacattaaattcaactattgagaagtttgactcgcactctggctgtttaaaatgatctaataccaagaaagtttttgaagtactcagggctcaaatgaagctcttatttttaaagaaagacttaaaatgagaggtcttgagacttgttgctgtttaaggacagttttgcaaagtgagcctaccattccaacagactttttttttttaaacttttgtttttttggccaaataggaaatggatgaaatagtcttgcattcttgtggctttctttaaattaaatgttgatccttcccaaccctcatttcttaaataattttttgcatgtttggggtaattagaatggtaacagatagataaataagaataatacatatactgggccaggcacggtggttcatgcctgtaatcccagcactttgggaggcccagccgggcggattgcctgaggtcaggagttcgagaccagcctggccaacacggtgaaacctcatctctactaaaaatacaaaacattagctggtgatggcgggc

SEQ ID NO: 70837 - DNA, 1091 bp, Homo sapiens
gattttggtcttcactcataatttgaagtagtaatcgattgccccagaagtgaagcaatgagtctctggtttatttgcccgctttccctttttcctttagcatctgttaatcattttggaaggatgatttgagtttttacagattgaatatatttggtggaataatacctcatgcactcatctcaatcttacaattctcttgtttttgcactttgtgtataagtttcgtaacagtttgctgtgaaaataaccagaaactccatttggaataaacattgaagaaatgtgcttacccacaggtagacatttcttcttggatagctgtaatgctagttaacagaactatgaagaaaaggagatcatcttcgaatgcatttgtaattgagaggattctgtaaagttaatattgcagacttgaaatgtgaaagcttgttttttcttgtcacaactgtgatcttctttgtgtaaacaagattagtaatcttagcgggatggatggctcattgtcaactcatttaagtggtttggcaaaactcatgcaactttacaaaactcactcttcataacctgtaaaatggtggtgataaagtttgtgcctcaactgcttaggtggaatgtggtaaagcaattgtgtaaggtaactgcagagtgtttctgccgcatctgccactgttgcctgtctacgccagtcttttctattaaaaggtcaaaaccttatgtgatttcttgattttctttaaaattctgctgacgggccgggggcggtggctcatgcctgtaatcccaccactttgagaggccgagataggtggatcaccaggtcaggagttcaagaccagcctggccgagatggtgaaaccctgtctctactaaaaatacaaaaattagccgggcgtggtggtgggcgcctgtaatcccagctactcgggagggtgaggcggagaatcacttgaacccgggaggcggaggttgcagtgaaccgagatcgcgtcagcctgggcacagagcgagactctgtctttaaataaataaataaataaataaataaataaataaaacaattctactgacaatgttattgtacctgctgc

SEQ ID NO: 70838 - DNA, 1014 bp, Homo sapiens
aagttcagccttattctgtgggaactgggtagctgttggaaattcttgaacagggaaatgatagcatgggaatggaagtttaaggagaaggtatatctgacatcagggtgaagcagcgattgaagatgggcaaaacacactggcttcttagaaggccactgtaaagacagaatagcctaattatccttcagaaggagactaagtaaataaatgatggtacatcatccaatagaatattaggtaactggaatagaaatgaggcagccctctatgaatagctttggaagcaaatctaacatacatggttcagtggaaaaaaagcaatgtgcaggataatatatatggcattccaccatttatgtaaaaacaatatatgttatgtgcttctacatgcacgacatatatctgggaggataaataagaaactagggaaacagacaagaaattgatgccaagagaggggaaccaggtagctagaaggcagagatggagagagatctaattttcactgtgtatacttttgaaacttgaatgtttatactgtgggcatatattaactattcagaaagtaaaattttttaaaaaatgttttttagagatagggtatctgttgcccaggctggggtgcagtggcacaatcatagctcactgcagcctcaaattcttggtctcaagggatcctcccacttcagtttcccaagtagctagaactacaggtgtgtgccaccatttctggctaattttaaaaatatatttttttgtagagaaagggttaaaactaacttaagaagaaattgaaagtcccatgtagtccttaagccattcaaaaaattaaatcaacacttttaaaaatacccatctaccactaccccaacacacaactatactagacccagagagtttttcaggtaagttctttgaaagaagagaaataccaaacgctggggtgtgtgtgtgtgtgtgtgtgtgtgtgtgtgtgtgttggagggagattttagctagggtggctagaga

SEQ ID NO: 70839 - DNA, 1024 bp, Homo sapiens
ctccagcagccgcggcgtgtccttgtcctccttcggggggctacagcggcatcctgtctgggtccaacggattgcttgcgggcaacgagaagctcaccatgcataacctcaacaactgcctggcctcctacctggacaaggtgcacgccctggaggcagccaacagcaagctggaggtgaagctccgtgactagtaccagaagcaggggcacaggccctcccacaactacagccactactacaggaccatcgaggacctgcgggacaagattcttggtgccaccattgagaacgccaggattgtcctgcagatcaacaatgctcaactggctgcagatgacttctgaaccaagtttggtttgagtgtttgggtgctggatgaggtgaccctggccaggactgatctggaggcacagatcaaaggcctgaaggaagagctggcctacctgaagaagaagcatgaggaggaaatcaatgccctgaggggccaagtgggagaccaggtccatgtgagggtggattcagctcggacctgccaagatcctgagtgacaggcaaagccaatatgagatcatggccaagcagaactggaaggatgctgaagcctggttcaccagctggactgaggaactgaaccaggaggtcactggccacatagagcagctccagataagcaggtctgaggtcactgacctgcagtgcaccctccagggtcttgagattgagctgcactcgcagctcagcgtgaaagctcccttagaaggcacactggcagaaacagaggcatgctttggagcccagctggtgcagatccaggcactgatcagcagtattgaagcccagctgggcgatgtgcgagctgatggtgagtggcagaatcaggagtaccagcggctcctggagcaggagatcgccacctatcgcagcctgcttgagggccaggaagatcattacaacaacctgtccacctccaaggtcctctgaggctgcaggctctggggcctctgctctcctcaaagcacgt

SEQ ID NO: 70840 - DNA, 1084 bp, Homo sapiens
tgccgtaagctcacataaagccccttgataagtgacagccttgactttaacagctaatccctcctctgagtggttagtggagcctggctcaccactatcgtctcataagggcttcagcgctcgtgtgctcatatgaatggttacagtttattggtccaggtcactttcactaatccccagcttcctttagaggatgtaagacagacactgacctagcttgtacagccttctgcattcttcattgtataagctgatcatgatacaattatctttagacataaacatagcaactgtaatcatattttatctctattcagactggtttttagtcagttacctagctatatctatcaattactgctagcaaatattcttaggtttacatagcaacaaaaattttttctcattagctttagttttagttattccactgaaacatcctcctcttgtccttttctctgcagctagataatcacttttccccccacccccgggctgcagttctgtggctgtcttctcattttcttttcccccaataaggtcatctctgtcttgtgagctccaggtcttagaggctgggacaaattctgtcttcccttctttcccatgtaaacccctcagcttagcttcctgcactctgtcccacaaactttgattcctcctttccctgtcattagcagcagcatcggtggtctcttccctttcaactccaggtatccagcttttaggtctgatttctggaacatatcctcttaaattgttaagcacttatgactgaaatatttgtgaattgggggtcgatttaacttttttctcaagacagggtctcactatgttgcccaggctggtcctgagcttctggcctcaagtgatcctcccacctcgtcctcccaaagtgctgggattatagacatgagccactgtgcctggccctgatttaattttttaatataacaagttgcatattctctagtgtttacactcacatgcttgaatttacaatgcatcaggctcttctcagcaggagcctcatgggttttaaactaaaccttcatgagccagagtaacctgagcatactgaaaa

SEQ ID NO: 70841 - DNA, 1078 bp, Homo sapiens
actgcagcctcgacctcctgggctcaagccatcctcctgcctcagcacccggagtagctggggctacaggcacgggccaccatgcccggctactgtttgtatgtatgtatgtatgtatgtatttagtagagacagtgttttgccatgttgcccaggctggtctcaaactcctgggctcaagctatccacctgccttggcctcccaaagtgttgacattacaggtgtgaactaccgtgcccagctcaagtactattctatactactttttctttctttttttttctcttgttcttgtctttattttgttcaatgccaattttattgccttcagttttattctgaagttatctaattgccaccgtctacacagtaacacacagaagtcttcattttcattgttatggtagttagcatttatatagaattagtgtagaaaagtagaaagtttgggctatttcatgcacggctgtataaaattattgttttcacttgtatcagaagaaataaagatgtgctttttgtggtttgaagtattggaaccttgaagtcctttgaaccaagttaaaaaaaaaaacaaagcaagacatggcttggttagatttttctctattgcacgtataccgttttcccacttggtggcactttctgttcatttcttagtaacatgtctttctctctcagcatagttacaccagtctctcctcgtacattgatttttcttattaaaattaatttactgaagtaatacataaatacatcatttaaaaaataatagtgtatggtaaagggtttctttttttttttaacagaaaataattttgtccctgaaaatttttctgtgcccagggaaaaattaataaatggttttgcccttgaaaggccaatttgtttaagatgcttaacatcgtggtggtcagctgtttttcatttggcgtgatgtgttctagaagcctttgtagagaaacagggtggcaggtgagggccattacatggaggcgatagagaagaatcaaggatgattcataggtttggggcctgagtggttggtaccataatgctgggaccattcactgagat

SEQ ID NO: 70842 - DNA, 1049 bp, Homo sapiens
aaatacaaaaattagccaggcgtagtggtgcatgcctataaccccagctactcaggaggctgaggcagaagaattgcttgaacccggggaggcggaggttgccgtgagccaagattgcatcactgccttccagcctaagtgacagagcgatactccatctttcaaaaaaaaagaaaaagatttttattaaacttcataatttttggtatgatttcatgtactttattttacttgattcttaaaatctccttagaagattttaagaatatggtagatcatattcccattttagaaattatatacatgcaacagaagtgaggtggttttggaaattgcatatacttatttctaaaattttattattttcacattagagtcagtctttctggtcgcccatgtttgcaactttagaggcagttactctccctaagcctcactcttctcattccataactgaattttaaccattccattgcttgaatttctcccttcctcttcatttccttcaccatattttaggccttttaaaattcctttcttgatttgttaccctaatatcttcgcttccagtctttcttttccatcttgtcctgtgtgctggtaccagcgttatatttgttaaaaatcaaattatgtcactctgcccagccttcagtagcttcccattgcccatatgttatgaaattaagtccggtctctataacttgaccttttagggccctccacattctgacccagctgctcatggtttctcacacatgccattagctttcttagcccttttctatagctcattcagtttttattttattcttccactgagacaatagcacttactggttcccagtgaactctaagtaaatagttactgaatgaatatgtaatctagggtcatactggtaattaggcgaagtgattaacaaaaagttggaagcagaatccagatctcctaactcaaatgatttttttctatttgtgtggagatgaggtttcactatgttgcccaggctggtctcaaactcctggccacaagcaatgatcttcccacc

SEQ ID NO: 70843 - DNA, 1017 bp, Homo sapiens
gaaatctagacttttgtttggcctacaaagccctctgagtcccagctgtcactcagatcccatattctactgtaatccctgtcttcccttctgtcttactcatcatatatctctattgctgtgccttgtgcctcacatgtgtcaaacacctccctcctgccctgggacctacttatatgctctgtttcctctacctggaatgttcttcccctaggtagtcctaagccttggtctgtttcttcactcaggcctttgcaaaaatgacacctccttagcgtgagcttccctcattgccctcattctgttactgtctcaccttgccttgtttttcttcatagcatttagtaccgcatgacaatattattatttgcttatttattatctgtctttccccactaaaataaaagcttcatgaaggcaaaagttttgttttattcactgctacatcccagtatgcagaacagctaatataaatcacccaatatatgtttgtctaaatggaacatgggagggaaggggaaggagggaatcaaaatagtgaggtcaaaatgttcttactattgtacctttgtttgcacatttgtttatttctgtaggatagaattttgtggcaatagaatcggtagtttaaaaggtacgtgtgtgttatattgaatatatatgtaatgtgcttttctaagaagataattgtgtcattaaagaaaaattattgagtttcattgattatttttcatgattttgttagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcaggtaaataactatagaagtgtcttttcctcttacatatataa

SEQ ID NO: 70844 - DNA, 1030 bp, Homo sapiens
aggacccccatctcaaaaaaataaagtcagaggcagacttcagtgcaagtagcagtcacaaaagatactcactcagtttgagaaagtatattctggtgatgtgttatttttgtaagggccactttttgtctttgaagggatcttttgtgcatacaaaaatatttaaggattatgaaaaaactaagtcttttttcatcttctaccatccagagatggctatcacatatccttttagtttttttccatctacctgtgctatatgttgtataatttgtttttcagaaaaaagcctttcatttgtggaaggttattacattagtgttgaaacaagttaaatcagtaaggatcctgatagagaaaatataagatacaggaattttaaaattcctctgataagtcttttccacttatgtagttagaaaaaaatagtcctttgattaaatgtggatcaggtggtttctttgatcttgttcaaaatatttatgttatataaaaggctactttaacaacatattatattactttttctcgttgtctttgcctttaggatgatattaactgcctctaggttttagaaatctaggatttctcatgttggtagaaaatgagatatttaaaacatctgttatagtgttctgaagctataaatttgagctatgtacaggctaacaagcgcatataaaaaagatcacaattaaattaatagatgactttttttcttttgagatggagtctaactctgttgcccaggctggagtgcagtggcacgatcttggctcactacaacctccacctcctgggttcaagtgattcttctgcctcaaccgcccgagtagctgggactacaggcacgtgccaccatgcccagctaatttttgtatttttagtagagacggggtttcaccatattggccaggctggtctggaactcctgacctcgtgatccacttgcctcggcctccctaactgctgggattacaggcgtgagccaccacgcccagccgctaatagatgactcttttttaaaaac

SEQ ID NO: 70845 - DNA, 1052 bp, Homo sapiens
ctggttagtaaacagacttttgacaagcttgggtgtagcccatatggtcttattctttagaatatagatgtttcataaatccattgcttaccatttactttttttttttttgagacagagtcatgctgtgttgcccaggctggagtacagtggcaccatcactgctcactgtagccttgacctcctggggttaagtgatcctcccatctcagcctcccaggtagctggtaccacaggcatgtgccaccacacccatctaatttttgtattttttgtagagatggggtttcaccttgttgcccaggctagtctcgaactcctggtctcaagacatcctcctgccttagcctcccaaagtgctggaattataggcgtcagccaccatgcctagcctacatttacaaatttataacaacatgtttacaatttatcagaaagtagttgtaggcagtccccaattcctaaaaggattgtgttctaaaagttcatggtaatttggaactcagagtgtatttcccaaagaaacagctttgaaatggtggtgaagtcctcagtttagtccgcaggttatattaaccattactgccctgtcttcccctccactcctctccctaccccagcccaagggaggtgaattatctctgactgtgtatgtgtgtgtgtgtgtgcgcgtgcatgcacgtgtgtccctgtgatgcaagctggggctgaggcggtagccagggtggggttaagcacctgggatctcagaggagcaaatctacaaggcctggggccccagggtttgtgggaaggatgagatgactaaggaagaatgaggaaactgggggctgggtgagctgtgtggaagactgaaagtcgtcaggagtgataagggggaagggtagggtagtggctgggaattagtaggcagtgagtttctctacctccttttcttcttattccaatcccttctctctttccctccccgttctcctttgctaactgcatcattcggctaattgagtttctgatgcctggcagagtgagtagaagaaaccagaggaggagac

SEQ ID NO: 70846 - DNA, 1047 bp, Homo sapiens
cccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaa

SEQ ID NO: 70847 - DNA, 1050 bp, Homo sapiens
ctccgccatgccacccgcctcagcacgatgggaaatgaaggcgggagtacaggcggcacggagctccagctcctgcccgtcccgtgggtccagaaaactacaattcccaatatgcctcgccgctcacgcccccttttcgagcccgcttattggagaagagagtgagcgtgtaagcgagagaggcgggagcgagctgaagctcgagccctccgattggaggaggctagggcttttgtctgccttttacggccgcgactagcagggggcgcccggagcactgctgatttttggagcccgagaagggcacgcgccagcggagccgaagagagcactgctcgtgcccgcgcctggctgtcagcctgccgctctgcggggcggtgctagtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccggtaagtgacggcgctcgcgctgccgcgggaaagtttgtggcgagcgctgctaggcttgggctcgcgagcaactttcttcgccggggtgggcgagttgtgtgccccgtacctttgccgagcacctcggcaagcgcggagctaatgggattcgctgccggctttctcgtcttttcctgcccagaggggctgtttggaaacccgggatttctcgggatctcccttccaagggggactgtgctgggggctctgcaccaggtgaaatgcgatgtgtgaagggcgttcgctcatctctccagcagtgcgaggacttcgcctttgcatgtgaaaatagtgtagattcccaagttaatagatcagttattataggtaaaggcagtgttctcagcgtgttcaatttggccactaagtgagtcgctttcaaccttgta

SEQ ID NO: 70848 - DNA, 1087 bp, Homo sapiens
gggtaggagagaaaagcccccgcagcgcccacattccgtcccgccgccccgcggcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctcctccaatcggagggctcgagcttcagctcgctcccgcctctctcgcttacacgctcactctcttctccaataagcgggctcgaaaagggggcgtgagcggcgaggcatattgggaattgtagttttctggacccacgggacgggcaggagctggagctccgtgccgcctgtactcccgccttcatttcccatcgtgctgaggcgggtggcatggcggagaaggatgacaccggagtttgacgaagaggtggtttttgaggtaagaggaaaatggcggtgggtgtggattgcctttgtttgagaaggacgagacggaaatcgaggaagcaaggcgttcccggggcgagggatcgggtgacgcgctccagctggcctcgaccaccgaaccccagcgatttcagggcctagagtccgtcgtcgcctgacaggtgtagccagaggcgccctggccgtggccggcctctatctcgggcccgcccagaattcccagacggtgcccggttgccaggctctgggctggagcggtgtctcttccttcctgggaatggatgtgcggcgggggggactgcgcccggctggggcggggccgaatcgtgccttttagatagtcacaacttagcctcctccttttccatccgcgatttttttgggtcagtatccagagtgcttcaggtcactgttcaccgtcaaggcgtggccctcggaatgaaggcagcaggtgcccgttttctaacacggtttaaagtctatttgtgggacctactgtgggtagttagg

SEQ ID NO: 70849 - DNA, 1033 bp, Homo sapiens
gtgccattgcactccagcctgggtgacagagaaagaccctgtctcaaataaaagctaaccagcaatgatgtagtaatgacactggcacttgtacagaatacatcatgaatcatgtagaaaacaagcactgccataagtgaatggttggactttatacatctgggagatctgatatcttttcttttttttctttttctttttttttttgagacggagtctcgctctgttgcccaggctggagtgcagtggcgggatctcagctcactgcgacctccacctcctgggttcaagggattctcctgcttcagtctcccgagtagctgagattacagacatgtgccaccatgcctggctaatttctgtgtttttagtagagacggggtttcaccatgttggccaaactggtctcgaactcctgacctcaagtgatccacccgccttggcctcccaaagtgctgggattacaggcgtgagccaccgcacccacccagatctgatatctttatgtggggcctgcagggagcagggctggcaagaagtgtcagtagtgtaggacttggatgagacattttcttaaagagctttcttcagcaaaaatgtgggattttcctgtctatttttgtttatttttattgcaaaaatgtttcggccaccagaacaatcttagcacaaccaaaggttcttggctgtttttcatttagcaaaattctttctggtgttatgatatgtgttttctgtcagctaaaacttacaggaatagtgaaccacaaagatttcctgaggagctcccacatgctgtgtctgaggtttctcatatttcttttggcatcagtaacattctccaatacttcgaaattatagtttgaatccagtgttaatgatttctcttcaaaaaaacaacttaaataaaacatttgcggttttattttgcttgaaccaaggaaaagtcataatagagacaactacctactctgccttaccctctgcacaaaaacacccctttctaaagctaccatctaatactttatgaaaa

SEQ ID NO: 70850 - DNA, 1025 bp, Homo sapiens
tgctgagcatatggtagataatacgtatttgtgcttgaatgaattaaggaatatgatgagatgataaaaatattataattcatacaatataatcattgtttaattattcttggctttgagtaataacattgtcgtttgagttatctataacattggctattttgaagcaatctaagactataaaatttgggacagtgaaattgcttaacaatctatttatattcctaaattcattttttcttgctggtactcactcaaaaaaaaaatctgtgtgttttatttagagtttttccttttttgggttcctctgttgaattgtttgttgatttgtttgtgttaaatggcattgtattataacagataattcagttcttatagaagaagccttaaagaatttggacatactggtcacaatagtgaagtctggtattaagtttggcccccgaaacttttgaagtagtaatgatcttgaaatttgctttattttgtgtctttttcagaattctccactttaccaatacttacaggatctgggacacacagactttgaaatatgttcttctttgtcaccaaaaacagaaaaatgcacaacagagggacaacaaaagcctcctacaagagtcctaccaaaagtaagaacgcatgctcattctttctggccgaatcttttgcactttaccttactggctattcagatacttcttaagcacttccatatcctccctcacactggtaagactatttatttcatcaatagtacaaaactttctgttagataaacatgaatccttactgctttggaatactttgtaggtaatttatatccagtgaggaaataatttggtagagaattaaaatacattacttatttaaatattgatgctatccaaacagaatcgaaaaaaatatactaaaactttaatgagagcacaactaataggaatcctctactaactggatttttctctttaaatcttttttttaaaaaacagcatgaatgacaagaacgcaaattgatatttctt

SEQ ID NO: 70851 - DNA, 1049 bp, Homo sapiens
ccaaagactcgaaacagtcaacctgaaaggtctttgtgatttttgtgaggctttgtttttttctactctctgctgtaacagaactccaggggggaaatacttcaaccttctgacgtcctaacaatacaaaatccagggagtatagcctaaaaattcaagttatgtggttctcatggctcccagaaggagtaatgtagttacaagtaagcaggtttcaggatctctgctggcctgtaaccttaagaattatcattcctgtaaattaacatttgtaaggagattgtttacaaagtgctttcacattttgatttggtaatctaaacaacactataagatttagtctgcttcagtaacgagaaaaccaaggttcagacaatcagtttgttttaataacttactgagtgaattgtctaaaaatgttcagctagaaagtgatagagccagaatttgaacccaggtctcttggttccaaagccatgctctttctgctatagcatacgacctctctagctcaagtattattattttttggctgactaaaattacttttttagcaatccaaattgtcaagttctttgttcagggtttcatctttgttgaaggtgtattgagaaggtcaatgaagtgtcttatcgtctacatataatgccatttttatccaggtggagccatctcattcttcagtgatactaggactgtggtaaggtatatggatccatatacatttttctgtgatttagtcatagtctgcctaggcctggtcttttcattcttgattctgtgtcactggccacatgtttcatgtgatgtttcactatacagtgccagcttctgtatgcatcccttttgtgcctatattatggagaactataagaatacatacctaaggattagtttactagtaatggaacaagaaattgccaaggtggcttttggcgtgagattgcttgactttttccccttgattgtgacgtatttaaaatgttgttagctatacagatattgaagcaggccctcatttcttttgtaagaatattggcaattgctct

SEQ ID NO: 70852 - DNA, 1025 bp, Homo sapiens
ttttatctgtgccttctcataacctttcatttcatccatgcagaaaggaattcctaagtactttctcatgccacttccctatttagatcctggaaagatctttatcaatcaaatcaagtccaaatttgtcacgtcagcactaaagagtctgcataatttggccctaacctacctttccagctttgtccaccagtatttgtatcaatgaacccagtcttcattttcctttattccgtacttattctgtatgtctatgtttgtgctcttatactgtgatggaatactttctgttttttttttcttgatccattagaatcttttcaataagcactcctagctttttctcaaagctttcccgaaacttcagcctattgtgtctcttattttctgcatcaacctagtaataattactttgtgttctataagtttttgtattgtaatatatccaacgtgtgcttttctttattgtttcagttattgcatagatagtgacaacagtaatagctaacatacagtgcttactatgagccactcttcttggtattttatagatactgacttatttaatcctcataacaaccctgtgaagtagctactgttattatcccacttttgccaaagaggaaactggcacagagagcttattaacatgcttaagttgtggagcaaggatataaagctagacactaagtcctggcactcagacttgttgaaaatgtgccaaagtttacatagtacacatcccaggagcatagagcctccagccatgcaggtgatacctgctaatatttaaatcgatcagaattagcaccttttcagtttcttcatttgtttgagacctggatctgggcttcccagtccaaatagtactgtcatgacatgtttcttaatttgcaggtgtcagtttttctggtagtttgattgttaccttgtaacacagttaacatgttttctgcagttcttatttttataatcaaagagtaatatctaattttacattttatccttaagaaagaaacttaatt

SEQ ID NO: 70853 - DNA, 1109 bp, Homo sapiens
tggagagaaaaaaatatatatatatatgtatatatatccactagtcctactatcttcttttctcctatgtgaaaattttttttaaataatgagtgaagattcacttttactaaattatctcattccatcaacacttcccatctagggcagaactgtagtaaattatatattgatgttacctgctgtattggaatcagaggttcccacacacataatttgaaatcatattcttggctaatcttaaggtagtttaagttcggctatatttattatttaggataaagtgcaaaatttaaaccagaagttaagataaacaaatttatagtttgttttgaacactgaccaatatttttattgatctagttcttttttcttttttctttaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgagtaagtttagaaattataccaagaaaggtctcggtaattagcaagcttcattcgtgtaccattgtggttgttggcttgtgtcctacctagaaaaaagaaacaaaactgaggcatgagcatgaagggtgatttatagctataaatatagcaaaaaaaaaaaataatttataagtactataacttgagggagttattatttatagtttttacttttccttagttcaacagaaaacttggaaaagtaggctaaaagcaggtgttgttcattctctttgagagctgaaatggagatggttataaagaatgagtttcttttaactgtcttaaggtagtgctcttaaactggaacctgcagtccaatagaaatatctaccagtactggaacagtata

SEQ ID NO: 70854 - DNA, 1044 bp, Homo sapiens
ctatcgcttatccactattgttaaccattactgtgaaaactttctccacctcattgggtaggtaattaagataagccattttctaattattttctgtatgtgtggcttttgcttatagataataatgatatggattaagacacaaatagttcacaaacttttttcactaaaaaattcacagtggccatgactacacaggtttaaatttaaaaaatgttcatttgaatattttaagaagcaggtactttagttagccatatctttttttaaaaaggtcttattttgaaatcatttcaaacttacagaaaagttgcaatagttgaaagtctccttcatcaatattccctagttgttgacattctgtcacaattgccttatctatgtatgtatctgtatgtgtgtgtaattcttttgatggtggtgttactctgagccatttgagagtaagttgtagacttgaagccccattacccctaaatatttctgtatgcatttttgtaaaacaggaacattctcctgtgtacccacagtataccatcaaaatcagaaaatgaacaccaaccatgatattgtcattttatccacagaacccattcaaatttccctgattgtcccaatattttttatatgtctagacctagattgtgcatggtgttcagttgtcatgctctttattctccttttccttaaagtctttcatgataaatattttgtaaagaaatactctgaggttttataaatatgctttcttcatcaaaattttaaccactatgaatgcatataccatatgacccagtagtatcattcctacgtatttaaccaagaaatataaaaacttagtgttcacacaaaagcctatacataaatattttgtttataaactaaaactagaagcagctaggctttgggaggtgactaagctgttacatccatccatacagtgaaatactactcggcaacaaaaaaagtgaactaccaatgcatacaacacgatgaatgaatctcaatacattatgccaagtgaaagacatcacattcaaacca

SEQ ID NO: 70855 - DNA, 2336 bp, Homo sapiens
tgttaaactttttttatccacaatgctttttagtatcaactgttaggttgtttttgaagatttcaatttatccataggtatatatttgcttttttcttttcctagctctgctttaatgacctgtgccaaatgcaagtcctttttttttaatctcagagataagtaagtgcaagtaaatgaatgcttactagagaattgtttgcttcaagtaaagtgctttttcttctattcattttcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggtaagcactgactttaaagtaacaggttatttcaatgtaggggattctttctttcttgaaccatgaatgttattttagctgaagaattcttggggttttataagggtccaccagtatgcatagtactttttcttctagatgctaaatcaatttgattaataaaagagtaggaatgtaaccacattggaaatatgaagtcatacttttttatgagttatttaattttttagtaaatttgttttagaatgggcagtgagttgaataatttgggatattttaaatgttattttcaaatttagtgaatttgagattctcaactctgttgtccatatgttaaaatatttaaaaatacctcagtgaagcacaaaattaataactgtgctcacattgaaaaaaatggcccaggcgcagcggcacatgcttgtaatatcagcacgttgggaagctgaggcgggtggatcatttgaggtcaggagttcaagaccagcctggccaacatggcgaaaccccatctctactaaaaatacaaaaattaacaaggcatggtggcgcgtgcctgtagtcccagctactcgagaggctgaggcaggagaatcacttgaacccgggaggcggaggtttcagtgagccaagatcacgccactgcactccagcctgggcaacagagggagactccatctcaaaaagaaaaaaagaaagaaaagaaaagaaaagaaaaaaaaggaattaaaacctagaccagtgagccacatcattagcattatttaagtggtttgagcactttagtagatgggaggggagcagggtgcctgtgggcgtactccccatactctgatttcagcagagtggggtagctggtaatacaaaagccttacattcctttctgtttctcacccttcttttcttaagtcaaacttcatgggagacagggaaggaatcaggggaagcttaatacttgacagtatcaacctagctaattcttagttgaattaatgcctatggatttctaagtaggtagagtgtggattctcttccattttacagtatctgtgtggaccctcgaaatcaactgccctgcttttccctcctcactagaagtacatagattacctatacttctggaaagttcctccagttctctttttttttttcccctcaggagccctatgttttctcctgtccagatctgcatttcttggttttatcattcctctttcttcccattggccccctttatagcccaggtcctcagtagattatccttgtacattaaaataccttcttagctgacttccattttcagtacttttttcttctaagctatcttgcaaactctttgcagatttttctccaacactgcattgatgatggctctctatcttaaaacctatagtggtttctccctttcttattgtgttgaatctaaactctttttcctgttttcaagtctcttcatcataagaattcatctatccaattatattttctactgtttttactatagatatcttcttatgtttatcgaattaaactacagttcacaaatgtgttatttttattcatgaaaaaaattcatgctggccaagcacagtggctcacgcctctaattccaacactttgggaggccaaggcaggtggatcacttgaggtcaggagttcaagaccagcctggccaacatggcgaaaccccctctctactaaaaatacaaaaattagccaggtgtgatggcgcacacctataatcccagctgctctggaggctgaggcaggagaatcgcttgaacctgggaggtggaggttgcagtgagccgacatcgcaccactgcactccagcctgggtgacagagtgagactctctctcaaaaaataataataataataataataat

SEQ ID NO: 70856 - DNA, 1050 bp, Homo sapiens
tctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagt

SEQ ID NO: 70857 - DNA, 1053 bp, Homo sapiens
tttacagatcatttcactctggtgactaactcttcacttcctatcagtaatgtaaaatatgaaaaagttcaactgatttggtttaatcatagtatattgttcctatacccaaaacaaacaaagaaacagactaaatactataagagtgtattatagctcagctaaatcattgtttgaactaaagtagatattatgctaagaatgacaaccagacaaggcataaaggttggtttatttttccaattctacttacaagaaaatagttatgcagttcacaattagaaaataaagctacaaatattttagaagagaaaatatagaaaaaaaatgcagtaaccatttatctgtcatcatagacaggtgattaatttgcctaagttaacttctcagctaactaaaacaaatccattttaataatttaataactaaatgcactacttctctactttgtctagagtatatagaatataatttaactttttctgtcatctttaggaatatcagtttctatcatggggtgataaacagaaactcatcctcaggggctactgagatatatgtcaggtacccctttacaacatgacctcacactggtgtgcttttttcagttatgtctgtttttcacagtttctctatcttcccttataatcagctgtcacttttgccgccgtcttgtgtgcctgcctcctgcaataggtccctaatttgctgcttctaatctgctgtggactgagaaaccagattgccaagcttgctagaattgtgtctaaaataagagtaagtagactgaaagagagctaaggggcttttctgtcagtaaagtgcatggactttgtgatacctgcttgactgcttagcattgttttgtttgcctcttagttctttactaaaaacttgctaaaacaaatacttggttgaatatgtgattgccatatatttgaagttctaattcagtttttatataatgatgtttctaggacttccattaatgaattcaactataagagaaatttgactatcatttttgaataaataattgtgtatatttcagaa

SEQ ID NO: 70858 - DNA, 2962 bp, Homo sapiens
agtcatgacaatagaaatgtgtacaagtgaacacatttcttagcccgtttccccactgcctgtgtgatttataaaaacgcaaatataaaatatttccgttccagcagagacgccgcttgctacggcgggttgcccgtctccacaggtatctccggctgactctagagctcaacttcccctttaaacttcaccctgcgcttgccgatttgcttcgggaatgcccgaggcaccggacgaagcagtcgggtctggccccagtcgactccagccaggcggggctccaagccgagactcctgcacgcccggcccgaagctagcccgacaccctcagctgagtcctccgccgtcccagcattccctgcgtccctaccatcgagagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcaggtaaagagagttttatgttttcccagtcccctccgggaacggctgaactgtttggctcaggcccgttgagggggccgggaccggggccccagagccccgactagactgattcttgggcctgacagggtggcaaagccgggctatagattcctagtctgagaagaggcgtcatctcctcctgtgggactagagggctggtgggggagaaaagagtgcctgaggttggcgtgtggtacctctggggtcgctgggcccgagcccctgtattaccagaactcagctcccacgcacatcgtggcacggtcttgagattgtgcgcagagcacagccctaccatctttcgcgcgatttggccgccgcctcaaaaatccgattctgatccgtattgccgcgtctttgctggtttgctggagcaagctaggacttattttctttgggggtgggcaaatgtaatggagagcacacctcctcccactatcccgtttcacgttggggttgttgcagcctgcacttttggggtgtgtgtacatgtgtgtttgcccgcgcgctcatgtcattaattgcagaatttgtggtggtgataacgaattttcacctgcctaatcccatagcatcgccaagctttagggcctttagacctgaattatgataccaattgcaggcagtgcagataggatattctgtggctcagaatggaacttctgaggtcttaacctctaaatccactggtaaggcaaggagaactgctgagagtttacagttggatattatgaactaggaacttacatattttgagaagtctgtgtttttgctgcacaagctccttcaccttaataaaaattatttttacttgtttctaattaaaatcgccagagaaacagaaaatggagaagtcagaagcgattaagatggaattgagagaggtcgaagagagctaatcttcatctttctgaaattttgattagataggaatggaaggagagttgtagcgttgctggaactcttccagagcaaaatttgttactctggtggctgttcctggatttcgagtgaaattcaaacactgctgtttgtcttgtaaggtgttaagctgactgatcctaatgtatttttaacagttgtatttcttaatatgaattctctccagtagccagaatgtcacttcatttcgtgctacctgatactattaatgcatgtaacatattgctcttataggtaggttataatcacttccagagcaggggcctggtcttgtgcttagatatttgagcgttttagttttttagtaatggactgtctttgcctatttattttgactttacccagcccatcgtgatatccttattcatgaaaccaggctgccccggggtgttgcacatgaatctttttcctaaggccttcagcatttattacctatctggtgtttaagtatttgttaagtctaattgctgaccactattacaagttaaactacttgaggatagagaccagttcacgctgtttatcttttagctgctagtgtgtgtaatggatattttgttgagtaaattaatgaatggacaatactgtgtaggtatggaagatttttctgtcattaaacgaattctgttatgttcacaataatgtttctgtttttgtttcctgaggaaaggatttgtaagttttccaagatcattagagcatattctagtgggaaagtgtctgtattagatttgatttctgctattttattttgatcagcaggggaacaggaacctgataaagaatcaggagcctcagtggatgaagtagcaagacagttggaaagatcagcattggaagataaagaaagagatgaagatgatgaaggtaaatggttaatttgatctttgtggttagaaaagctagaaaatgtagccgggtgtggtggcacacacctgtaatcccagcactttgggaggtcgaggcgggtggattacataaggtcagtagttcgagaccagcctggccaacatgttgaaaccccatctcttctaaaaagacaaaaaaaaatttagccgggtgtggtagcacacacctgtaatcccaacaacttgggaagctgaggcaggagaattgcttgagcccgagagatggaggttgcagtgagctgagattgcaccactgcactccagcctggccagcagagtaagactgtctcaaaaaaaagaaagaaagaaagaaagaaagaaaagctagaaaatgtgatattccttaatcaaaatttatttactcgtatagtgttttctctgacatttcacttgttacctcaattaatgtcacagattaaaaaggaaaaggtatttattagcaagtcttgaaaaag

SEQ ID NO: 70859 - DNA, 1054 bp, Homo sapiens
ctctgcttatgaggtttaaatgaacatgtacttgaaatgtcttttcttagatggagatggcgatggagatggagcaactggaaagaagaagaaaaagaagaagaagaagagaggacgttagtgtcttaagttaatgttaattgatatattagaagtgtttattctgtcgggtgtggtggctcacacctgtgatcccagctactccggaggctgaggcaggagaattgctggaacccaagagacggagattgcagtaagctgagattgtgccactgcactgcagcctgggcaacagagtgagactctgtctcaaaaaaaaaaaaaaaaaaaaaaagaagtggttattcactgacaggtttgaagagtaggtttgaagttgcttaaggtcctgatatatgttagggaaataaacttaggcttaatagaagcagaatttagtgaaactaataattatttattagtttaataactttggtttaacaatcctttattttctttagctgttagctaagggatgtcgatatgaattggttgcattttactgcaagttagggatgagtttctaaaaattttatgatttaaaacttgcataatttaaagaataattctgtcaagaatggccgaagtggtgccatggtggtggtagggtaagcgttgtttgtaatttaccttccagcttttaaattatgagattcttgatgagtatttaatgaggaatcccgttatttaagatgtgtgcatatggtgagactttattattaataataacttttatattgtacgatcagatttgtataaaatatcctgcttgttttgagtttctgtaagtgccacaaccaaacatcatcaggtgcccgaaaatatattaaggaggctgaagggagatttcgtagtgttgaggaagaaaggttgggttgagaatcacaacatgtaagttttaatcttggatgccatttgggctgttgtagaccactgaatgtctggttatgccttcctttaaaatttttcaggctaaaattttatgaatcagaattttgggggcttggtagtgatt

SEQ ID NO: 70860 - DNA, 1063 bp, Homo sapiens
tagtacatatgatgtgatcacatttatttttaaatataatctcttaatttttttttttttttgcttgttccctcttcttttccttccttccagacccatgttaaccacctagcaggtagccttccatattttttctatgctcatatatgtatacatctgtctgtttatgtaagggaatgtttgatcattgtttgttttacaaaaatggaatcataggcacactttcctccaccttttctcattcagtgctaactcttggaagttcctccaagtcaattagaatagttctattattatcttgaatggcttcataatattccgtggtgtgagtgtaccacactttattccaccattctttagctgatggccatttgctttgtctgcaataatttttgccactataaaccattctgcaataaacctccttaggtaaataggtagctggatatgtaggtatttttctctctttctcatgtactggtagttatattctgaaatacgtttttaggagtgagattgattaaccaaagaatatattaataatttccagttcttatactattagtgatttcgagcatcttttgatcgtaggctttatgatatcttttgctcttcccagaagttttaaatttttaaatgcattatgtgtccatgtttaatacttctgagttccggccaggcatggtggctcatgcctgtaatcctagcactttgggaggctgaggcaggtggattacctaaggtcaggagttcaagaccagcctggccaacatggtaaaaccccgtctctactaaaaataaaaaaataaaaaaaattagccgggtgcagtggtgcgtgcctgtaatcccagctactcggggggctgaggcaggagaatcgcttgaacacaggagatggaggttgcagtgagctgagattgcaccactgcactacaccctgggtgacagagcgagactttgtctcaccaaaaaaaaaaaaaaaaaaaaaaaaaaaatacttctgagttcccagtagtctctcagattttcttgaacacgtattttgtgtgttattacatcttta

SEQ ID NO: 70861 - DNA, 2008 bp, Homo sapiens
tttccaagtcagtttcttgggttagtagttactctgttggcaaaattaaatgcaaattgttgttgtgctcctttgaagtgtctaaagtatatatgacctcaagtggaaggatgactttttcctacttactctgattctaggactcttcagacttttctgattgttttattatctttttgtgttgtcagggtattagttcctctgactatgaatgaaatctcacatgagggtttttttccctcccttagagtcttaaaaagtttttaatttcatttgagttggttgcaagtgtttggctttttgtatttcagaaactttattgacataaactgaatatgtactgtatttttatttgaactgtcttgttacttagtatagttgtcagcttttatgcttgttctgctgttttatcactaatagtattctatgcccactctaaaggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctggtaaaaggaatacttcttcgtaagaacatgataaaaaatgttttattaagtactaactctccaattataatgtttggctttcattaccactttgctaaatctttaagtaaaggttgtagaaatgccttctagattattttagtgtcactatgagaaaaccatgaagaggagtacacattggcacctcagccacccttttgtgtgcacatgtagtcattactgattgttattttctatctggaaatctgttattttgctatctaacaagtcatactaagaaataagaaagtattggagcaattgcccaaatacagaacatgatgataatacagtaacaaaaccaattcaagtaattattctctagtttttccttttgataaatggttagtataacatgtaattctctgattcctacaatttaaaaaatatacaacatgaacaaataagatcagcatttaaattggtctaagttagactcttattttctagtaaatttagttaaaagtggattgtgtttctctgactttctagcagaatcaaattccttgtcttctaaagatatgctattttcatagcatcagagaactgttatttatttatattcagaaagtgctcagatcattcccagaaggtatttaaggtttttagtaaactttctggacttgatgaactatatggtattaatatataaaagtaagaatgtaaaagtaaacaagttccctttgcttttttgttttagtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaaattcttgcagaaaattcctaccccagcctcctcctgaaaaactagtttttgtctctgttaaatggagtgataaatactgaactcccaaattttgttcttgcttcctcatttcattaggaaaggtgtgttgaggcagatttttaaaaaaattttagtgcacttataggagagagaggcagttgtgacatttacttgaaagcatactactaagtagaataaaatgaaaactgttgggtagttgaggtttattaccctttgtatcaaggcatgaaagacattatcctacctttctttaggtcattgtttcatatctcttttattcaaataataacatttatttaaaatacttaagtttatcagccttaatatacatgtttgcttttctgaattctctccaaaacctggttaggtaagcaccttgttatcttacttacaagtgagaaagcaagcttagaataaatacttgcctaaggtttcact

SEQ ID NO: 70862 - DNA, 1180 bp, Homo sapiens
gctcaccatttaaatcctctgaaagtcacttcagccacaggggtgtgtaagcgctgaggtgtgcaactatgaggggagatgcaacaacagtggccacttctgtatctgcgcctatgtgaccagaagcagcaaccagggatcaaagcacagatccctgatgtttaggacatagactgttctgcccactcccatacccccaagctgtgtgcgtgttgctccaggaacacgagccaaccatgagtttatggaacggtatgtagcagtgctgctactgtgctgagagctaaaatggatggaaataaccacacttgaccatcccattattcccctggaagttgcaaggcttcagtagactccagagttcccaagtacttacattagacagattttgtcagtgcacttgttgtctatttagggaggcagattcctggtgcttaatacttcactatcctcccataatcctctgcaaagtattttaaacaggaagttacaatgtacaaagcagtttttctgattgtcccttgtttttaaatgttacaaaattaagttgctatgaaaattttgcactttgaataataaagcatatgttactctttttttagtgtgctggaattgatgttcgtctgtgtgatgttggtgaggccatccaagaagttatggagtcctatgaagttgaaatagatgggaagacatatcaaggtatgttcttttaaaatatatcttattttgaaattgattttacaaactattgtcgagtgttttctttgggtcagctgcttcatgtttctatcttggtaattcaaggaaagaagacgggaaatgacctgcttagagcatggtaggagtagtgttgtaactaactggaaactattgccaagccactctgttagctgataagaaaacacctgaggaaatatcctagggcagccaaaatgtgcagccagttttctgtgactagtcaaatcaaggctgagagaagccaggtctcttgccattgatgacttctcattgtgattttttttgttgttgttttttgttttgtttgttttttaaagacagggtctcgttccgtcatccaggctggagcgcagtggtgcaaccagagctcactgtagtttcaacctcccaggcttaggcttaagcgatcctcccaccttagccctcccgggtagttgggact

SEQ ID NO: 70863 - DNA, 1021 bp, Homo sapiens
atctgcctgccttggtgtctcaaagtgctgggattaacaggcctgagctaccgagcctggcctacaattaccatctcttgaagtctctacctgattaagcagcaacatgaaatagcccctggcggtccttatctagccttgccctgctttatctccttagcactttttggtctttctgcttccccctatgaattatgttcacagctctacccctagagcctactataaagagactggcacctgagaatgctcaataaatattcattaaatgttgaataaacaaccctttcacagccccaatttccacaactgatttagtgctgactatacacaatttgcaaattcaaatggcccaattcctggcagggtgaatatggatgataagcagctaattctggtcagtataaccatatatttaactaccatgaccttctgcttggaagaaaaaaatgtcttccatggaagtaaaatgttagtgacacacatacctccattcttgttgcctcccctcctttcacaatcggcactgtttttccagcatgtattctatattgcccaattgaatgtccatttagattacggattggtttcactgttataaaaaatagggaaataaaagtcattcaggatctcaagaagcaaaaacagatctcttacattttggtacagagttcaagcatttattcaaaaaccaggtatggctttactaaataaccttacattaaggtagtttaatataaactggaatctagtggaatataaaaagtagttgcagtgttattaatactagaagtaggccaggtgcagtggctcatgcctgtaatcccagcactctgggaggccgaggcaagcggatcacctgaggtcaggagttcgagaccagcctgaccaacatggcgaaaccctgtctctactacaaatacaaaaattcgctgggtgtggtggtgggggcctgtaattccagctactcaggaggctgaggcaggagaatcacttgaacccgggaagcggaggttgccgt

SEQ ID NO: 70864 - DNA, 2338 bp, Homo sapiens
aaagtgctaaggagataaagcagggcaaggctagataaggaccgccaggggctatttcatgttgctgcttaatcaggtagagacttcaagagatggtaattgtaggccaggctcggtagctcaggcctgttaatcccagcactttgagacaccaaggcaggcagatcacctgagtgaggtcaggagtttgagaccatcctggccaacatggtggaaccttgtatctactaaaaatacaaaaattagccaggcatggtggcacgtgcctgtagtcccacctactcgggaggctgaggcaggagaatcgcttgaacctggaaagtggaggttgcagtgagccaagatctcaccactgcactccagcctggcagcagagagagactctgtctcaaaaagagagagagagaaagagagatggtaattgtgattcgttctgaatttttcttctttctctccccttgacccttatttatttttcaggaaggagaagtatatgcaattgaaacctttggtagtacaggaaaaggtgttgttcatgatgatatggaatgttcacattacatgaaaaattttgatgttggacatgtgccaataaggtgagagacgagacgattgattttatgtggctaattagcatctcttctgagttaacagcatttctaaaaaatgtggcatacatacaaaatagtatattcatgaatgtagagttctgtagcccaacaataagaaaaaaaaatagcctgttaaacattttaactgagataaaaattacacacacacacacacacacacacacacacacacacacacacaagtgctctcttcaagtccggtttctgataatcataaatgtcagagattattttgctagcattcctaggtttttgctttaatatttttccattggtaaacttccatttacagcgtctttcaatttacattgaaattttttaacatttgaagatgattgaaatctgcatttacatcttttatatgcaggtctttgagcttgctgcacacaaaaggaaattcacatcataataccctgtagtaggtctctagtggggaatataacacacacacacgcacacgcgcgcgcacgtagacacgtaaacatgataagatggcctccagctggtgtcctattcagctgccatctataattaggtatgggctattatacattctggcttttgattgttgaaagagcaacaataaaagtttttggacttcaactactaggacacagctaaggtctgggcttttcttaatgagggaaatcagttcgtaactcttttgccaacagttaattttggattttctcctcttaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatt

SEQ ID NO: 70865 - DNA, 1012 bp, Homo sapiens
tttccaagcctccccccataggtgtttgttagttttaagggattaaaaagtaaagggctaagtcactttgttttttttttttttttttttttttttttttttagcgggagtctcgctctgtcacccaggctggagtgcagtggcgcgatctcagctcactgcagccgggttcaagctattctcctgcctcagcctcctgagtagctggactatagatgcatgctaccacgcctggctaattttttttttttttgtatttttagtagagatggggtttcactgtgttagccaggatggtcttgatctcctgaccttgtgatctgcccgcctcggccttccaaagtgctgggattacaggcatgagccatggcgtccggcctcttgtatgtttttatattgaaataagtacaagcaacgataccattacaaatagctcaggagtttttacagttccattaaaatgacgtgctaaaatgtataacgttaaaaatagtccttgaaattagaaaagagtagactctggttatcttgaccatgtaaatttttaatgaggtattaagaagtgtgtaacagttgaggtaacaacttgcataggtattatgaacaattttaaacatagccatttaatattccagatgtattttcggcacaaatgatttgtctattcagtgataaaagtctcactgcacctcactatcagctaacccagatgacttgttttgtgaaatttaagaaaaatttattggtagagacctctttcaagtttgtacttaacagatgatcactagtggtgaacagcattctacaggatactatctttcactaagacttcaacctgcaaataaacccacttataaaaaagggatacatgatcttcctgtggttaacagagcttagatacatagctggtctacagagattagttgattctaccctctccaaataagataaagttagcagcaacaggactttaaagaaacccagtgagattatcagaagaagaaaaagagtg

SEQ ID NO: 70866 - DNA, 2201 bp, Homo sapiens
tctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggtatggatttttaagaatcttattttcatcattgggagttcataaagtgtagcctataaaaaggcatattctatgtacatctagtgtgttgagctagtaccattttcaggtcaaaatagattgtttttataaatatgtatagagaaatcagctcactcaattccttctttcatgaatcattggaagtagttttacatctatggtagcaaaagcttttggagggagggagaaatcaggagacggagctctctaggttaccaatattacattcattatctgagggattgagaagaggagggtttaatcccagagggaacggatttaaagatgctgctattctcgggatgaaaatggtgcacatggccgggcgtgggggctcacacctataatcccagcactttgggaagccaaggcgggtagatcagctgaagtcaggagttcaagaccagcctgaccaacatggtgtaaccccatctctactaaaaatacaaaagctagctgagtgtggtggcagacgcctgtaatctcagctacttgggaggctgagtcaggagaatcgcttgaacccaggaggtggaggttgcaatgagctgaaatcacaccactgcactccagcctgggtgacagagcgagactccgtctcaaaaaaaaaaaaaaaaaacccaaagaaagaaagaaaatggtgcacacttgagcaatttcagggaccaaggagtagccctggaggacttcctataaaatcaaagggtcatggtctgagagctttaacaagtaggtagggaaattttaaggtaaacaaatgtgatttcatctagaataatcttatatgattttcctttattttaattactactcaaaagtttcctttgtcatgataaggtggactataaaaccagaatcttcgaagtaaaggttctctatactgagtggacttattggtgaactgttaatagacataaggttctctactttcccataacacacaaatttaaacaaaattttttttataactgaggctattaggcttttaggtcatttccttccccctgcacacctgcctctgttcttcagttcaacttgcattgtaataaggccatcttttgtttttatagcatactttcctaaaatgttgtttaagtatttcagatgtaattcttcttaaggaatatctatgaagtttattt

SEQ ID NO: 70867 - DNA, 1606 bp, Homo sapiens
gctactcaggaggctgaggcaggagaatggtgtgaacccaggaggcggagcttgcagtgagcctagatcgcgccactgcactccagcctggttgacagagcaagactccgtctcaaaaaaaaaaacaaaaaaaaaagccatttcattgacaagtcacactggtaaaaaaagaaaaaaaagccatttgatagctactgatttgaatttggagtgtgaaacattttttaaatgcatgagaattatagcacagatagttttaatccttatagatttcatttcaagcatcctatttgtaaggtgctattatattggtacaggtaatattttgtcagaatctgcatgagggatataaaaatgttttgtcaggtaatacctctttaaaatgaatatactgccaaaaatcatacatccaatctgctgacgccagagcgaatgcatagcttcacagcggtggattagcaaatgaaaagaggtgctctgaacccagtagaggaatataggaagtgtcaagaaaatactcccatcctcctttctttcctccaagctcttagatctttgtgtgatgagacccctttggggataccctagttactgtctgagttactggagatctctagggacagcagcctggctctgcagctcctgctttccacggtgcccttgcctctgtcgtctaccccttactgatttctttcataagtagacagggtaagtgggccccctgagctaaaatattaatctcgtgatccgtcattccactattctggtttcacgtctatttttaaaaagattttatctttgagagaccccccccttttaaaatgcaaattcccctgggagaggtcagaccttagttcttagctaacatcttgattatctgttagcaccttagttgggcttagtacacatttggctgagaagaaggaatccctggctaaaagtgatcaactagaaggaaactagcatttataataataatttattattattttattactattggcagctaagatgtactcagggccatattattaagtgtcaggagttgttctaagttaattccctcaacaaccctattggtattattaccactgttactttacagataagaaaactgaggtatgtagcacgtaatttatggtcacatagtaaatcctgtcaagtgttaaactcggggatttagattccagtgtgtgctcgctcaccgttttactgtaatccctctcttctaccatgatgtctcagatagatgacatctaatcaagatttcacccttttcacaattttgtatcaaatagaatgatgtgtttaattatagatgccacttccctttgaaggtcaagtactttgttattatctaaatagattttttagcaatagcttcaatgaaacaggtactttttttgtattcaagggaatttatttgcagagtagagaaaggagtaaagaggttagtgtacaatttagcacatacttaacactatctgagctgtttttatttaaaacatgttatttttacaattttgaaagtatagattaataaagaaagtacagtaattttcagtcccattacccagaggtaacctcagaataaatgtattctcac

SEQ ID NO: 70868 - DNA, 2182 bp, Homo sapiens
aggtgatgctcgaagccccggggcacttcgggagggcggttgtggcactcggttgaggaggaatgcgcttcccggcgtcttgcccgccttctctccatcgatcggtccccgcgctgccggcacctgctgccgcttaaagcttgaaaatcagcttcctaaagccattcccgatggccttcgatgggaaagaatgccatatggctgaattcattatgggggataagaaatatgtcagtgtgcgcggaggggaacctgttaatacgttcaaatttaagagtaggtaagacaccataccccgcccccatgaaaaaagaaagtgaactatatagtaactgttccaaatgcaaggttgagctgttgttaaattctactggtagctcgcagtttttatactggaagcaaaaccatttaggaacccttgggagattcactttctcctcagaccagtcctcaagtcccccactcccgccaccttttaagctttaattgttgtatctgggcaagtaacggggattgtgaaatttgcatggaaataagaccttcaggtcctgcacttgaattccttatctgttaagtagctgcctgtgggggtgaaagtaggggtggtgacttttgggcctggaattccattttgagttgtgttcaaaacgagcatttggtgtaaacaaggaaaaagaatgggctgttcactgtggtgaaatgcggaaagccaaatagaagttaagcacatgcttagagaatatttcataatctcaatgagattcaatattcagttgaatcttgaaagagatgaaaatttgtattcttggaactctaatcgttttgtccttaatttagcatctcaggatattttaaagagcgtttaaatgttttggcacattcaagttttctctccccattctatcttttttcatagtagccattagttttgcatatgttcgatgtcagatttttcagtccagtatttatcactgtgggctatccaaattcaaatgtagagatattctaatattgaacagttagtccagtgcatacagtttagaaagctgaaatattttgactactttgtgtatcagtcctgtttttcttcccaaatgttaattgtttgagattttttagcttaaaaatttttaagtgataaatgaacctgcatttagtataatatacaatggtacactttttggaatatttaaaatggaaaatctgttgaagatttgggttagatatttgaaataaattttctacccagttgtctttctcccttttctacagatttatcttttctgtactacaaagaaagaaagcgtcatatccactctaccaaacttctcctctacacacttgaatctattacagcgttttggtgcctaagagaattttctgctcattgggttgtttgagggcagagtctgtgttttatatgtgtatctctagtacccgactaactgcttaacgtggaggaaaaacccccgtgtaaatttgttgaattggggttttgaatggtagaggatacagaaatttggcttcttggtagccaaaaacaaaacaaaaaaacaaacacgtgctttgaagtctctgtccttcctgcagtgttaggcagaacaaacgtgggtgccagattctaatggagttgtctggtccagggagattagcgagaggctggggcacgggctcaggagtctaatcaagataggaaataaatcgtgtgcccgaataattctctgaattcagtaacgggggacagttttgctattaggcccagcctaaataggtgacaaataactgaaatacaggaggattctacaaataatggctttctggctaaaaggtgattgtaaaaggtgtaacattcacagcaattttagacgccataaaaaactttattaggaagaattcatttttaatggagttttacacgtcataggaaaaaggtaatttgtagtctaacgatatacttgctagatcagatcatagatgtgctggaatgacagagtctaggcattttacacacagagtatttgaattcaatttttcagacccttggtaggatgctcagtattattctgaatgtttctcccattgttacgaagttagctgcggtagattgatgtgtaaatttgttgatgtgacactgatgataaatgttttggaacaaaattacttgttaagtagggatgggggt

SEQ ID NO: 70869 - DNA, 1100 bp, Homo sapiens
ggggtgggggatggggatctgcacgcccggtttgtgacttcaggaaagcagtttccaggaggtgagagtttaagccaaacctgaaagaggttgatttgtaatgatttgcaggggggcactggaggcagccgccaggacttttcacttaggagatcagcatttgccctgatggaaactgggcgatcctgcagggactgacctctgagttatccaaaggccgacctggggaaagactgattttgaggttttaataggtaagtttggggacatcattgatgaaggtgggcagggaaggaggcttttttcttttcttttttttaatgttacagtaaaaagcttagattcgatgagacgggttaaaaaacaaataggaaaatttaaggagaagaatgactatgattgctatgtaaaaataaaattgcaatagagaggttctggagctcaggaaatgagctagagcatgctataatttaggcctagatagtgaagatcatgaataaaatggtagctgaggaaatttcaaagttgaataagtagtaataagtatgaagaaaaagctaaactacaaacatctgctctttaattactaacactagtaatgagaatttgtctccagcctcttcccttcccactccgcacctcttcctagcttacatcattgtattaaggcattttattgaagacactattcagcactctccacctatgccttacacagcttgcctttgcttttcttcccatttcactttttctcttcatttattcacatcattttagtccttaaaagaccccgcccaattactagatcagagggaggcaactaagactcttcctatctcccaaacgaccttccagaatggttttatggcattataataggaaagcaagagttttgatttttctattattaatattttgctttcaaggaattacaggaaaaaccatattgcatgccagaaatacttaaattttaaatatttcatcttaagagatgccctcatgtaatgcttttaatgcatttgagaaattcaggtggtgggcaaaagtacaacatagaggttagatgttttgagtgggagaagtgcactggggtcattatt

SEQ ID NO: 70870 - DNA, 1050 bp, Homo sapiens
tccatatattgcataacgtattcacactttgcccatcattcaaggcattgcatgtgctattgtcaacttccctaaccaccttttaaatttatcatcaacataaaattaagaagaatagtgaaattcttttcatattgatgacagtccactattttctacagagcaagataatcaaaacaaaataattggtcattttgaagaagaaatttactgaatgaagcagttggaaagaatggattacagttgtttttgagaaagtttacattaattgttcacattaaaaatatatcttccaagtatcttctctgctttccttagtcgttttagcaaaggcatctgtgtttatttatttacctaataagtagttattctctaaattcttacctctaagttctctaacttattctttaagttcttgtctctaagaacatttatttacctaattatttattcatttacctaatgtcatcttttggtcccataattttaaataagtgcaaagtgatgtttatactgccagtttggagttttgcagtagcaggtgtgattgtcttataaaactcttttgatatagccaatgtcatgttccttattcgtgtgttattttcgaaatgtattcaaggcagcacccccgagacagctgtgacaataatgcccccccccccatgacaacagaggaactgtgccaaagctcagcaaaacaaaatttacttggcaggggagagagtttagaggcttttcacagctctttggaaatgctaataaggtctcaaccttgaaccatgtttgctttttatctgggaaaccctttccagttacaatagcattgatatactaagagattccaagttaggagtttatacagtaggtttatgagacaggtaatccaaaagtcaggtgctccctcttcgcttggaagaacagtgcattttgggacattttaaagcacattgtcaacttctttggccttttttttttttttttttttttttttttgagttggagtctttactctgtcgcccaggctggagcgcaatggcgcgatctcgg

SEQ ID NO: 70871 - DNA, 1061 bp, Homo sapiens
tgctttggtacccttgtgcctagtatatctccttttactacagtgcagcatgcaatataattatttgtatgtgaggagttcccctccccatctccaacttcttgacagggactcatttatttatttatttataagagacaaggtcttgctctgttgcccaggctggagtgcagtggcctaatcatagctcactgcagcctcgagctcctgggttcaagcagtcctcccacctcatcctccctagtagctgggactacaggtgtgcaccaccacacctgactatttttggtagagatgggggtctcactatgttgcctgggctggtcttgaactcgtgacctcaagtgatcccccggccttggccttccagattactggaattacagatacgagccaccctacctggcccgcttttttttttttttttttttagtgcctttatctttgtttctttagagctcagaacagtgagtgatgtaggtagtcagtgtatcttaagtgaatagtcagtgttttgttttgatgggttaaaggtgaaattggctaactggatatttaaatttccctggtactctcaacaaataaaagtgaaaattatgtactaaaataataaggagtcaaaagttttcttcatttgcataccacaaaatattggtgattcggtagaagagagttggtggtgggaggaaaaataattaattagatccttttttgttctttgtgcagagtttacccctcaatcccaaacctttcctcaatggactaacaggaaagccagtgatggtgaaacttaagtggggaatggagtacaagggctatctggtatctgtagatggctacatgaacatgcaggtaagctaaagagctgtaaaggtcataacattgcatttattttgcttcaccttatttctcaaaggtttagtctgactaataagaatacatacaattaaattgacaaatatacggcaaaattcaaaaataaagtcaaagccaggagggatactgtgatatactaggtacaagacatggacttaaaccagaattcagctacagattttatt

SEQ ID NO: 70872 - DNA, 1813 bp, Homo sapiens
atataccacattctaatccatttgcctcttggtggacactgggttgcttccctctttggactgtagtaaataatgctgctgtgaacatgggtatacgaatgtctgttccagtcactgctttcagctctttggggtatatacccagaagtggaattactggattactggtaattctatgtttaattttttaaggaggccaagcgtggtggctcatgcctgtaatcccagcactttgggaggctgaggcagcagattgcttgagcccaggagtttgagaccagcctgggcaacatagtgaaactgcatctctacaaaaaaaatacaaaaactagctaggcatgatggtgtgggcagctatattcccagctactcaggaagctgagttgggaggattacctgagcctggggaggttgaagctgcagtgagctgtgatcactgcactctagcctggatgacagagaaatttttttttttcttttgagtaactgtcacactattttccacagcagctacgtggttttacatacccaccagcaatgcacaacggttccagtttctccacatcctcaccaacacttgttattttctatgggtgtttataaaatagttattctaatgggtgtgaagtggtatcttattgtggttttgatttgcatttggctaatgatgttgagcaccttttcatgtgtttattggccatttgtttatctttggagaaatgcctgttcatgtcttttgcacatttaaaaaattagtttgggattttttgttgtttttttaatggtagtagtttccaggcaggtttttaaaggctatcaagacaggtggtcaatccaatcatgaatccaaggattccatacttgtaagcagagtactaaaaggagtacttaagtaggcagagagctatgattttccttaacttaggcaattaccacctgagcacatgacattaaggcccccaaagcatagtttgagtgtggaaaattccttaaacaggagtcatttaccaagaccatagaaaaatctgggaagtatatgaattgtgatgaaaatattctggaagtagtggtgatagttgcacaggtttttgaatatactgaaaaccactgaattgtacactttaaaagggtgaattttatgctatggaaattaacatctcaataataaaagaattaccacttaatatttgttttagaattaatatagcttgctagtgaccctgctagagttgcaaaatgtctgagtaaccaaccactttgagtagtcaaccatattgataccagtgtttgaatttgttcactcagcaaatatttattgaattccattatgtgcctggcactgtgaatatagcattgaacaaaacaaagtccctgccctcaacagtttatggtttagtggtgggaggtggtaatataatgtgataataggcatgatagatgccatccatgaagaaaagggggaagacagtatgtgcaatattatatagagtagcctctctgaggaggcgaattctggaagataccagaattagtgtacaactcagttgagtatctggggaaaagcatcccagtttgagggaacagcaagtacaaaggccctgtggcagaagcatgcttggtgtgttcaaggcacagcaaaaaggccagagcagattgagttaagggacgaatgacagaaagttaggttaaaatggcggccatagagagcctgttaagtgatggtgaagaacatgatagaaagtatttggaacattattgtgtaatttagaaatgttaaatgttgtaattactttttacaaaaaattagttgctc

SEQ ID NO: 70873 - DNA, 1018 bp, Homo sapiens
gattgtgccactgcattccagcctgggcaacagagggagaccctgtttcttaaaagacaggaaaagaagaaaattcttactcaattatttgctttggttgttgactaatataaaagtatttggcatgttagccatagctttcgtatacctatttggacacctcaatatgagttagagactgccttcttccacacactgttttaatatctaatagaaagaaatattacataacctgggagattcagaaacttatgttgaaacaagctttgaatattaatttcgttgaaggtttatatgaaaccaaaagtactacaatagtaatagaaagctcatcttctgtttattaattatagataaatttgagttgttggtatagaaaggtctcagttaatgagttctctcaccaatattagctgtattgtaatattttcctcctgtgtgattatactaatatatttctttttattgaaagcttgcaaatacagaagaatacatagatggagctttgtctggacatctgggtgaagttttaataaggtaacaaacagcagtagtatatgtaaggagttactggtgagcattaggaatacctgttctaaatatattagtgcctcaattttggaattacttttttttaaaaaatcactattataatactttacagttagacttcagaagtctttgaaattgttaaacttgtcaaaggtaagttttcaaatgttttggaactggccaaaagatttttctagtgttgatgtttaattttctagctcttagctataatcttttgcagtggcaaccttttgcagtggcctttgttgcgggaacttagttttgaattttagttgggtctggctgttttgttatattgattttctgtactagcttcaaagctccaaattctggtaattatttcctttggaaaatcataaagatgtcattttataacaaccatatggtggaaaataagtgccatgtgcttttcaacaaatctatgtgaaacttttttttaaaatga

SEQ ID NO: 70874 - DNA, 1058 bp, Homo sapiens
taaccgtggcttttgaatattcaggtaaatctcgacaacaaatactattttgaaatgggaagaaatttcatcattttggaaaatataaaatatacccagatcttggtctatttttttttttttttcctcagagacagagtctcagtctgttgcctaggctggagtgcagtggcatgatcttggctcactgcaacctctacctcctgggttcaagcagttctcctgcctcagcctcccaagtagctgggattacaggtgcatgccaccacacccggctaatttttgtatttttagtagagacggggtgtcaccatgtttcccaggccggtctcgaactcctgacctcgtgatctgcccaccttgacctcctaaacatttcagcactttacagatagtttgtataatagctacttgaattaactttcagctacttgttcctctttttaaaacttttaattgaaatgtcacatacatacagaagagtacacaaataaatgcatagcttagtgagctgccacaaaagtgtaccttccagttaatctttttgaataatatcctcaaattgtgagcaagaaatgctatttgtcatactctctttagggttgttttgagggaaaaattaagtaatctgtgcaacttatcaagtacaaggtggtgagcaataggcactaaatatgtgatagctattttatggacctatttaatgatattctaagtgtaaggttatatactagggaatggaaataacatgtactgagcatttttattgcaaaattaggtgccgtgttaggtgccccaaaccatggggaaaatcagctaaaattctttttaagaagaatgtaagtaattggaattacattcatgtatcactgctaaaaatgagttgtaattacactttggtgcaaatatatttgctagtgtaaaaaagatggaagtgctgttagtgtagtcataatgaggtcatcttagggaaggagtaacttttcatttatagttttttttaaagcttgctttatgttcaataagatcccatcaggatcaccatgatatagtctgga

SEQ ID NO: 70875 - DNA, 1026 bp, Homo sapiens
gctgggactacaagcacatgccactatacctggctaattttttgtatttttagtagagacgaggttttgccatgttggccagggtggtctcgaactcctgtcctgaagtaatccacctgcctcggtctcccaaagtgctgggattacaggcatgggccaccactcccagcctaaagttttaaaatctattaaaaagacagctgtgtgataaatgctgactgatttcatatgtattttatttaatcatcaacaaaacattgttaaatatttttgcctcctcgttgtgtctgatgaacgtggctcacggagtctgtcacttattcgaagttctcggtgggtgcagaattcaagccaaggcctgtctgattccaaagcttgctttcttttacctcccaattaacatttattaatgattataataatcattgttgccattattaaccttgagaaattaaataattactcatcccaattgtattgtttaaataatagccagtaacaattattaagaagttactatgtgtttttgtaatatattgcatcattttcctctcacaacaccattacaaagtaaagtagtgtatctacccgggcttacttatgctttggtaataaatcactcctaaatttcagtggcttccaataacagaggtttaattatccttcactttccaatgtgggtgcttttctctgggtcttctgctgaaagaatatttcctgtctaggatgttgctggagttatagcaaagggagaaaggagagaaacaggtagtggttctcgaagcttcttcctggaggcaacataaatcccatccgatcccattcccattccctgggctgaatctgtcaataggcaagtttgacatcaacttagtggggaaagagaatcctctcacagagaggggcagcaaatatttgggaacaataacataatctgccacaggcaatatcctcatttcacaaatgaggaagctgaggcatggagagagggtaatttactcatattcccacagctagtaagaggtg

SEQ ID NO: 70876 - DNA, 1265 bp, Homo sapiens
tgtatggtaggtcctttttatttagtgtatttattatttatttcgtgtattatttattatgtatttattatttcactgtggtcaggacttttattctcaattatttgaagttttcagaaattctatataaattttagtgttttcatactcttaaaatcttgattaaaaaattttttttaaaagcagtttttaaaaagaaaggctttgaggctcactctcacatacagggctgatatttagccaggagatgagaggactctgttcaaataataaaatccttccatgctgcttggtaaatagccacgggtcccagccactctagcccttccctgtaacttgctgcaaaatgtctgatctgccagtataaaggccagtctctggtacagaaggaggtctctgggaccctgtggcaggaccatacccatctgattggctgggactggtgccttatttgggtgatgctggctgtcacccctgctgacatcctttaatttaatcttgggtattgacttgtgttcttattctctttctccttcctttttcctttcctctgaaccccttccctcctttctttcttctctccctccctttctcctcctctgtctccttctcgcctttctttcttttcaattttttcttttttggcagggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttatagtggcatattctttgtaaattttaacaaggtttaatcttttgatttacaaattaaaaaattttgaattagctttatattaattttctctcagtatgatcacaaaatatgtcaaggtagtattttacctgatatatgatttaaattcattaatttgaatctgctgcagattcaaaaattcaacatggttaggattttgctttgctttttaaataaccttaaacataagtccgggcgcagtggttcatgcctgtaatcccagcactttgggaggccaaggcgggtgaatcacctgaggtcaggagtttgagaccagcctggccaacatggtgaaaccccg

SEQ ID NO: 70877 - DNA, 1047 bp, Homo sapiens
gcaatggtatcgggctctctcaagggtctagcatctagaacggtgccaattatgtagcaggtgcttgcaggtttgttagatgattagatgtttggaacaaccaagtaaaatccatgacagcaaggacttgatgttgttcatcttgttgtcttgagtgcctagaactgttcctgccatgtactaaatatgctcaactgattccaactactttagcatatactactcgagcacatgacagtcttttgctgaggtgctttggcattctttctaaaagatagatgggtgtttcattaatgtggtatccatttgggtttgtgagttcttggatgatgccagtagtatgtaagttaggtaaaatatttcctattttcctcactttggagtttgttttccttatttaaaagggactttgaaatttaagtatgtactgtagctttaaaactgcatttctgcaaaagcacgtgcatttttaaacaatgtaatctttatctttgcagttatgatatgactctgacaaatgcttgtattgccttaagtcaaagatggattactgtaagtaataatgtgtgatttttgattcctttttgaattgtgcaaatatgtctttactcatgaagcagggagggtactttaaatcacaaacagttatatttggaaaggctatttgaaagtcaggtttatctaaggtgatattatatctactctcaatatagaaaattaagggtttgagacagggtcttgctctgttgcccaggctggactacagtggcgtgatcatggctcattgcagcctcaacctcctgggctcagtcagttgtcccacctcagcctcccgagtaactgggactacaggcatgtgcctccatgcctggctaatttaaaactttttatacaaacagggtctgtgttgtacaggctggtctcaaactcctggtctccagtgatcctcccaccttagcctcccaaagtgctggaattacaggcatcaggcatgagccactgtgcccagcctagaaaattaagttttatggggggaaaaattgatgt

SEQ ID NO: 70878 - DNA, 1033 bp, Homo sapiens
tttttagtagagacggggtttcaccatgttggccaggctggtcttgaactcctgacctcagataattctcccgcctcggcctcccaaagtgctaggattacaggcgtgggccaccatgcccggccaacaaggatagttcttaaaaattctgtaacacttattacagcgttaggagtgttaggttcagtctaggtgttaagtttaattcctgatatactcccacttttaacatagggacatgcaagagcagaagcagggcttaactttccctgctgccatctgctgggctgggcttcccattgctctggattgactgcctgggagccagagtcggcttagactgtagtggtcatgccttacaactgctttcctctgtagaaaagccaaaaagaaaatatcttgattgaaatgtcttttcttctcagctgtgtccgtgtttttattaaaatatttttttttcaggttaaatgagggacatactgtgtacttggaacgccacatttgcggacgattgtttggtgaaaagttcagacattttaatgctctgggaggatggggagaactacagaattcggtaaaggagtcaaagttttaaaaaccttcatccaaagttgtataggtgttaaaaactgagtttttataaaagcgtctttactgtgtagcaaccaaaaagtcatttttacaagtgtggaaagtgaagtcaatgctggtataacactgtgttgatccacactgttcactgttctatgtaaggtagttttgatgacctggtctaaatagggagctgtgggacctcactgggtctttgctattaatatagctgtttactatgtttgcatcttatttggtatgtcatttttaagtgttgtctcctgaaagccaaatttgctgaccaggcattaaatcatttttctagtctttttataagaataaagcctgtattattgagcaagaaacaacagagaatattacttaagtaagcattctattaatagacttccagaagtttatgccaacatatcctagtgttcca

SEQ ID NO: 70879 - DNA, 1034 bp, Homo sapiens
atcactatcccggaggctagacctacttagaccaagcaaatagaatgaggaccaacccatatttatggggccttcttgcttcccaaatcatcccacaaccaaattacatctaggatagtgcagtgatatattatacttggaggcaaagaatcccagggctctggctcttctccaccacttaataactgcgtgaagtcccaactacttgggaggctgaggtgggaagatcacttgaactcagaagttcaaggccagcctgggcgacatagcgagaccccatttctaaaaaaataaataaataatgatgtgacacttgaacaagttttatgacctcgcaacctcagctggcacatatatataacgtatcaccacctaaatgaagggaggtggctgaaccgaattatttcctgaatagttttgtgctttagaatctacaattgttgtagcactggttcaggaacttctaattctgtgcctgcctcagtcacagctttgggtcctgagccatgcaagaagaacatgaaagtctagcccctactggaatatattcttgtttgatcattaatacttgggggagtcctttattctggcattcatcagaaatcaaactttcagaatcatggagctaggatacacagttaaatgactatatggtttgccgcataagggtcttttccgtatggatttccagagaaaattatttgacagtttttagcaataaattttagtttttcacagttactacttttaaaatgttcctctatttgtaactccaagtgtgtgttttcaaaacaaaattgttcaaaaccattctgtcctacagtgagtatataacgtccttttgaatctgttttgtgagtgtagcgggagcagggatggtggctgccattgccagggatggtgctgggctcttcacttatattatttattccttgcagcaagcctttgaagttttacacttacttgatggggaaactgaggctcgggggttatatttatttgcccaagtttgtgcagttagttattaggtggca

SEQ ID NO: 70880 - DNA, 1063 bp, Homo sapiens
cactactgtcacccagaccatagagtaggaaacactgcttaagagtttctccatgcttcaactgaaatgtgagggttaaccatagattaaaatggaaaatctgatttttaaaagtccaagaatctatttttggactttaaaagatcccaaaaggccaggcgtggtggctcacgcctgtaatccctgcactttgggaggccgaggtgggcagatcacctgaagttgggagttcgagaccagcctgatcaacatggagaaaccccatctctactcaaaatacaaaattagctgggcgtggtggtacatgcctgtaatcccagctactcgggaggttgaggcaggagaattgcttgaacccgggaggtggaggttgcagtgagccaagatcatgccattgaactccagcctgggcaacaagagtgaaactccgtctcaaaaaaaaaaaaaaaatcccaagaaatgaggactgtttttattttaatgtctaagaacaatgctgcaatttttaatgatttcttaatgacttatgcgaaagataaatagctatttcttcttgtttctccctttttcaggccatccactgcagagcaatccttccttgtcaggacactccttctgtgaaattaacctatactgcagaggtaaatattacgaattattaactcaattaaatgatgcatatcagtaaatatggtataaatgataagcagagatgataattgaattcctagagctagaattatttttcttaatgaaattctacctgaaatatgtaaacaaagaggctgtggcactcattctgaatctctactttaaaggcagttttaaacattttaactgtgaaaaaaaggaaatggaaaccaatctgacttttaaaaaggaattcagggctaggtgtggtggctcacacctgtaatcccagcactttgggaggccgagatgggtggatcacgaggtcaggagatcgagaccatcctggctaacatggtgaaaccccatctgtactaaaaaaaacacaaaaaattagccgggcatggtggcgggcacctgtagtcccagctac

SEQ ID NO: 70881 - DNA, 1037 bp, Homo sapiens
gtgatatacagtttgctgatttgcttaacgaacatgaagtttgaaagtacatgagttctaggaggaaatatattgtgtaatgtattgaggagccagagtgaaagaaacttaagttatagataaagtttttcataatagagaaaattttaggagtcagaagcaaacatattttgatttagatttgacttttacttaaagcccaaaatttgtgtgactgtcctagggttatttaacaatatatatgcaaatcttagaacccaaaaattttcaagatgcttagagtcccaaaaaatgagacctagactagcttttgactcttcaattcttctaatttcactctgtattttactctccataagcaactagttgttgtagcctatatctaatatgagttttttctggtaaatgaaactattttcttactatttaaaaatattaattttaggttttggatacaaaggaccttacaatagaaaaagtagtgatcaatggacaagaagtcaaatatgctcttggagaaagacaaagttacaagggatcgccaatggaaatctctcttcctatcgctttgagcaagtatgaatgttatgatctttctcttttacagctaaataatggggaaacatattcttaactaatttaaatattttttctttttaaattttagtttgtaaatatgtaatgattggtacactacttatcctgatcttctgttcagattaaagttgatacagcagttaaaattatatatacttaagatactaaaaatgttgtttgtatataatacaacaaggactttgggaactgttagtttctaaacgattcatccttttactaatatctagagtgatggtgggggcatgccatcataagaaggcatttcaagataacctgggcagctttacaagttgcaccctccttgcccttgccccagaggccagctgcatttattaatgggacaatgataatgccaaagatagaactgttacagtgcagcaatcttgggataagtgctttaaatgcattcttgtatctaa

SEQ ID NO: 70882 - DNA, 1090 bp, Homo sapiens
ctccagggctcaggtgatcctcctgcctcagtctcccaagcagataggactgcaggtgtgcaccaccacacctggctaattttttttttctttttgagacagtgtctggctctgttgcccaggctggagtgcagtggtgcaagcttggcgcactgcaacctccgcctcctgtgtctaagcaattctcatgcctcagcctcccaagtagctggtatcataggcatatgccaccatgcctggctaatttttgtatttttaatagagacgggcttttgccatattggccaggctggtctcaaactcctggcctcaagagatctgcctgtctccacctccaaagggctgggattaacaggagtgagccaccatgcctggcctctggctaatttttttattttttgtagaaatggggtctcattatccctggccatttacaaaattctgttacggcaatttcatgattctaccatatagattcttaaacttcagaataccttgataaaatattgtggtattttatttaatctgcttagttaaaaataaatcagaatgtgtagatttcctcatcatacagtaagaggaaaaagaaaaatcctttctgtattacctgatatccgcaaaatatttaaccaaaagtaatatgtgtgctttaggaaaaatgtattacctgaagactaattgggatgagaggatattagtaaatcttcccagacctcagtttctttagcctgatggtaaagtagttgaagtggaggctgggtgcagtggctcacatgtgtcatcccagcattttgggaggctgaagcaggcagatcacttgagcccaggagtctgagatcaacctgggcaacatagtgagaccccatctctgccaaaaattagctagacgtggtggtgcgtgccagtagtcccagctacccgggaggtcaaggctgcagtgaaccatgattgcgccactacactccagcctgggtaacagagtgaaaccctgtctcaaaaaaaaaaaaaaaaaaaaaagggattgaagtggagaagctgagatatactccctttcaagtcggaagccctatttgtgtactgctatatttgg

SEQ ID NO: 70883 - DNA, 1055 bp, Homo sapiens
ggtgggagtcaatggcactctgtaagacagaatttggctgtctatagacgagaattatttcatgatcagttacctatagtcaacaacgttgtaaaataccttccaaaaaatcagaatcacatcatccggagggagtcttctctagagtcaagaatgcagtttttcactgaagcataattcttttcttttcgactaggtctcactctgtcagccaggctggagtgcagtggcacgatcttggctcactgcagcctcagcctcctggggtcaaacaatcctcccatctctagctcccaagtagcttgggctacaggtatgtgccaccacgccctgctcatttcttaattttttgtggagaccatctctgtatgttgctcaggagtctccaactcctggcctgaagcaactctcctgcctcagcctctcaaagtgctgggattacaggcatgagccatcgcatccagctgtttagctattttctataactcaaagcaggtgctagtgaagcacttttgtctatttggaaggtaagcgcagattctggcacctgactctctgggttcaacagcaaagactcgtcctgtctggttgtgggactttggggaagttacttaacctttctgtgcctcagtatcctcataggtaaaatgggactgatatgataaaagtatcatatcatacagggttgttgtaagagttacagaagttactaataatgcacttaaactacacctggggcaaagtaagtgctatttaaatgttaactacaattaccttttaagctacagggaatcctcctcacagagcttgctgtggagtcacatggccttcaccaggctagaaggcattgtgtagctacagcacccacctgggctctttgtccattaggcaatgagccccacacaggcactgaaatccagggagactcttcagccacatggcgactgtggtttataaggtgacttggagtatgcttctgttttgtagtctatcatcaaatatgaaagcacaaaaaatcgtaaatgcttgcagaaaactcagatgctagggcactg

SEQ ID NO: 70884 - DNA, 1059 bp, Homo sapiens
acagatgtccacatgtccacacagatgtccacatgtgcacacccatgcccacatgcacacacagatgtccacatgcacacacacatatgcccacatgcacacaggcacacacacccacttgcacatacatatccacatgcacacgtggccactgccatatgcacagacatgtgcacacgcatacatgtacatgtgcacgcatggctggttaattcttgcttataaaatgctctcaagtgatgagcaagacggaaagttagactcttaatacagtttaaaaagaaaagaaggagagggggaggaagataagaagaaaagagatggttgagggaaatggaggggagaggaaaaaaagaggggatggagaaggaggaagaagaggaggcatgtcaaaaagagatgacgaaaactacactctatttgacattttccgatgacctctttcttccttccgttttgccagtgtcactctgtgatgataggtgtaagttgactgtgtgcattgcccgtctgtgaccgttttcgactcacagaaatggcagtctgaagtggctcggcctcttgcttgagagacagattggagcagagtctttgtggatgcaaagccacctgggccactgccgtgtgtgccaccctgaacttcaagctgccctgaaccgcgtgcgtttctcagtgtcacgtacagctcggcctgaccgtttgccttttagtgttctcttccttctcggtgtcctcctcctcttcctcactaacattcatccagagcctttcagtgcagaaatcaggtagctgctgaactcggcagctgcgtcctttttcccatcatctcttctgtcctttgctagctgtcatttcttccctcttggcttcaactgcacatccctgggtttgtcctaatagggaatttttcccacttgagtagacaagcatgagaatatcattatttttatatgttatatgttatatttttagcagagaaaaaagtggaaaatgtgtgcaaacttgcagaaggccccccggaggagggtcgtccctgtgcccatgctgtcaggaaggccc

SEQ ID NO: 70885 - DNA, 1421 bp, Homo sapiens
atgttgagttgaaatattaaatgtccagagggggttcatgttagtggggttgcacgcccttcagaggcagacattttcattgaggcagaaattgcagactcatgccagacacccatacgtggaacaattagttcttaaagtgttttgcatattttcatttgtctatgaaaacaggaaatttattaaggaaaaggcaaaactttaagaattattctttaggccagtgtgatggctcacacctgtaatcccagcactttgggaggttgagggtgggaggattgtttgagcccaggagtttgagaccagcctgggcaacacagcaagaccccatctatatttaaaataaaatgaaaataaatattattatttataaaagtccacaaaagactttaaaatattaatcctcctagttaatgtagcaacttgtttgacataaagtgaaaataaaaatagtgaacaatttccccatcctgggatagaaaaattacttgcatcattttatgaatcatcattaagttctccttgttctgtaatgaaaaaggagaatccagggcatttggttaaaaaataatgaagacttagctgctttatcttatagaactctccatactaggcgagcaccttcattattcattcacacaccagaatcttgcaggaccgtcacttgctatcatggagaaatcagtatttcctccttgagacccatagatcattactcactgattaaggtgttactgtttgaatatgttgagtgcaggtggaaagaatcctagggacaggactgaagaaaaggtggacccagtgcaaactccctctttcccaaattctagcttttctcatcgtccctgcctgtatcctgtgccccacagtgtggcttaccccaagttagttgcagctctttggataccatttcatctagcacgtggcactttgtattatgattgcctgttgatctggcaatctttctcactaaactatgggccctcgagaccagaatggaatcctgttcactgtggtgtccccagcatctggcacatggcttggtacacaagtgaggctcagtaataattgactgtctaaatgaattcacaaagagaagtctgagaaaggccagtattaatagcaagtcttcatgatcatctgagctggtcattttgcttgtcaaggttaatgtctgctgagtacctcctctgtgccaggagctgtacatgctgggattcagggtctctttgtaagggtggagctaaagaggttttgattgccatcttgcttctttggtttcctagtggagttagggtagggtgtcatgaagtgaccatatccttggagtaattgggtttctatctctttcacagcccttattcccatcacaacaacttgagctatagtcatgttgatttttaacaatttcagcttgggta

SEQ ID NO: 70886 - DNA, 3295 bp, Homo sapiens
acacatcttgtgcttccctagtcatcaggttcatcacttcgaagcatagaagctgtagactgaccccgtcaacagaagggtcatttaagacagtgctgatcactcttaccatggaatattagcttttgctggtgggaacattagcttcctagtcaccaaataactgtatgtgggataaaactgaaccttgaactgcctcataaaatgactttatattttaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatatatatccatttgttacataaagtgtttcttcctaggaattcctaggggtatttcttcattttattaaggaatttgacaagcaaacaagtgtttgtttttttgttttatttttgatactcgagcaccattcagatcctgaaaacactgcagtgaagggaattgaaactccgaaacttggaactttgaatacctgtgattcctcttaaactggtaagattcttaaaggtaagagaagatgccttttatattttctttccaagtggtactgtgaacacacattggatgtgtcattctaggtgtatagagtggctgcattctgtctgaggctttatcaactttcatttgaaaggctatttgttaacatgttataatctgtcttttggactcgggacaatttatgtaggttctttttatcttttaaaaattgtgttgagacatatatatatatatatatatatatatatatatatatatatatatatcataaaatttggcattgtaattatttgtatgtgtacagttcagtggcataattatagccacaaagttgtataacagttaccactgtctacttctaaaatgtttcattactccaaacagaaactctgaaccattttacccttccccgcagcccctggtaaccgctaatctactttctgtctctgtgaatttgcccattctaggtatttcaaataagtggagtcataccatatttgtcgttttgggtctggcttatttcattcagcataatgttcacagttcatccatgtttagcatgtatcagaacttcatttcttatcatgactgaataatattctattatgattatacacattttgtttatcgatttatctgttgatggacactaggatatcccatcttttggcttttgtgaataatgctgtgtgaacattggggtataagcatctgtttgagtccttgtttttaattatttggggaatacatacacctaggagtggaattgctgggtcatataattctgtgtttgactgtttgaggaactgccaaaatgttttccacagtggctgtactattt

SEQ ID NO: 70887 - DNA, 1095 bp, Homo sapiens
atcattttactttctatataacacttaatatgtaaaattaacttttatatatagttgctagattacgagccctttaatggaaggattatgtcttaaactgtgtgtgtacatacagttcctagatgactgttctaagaaccaccattctattctctgaaccaccatccttttcttttccttcacttacacacaccgccttgtaccaacatgttctacctctgcttcctgcatcaaaacgtcttgaatcatttgtttctctccatttctcctgcctagcttcactcactgtcatctcctagattaccataatatctcttcagttgtttttccccactcctgtctttgctgttcaatccatggtctacactattgctaatacaaggattcagtgagataattggtgcacttaaaaaacatttctaacacatagtaaatcttcagtcactgttagctgttgttagtgttattcttcaaggattatgcaaaggagagttggacattttaagtgggaaaaatggatatagcaatatagaaattgagacaaatagggtaaatgcgaacaaattagttagatctaaaatatcccttcaagaggttttccgacaggctagtgcaaaattctgcagagaggcaaccttaaggaaaagattcttgtgcttcataatatgtaaatgaattgctaaattattttcatgatctattttaaaggggtgttggttgcattttctttgaaatggcttctggaagacctttatttccaggatcaaccgtggaagatgaactgcacttaattttccgactgctaggtaacagaagaaatcttttcccagtgattttgcacccataattgactagctggataagactgtatctctaaaatacatattttaaaattagatactgagactaacataaacagctgttagttagaataattagaatggacactatgaagatagatccttctaggtaacttcatctgctaagttttatctttgcaataaagattttatggaaaaacagaacataattagtatggaaaattggatgtcaccatattattaaggaatattgctaacttttttggtatcaact

SEQ ID NO: 70888 - DNA, 1134 bp, Homo sapiens
acatagttctaaatggcagaattggtatttaaacctaggtaatctaattcccatgccagaactcattaatcactgttacattatggctctttaaaataatatctccttaaaagtatatacttatcaatacatcttgcattaacagttacattctttcaaaattataaatgtcagtgacatctgtatatatttaccacatgtcaatctgtgttgagtactccgaggaaccaagaagcacatcaggtggccggtaccatagtgtgacaacttcatttgagtaggtctttgtgggaactgacttggctcgggctagtccttcatagggaaaataaaacaaagggttaagaaaaagctttaatggatctctcagaccctattctcaccatgactccattcaaagggatgcctgaaatggttaattcgtagcttcttgaggcttcaccactattaactttatgaattcgttgagtgcatgtggccctaagtaagcaaatccttacatagttgaactaaacaagaattccacaaccagagactgtgcttacttttatgtttgaatacacctggtgaagtattctgggtgaatctaaacttaagatgttttccttctgtccatgaatcatgatgacaaaattatttctcagctgcaattaaattaatccataataggccaatgacattgagatacacaattttacttctaacggctatgagcttttgtcaccttttaacctgattccaactttcatttgctataccattttttatcaaaaactgtaaagttattggtccataatctcattgagatttactgacaaatcgacttagagacaatttccttggaataaaattacagtgctgttctgtactccctttttaggttgtaagttacatggatcattctggagtaagacagacttcattgtccttggatattattaattgctgtttacgtcaggggtgtccaatcttttagcttccctgggctacaatggaagaactgtcttaagccacacataaaatacactaacactaacaacagccatgacctttaaaaaaaaaaatcgcaaaaaaatctcataatgttttaagaaagtttacgaatttgtgttgggctgcattcaaagccatcct

SEQ ID NO: 70889 - DNA, 2505 bp, Homo sapiens
gttattaactgagtaacagcatccagcatagtttgtattcttacagtaggtttctttgacctgagtagtgtatccaaatttagcaaagatttatttatccaaacttagtcaacaatatgtaagaacctattctgaaaataggctgtcgcagctgtgtgcttcagacatttctaattctgtaggtagtaattttaaacttacattttaaaaaaatattaagtttggtggttataaaggagagccagtttctgttactaaaagacagctcagaacatatggataacacattgctaaggatttttaaaaagggctttaaatgtacttccatatatattctgtcagggttgttttcatcttattttacatcttttgtttgcaaagtgttataactgtcattttgtatttttttggttttaattttgtttttcctgctttttttattggcaataatttgaaaataaaacaaggtccttgatgataatttcacaaatgttgagacgtttatttctttaatgccaggtttacatgattagcttaagttggaaagcgttttattatttatttgtttaaatggcctttatactttcaaaatacaaagtgtaacaagaattcatttaaatagtaattttagagttttaaaaacataattatgtagactggagagactctggcacagagaattcattcaggcataccgttgacctgctgccttggctgcctcagtgttcggatgccctgtttttcacctacagatgaactgaggggaaactcttgaatcctctgtacttgaggttctttttgttaaccccagagaatcaaaggtcttatgtgttccgtaaccctctttctaccaaaatgtacagcaaaaactctaccattagccttataggaattacttttttcagagtcattcagaacactacggtgctaatgcccctttgtgaatcacagtagattttgaaggctaagtaggaggtgctgaaagtaaagtacccaagagatgggtgatagaagctggtttaggttagttttatagtaagtaatttgccagagctatgcagcagctttctctttgatacctcagacttttcataaaatcgccaattccagtgccttattttaaagacactgccccagatcagagtttttgtttttgttttttttcaaggagagatgggtgggaggggggttggttggttgttttgccagaattttataattaaactatgtaaaccttagtaggcctgtaagtttatgaggatatgtttttttttttaagtcattttccacagtaaatcaactgttactgctaggaggaagttactttttaaaaaatatttccatagatactgttagactaaaagaaataggtagatgcttcaaatagaataataaactattaaattcagaaagccactatatataaaaggaaaaagacattgtacttaagtatgcaattactttctttttcctgttacaatgttctaggccagctgcttttctgcttaccatcatttatgcttatactaaagcatgtctcatctttaagactaatttttatttatttgtttctgtagctgtttctgtaccaaattctacgtggtttggcatattgccatagaagaaaggtattgcatcgagacttgaaaccacagaacctcctcattaatgagaaaggagaattaaagctagcagattttggtatggaatgtatgagatatttattagtacttccaggttctaaagtgtaatggttaaaagatcaaccactgtcataatgtgccattgcttttatgtgggtttggaaattttctcggtagcccacagaataagatatttgacagaactttggttggtgatttatgttggttattagcagcaaattctaaaatgcacaggctgttcttgggtgtggacaaagacccctagggctcctgagacccttgtaggaggcctctaaatgtaaatatattaccaaaattgtaccatctgttatttgcctatttcactgtgttaatatttgcaatgatggtcccaaaataataatgcataaaactatacatcaaagtagtggcaccaaaatatatctttttttttttttttttttttttttttgaagacagcattttgctgttaaagcccaggctggagtgcagtggtgtgatcttgactcactgcaacctctgcctcccaggttcaagtgactctcctgcctcagcctcccaagtagctgggattacaggcatgcgccaccatgcctggctaattttgtatttttagcgtgaccaccatgttggtcaggctgatctcgaactcctgacctcaggtggtccactcgcctcggcctcccaaagtgctgagattacaggcatgagccaccatgcccaggccgtcattgtattctttaccactacacttacgtaaagggaaaactgtcagttacacttacatgatgaagcaataaaatttattaattatatttaatttccatccttgactacattt

SEQ ID NO: 70890 - DNA, 1377 bp, Homo sapiens
agtagctggaactacaggcgtccgccatcacgcccggctaacttttttttgtattttttagtagagacggggtttcaccatgttagccaggcgatctcctgacctcacgatccgcccgccttggccttccaaagtgctgggattacaggcatgagccaccgtgcccagcctccatgaacatttttacaaccaatccccttggtaaattattgctttaaacttaagagaatcttttttttttttttttaaatagcattgttgcccaggctggtcttgaactcctgggctcaagtgatccgcctgcctcggtctctcaaaagtgctgggattataggggtgagccaccgcccaagacctaaacttaagagaatcttttaatcagttcgtatgttcaacttacttcaggtttttataaagactgccacagactaaacaattttctttttctgttttgcagtttcactattaaaggatttaaaacatgcaaatatagtaaccttacatgacattgttcacacagataaatccttgactttggtgtttgagtatctggtaagcatctcataaaaattcagtatttaactttactttagaaaaacatagtaaattggacttttagtttgttttttatttttctttaaactgcagctgtgcttagctaaattggactttttaacagcccaagagactttattatttagttatcagtttttcattaaattatgtgtatggtgcatccagtatcttttcttgaaaaacaactaattttgaaaaacactattaagtgaaccagtcacaacattctgaaaatggtgtatcacatagcagagtgctgtgtttttccaggataaagacctgaaacagtacatggatgactgtggaaacatcatgagtatgcacaacgtaaaggtatgttttcttgcgtgtgtaatttttaaattttgtttaaagcataggtgaaccattatataatgaaatgtaccagcctcataactcttcttcagggttttctgtttggccttttaaataggttattgtcctctgaacgtgcaatatttacccagaacttctgtttactacactatagctttcttaggatcagacctttttgtagaaccacttcattcttttgacatttcacattacaactgattgtcctaatatagaatatatgtacaggtgtattctgctttaaaaaaaaaattcaaaataaacacgaatgatgggtgcattctgtgaaaggccttctttaaatagtgaactccccaaataaatggtatttaattgtaaaacaacaacttttcagaactaatgaataaggccagaacatgcaggttttatgaacactatgctggaaataccaatctgtactgtcag

SEQ ID NO: 70891 - DNA, 1048 bp, Homo sapiens
ttgattttaaagctattgatctaattgttaatctaaaataaggtacaaaaagtaaatattctgtctatgtttttatactcttgaggcactctgtagtgttacagaagtatggaagctgtgcatatgaactgaaagtcctgtttactgtaagaaaagccatggctgatcattgtgtgtttttctttgcaagatggaacttaacaatgcttagaaactagaaattcaggtagagctctttattataagatggtattaaatagactcttatgatacttttgatgcgtcctttaaaaatatattttatagggtacatatgcaacagtatataaaggaagaagtaaattgacagagaatttggtggcattaaaagagatccgattggaacatgaagaaggtgcaccctgcacagctataagagaaggtataataattatacagaacattttaaaatcaaagtggtggaataagtgtctattttttataagtaaaaagagctcagatatacaagtaataaatgactggaagatgtaattaaacctttaaaaagcaaatttctaaaacaaatactcaaagggattaattatattagtgtataacttataatgaaatctgaattcattaaaaatcactatcatagacaactatttgtcatagggaaatgttatacattggtacatgaggaacatggtaactataaattaaccagataaactaaataaattaaaaaacagtgtgtaaacatatttatatcatagtaccattttataaagaagattattcagaaaatggcttgaggcaactgattagtaatgtggaggggaaaaatggttccttgtaatttatatctaaattaatgccagaagtttcaaaagttaacatttaggaaaaatacagaagatgatatggagaatgttataatattggggacaattttaagtattataatatcaaacccagtagtataaaagaaaaaattgatttccatgaacttttttttttttttgagagggagtctggctctgttgcccaggctggagtgcagtggcga

SEQ ID NO: 70892 - DNA, 1065 bp, Homo sapiens
atatttttgaacctttgaatgttccaacattgggtttattttaaaacttgatagatattcaaccatttgattataatcagatttttctattcttagtcattctttagagtgggaaagtttcagaagttgaggaagagatgaattgaaactttaagaatatatacaaggctgggcgcggtggcttacgcctgtaatcccagcactttggaaggccaaggcaggcagatcacttgaggtcaggagttcgagaacagcctggccaatgtgttgaaaccctgtctctgctaaaaatgcaaaaatttgccgggcttggtgctgcgtgcctgtaatcccagctgctccggaggctgaggcaggagaatcacttgaacccgcgaggtggaggttgcagtaagccaagattgtgccgctgcactccagcctgggcaacagagtgagacgatgctgtctcaaaaaaaaaaaaaaaaagtaaatactacatttttcattgtttacttttcagtcagaaattggctttggaaaaatggaaacctacatcaaattggaaaagcttggagaggtaagtaaatatctcaaaaatgtaagacacatttttttcttattcgtcattcaaactctgttactccacggtttttgttaacctggaaaaaacgtaagtactgatgtctacaagattatatacttgttctggaaaggtaacagagtttctaggagttagagtcttcaattcttgaaattatcccatcagtttgagaggaaatgaattttttttatagctttgaaatttttattgaagcagaaagtattatgttttcttaataacaaagtaggcatttgtcacttagtctactgccagtctactgtctgtgccaccatgggaaattgcatgagttcagacctgtgaaaaatcagaataaagataaaaacacattttttgaaggttacggaaattcttaagatcttggttttcttgaacttactactagtactactgatttagaaatggcctacctcctatagtaggaaagggcaaagaaaacaatagttaatagggaaggcttaaag

SEQ ID NO: 70893 - DNA, 1022 bp, Homo sapiens
taaatttcttgatacaatgatataggcaagattcttttcaagtttatcccagctcacattgtataattaaataaagtagaaatgccattaacatggcagtaataaatacaattctctttccccatgttgcatacaagatcatataatgtctacttggttagttatttaaactgatcacagagtttgtggtagtgtttgcctaatgttactatatggtataataaatttaaagtaaatttcaagttgaatttaccagtgaaaggactcaaaaattactgaggttgcaaaatttcatttctgtaacacttcgctgtatacttttgcttacagtaaatgtttttgccatgagtatattacatataatcaatgtaggtaactttgcaactgcaataaaactttacaattacttatcactaagaaataatatgttagagcctgtgaatacaaaagccaaatgccttgcctttactattttggattacctttttttttttttaaggatttaaataagcggttatcactgcctgcagacatcagaatacctgatggatatcttgaaaagttgcagataaacagtccaccatttgaccaaccaatgagtcgaaggtctcgtagagcttccttagtaagtttttggtctcctatacctccaccatcaatcagatctgcttgtttgctgcttctgggtgtaaacattttaaattaatttttatacttgactttagaatagctaaattttattatattgccttctcgatttttattattttccattcttaaaggtttattggagtccttaagatgcattcaataggatgcatattggaataggatttaaggtatattttatttttggtaaatgttattaatacatgctaggtagataaatacatactagatatatagatacactagatatgtgctggataaataaacatgtattaatatatactagatatacagagaagtacacaaaccataattgtacagctcaacgaacctttgaaatgttaatatacctg

SEQ ID NO: 70894 - DNA, 1011 bp, Homo sapiens
cagctctgcatctaagctttgtgaacttttgaaagtcatttaacctttcaagtctcagttcccagatctagaaaatgaaagaactggctcattctcagagatattatttccagtttataattttattactcaacccttgataataacttgaatgttaatttttttcataatttgaaagtgtaaaaagatttcatactattttaagacatttgagtcatgttttcatctattaactgcatacctgtggcacccagaatgtaaatgactttttatgctgtgatttttactcgttggccttctatattttacccatagtgataataaattatatattagaatataatgtatctcttttaatgtctcattttttgatatagatattgttcatgaaaatctaaaaatgggatcagatggtgagagtgaccaagcttctgggacatcatctgatgaagtccagtcacctacaggtgtttgtctcagaaatcgtatacatagacggatctcaatggaggtaatcatttaaaaaatacaaatatacttgtgaatatgtgtgttggtatatgttaatacacatacatatcaagtggagtaaatgcccatttaaaaattttcatgaagacacgtgacacttgtaagaaagttacttctttgcattcataaattgcagtctgtgaatatttcctcttttttaatttttatcccaatgtagatatgtaatatagttgttcgcattctgtgaaacattttattttaattttttgcgaaacgttattttaggttatccattaaggagaagtgaattttcaaaaattctggaaatacagaatgatacattagcaatgtcttctttttagaaaatacgattttaatgatatttttgagattcatctggataattagcattttattttctctgtttcaaattttaagaggtataaataaacagcttttttttcttgcattatattataaaagtgggtgtcctttcctttgtggttcactgtacctact

SEQ ID NO: 70895 - DNA, 1076 bp, Homo sapiens
taaaatatgttccacaagaaaagaatgtgttggaatcagctatcaggcactgacaggtgaccaaaaaggtgtagaatctctgtgaaagctgttggtgaaatccatgtgctattacagagagaaaataagcatagtagattatggtagcctatgctactagcaatctttgtaacccaagaggaatcaatgtctcttatgacgtcttgaagtattacttcaaggtcaaggagaaactcaatagatcgcctatttgcccttatttactacctattaaaagttactactgtaataaaataagttttaaaaaacatatacaacttgagaaaacaaatatttttaatctttcaccatttgttaaaaacaaagcatgttttatgatagttaataccaaaatattctagaaaatatgcaattggtctaaaatattagctaaaacatacgttcattttctttgactcatatcttttctttaggaaaagaggattgtcttgtagtcaaatactaaaaatatgtcccagaaaccaaccactaagatatatactgtgtttattttattcctgatcatcattggcaaacacattggcaagacccttctatcctaagagtaggcacactgcgcttcccaccaaaaattcaatgggggggggtcccaccaaaaattcaatgagggggtctaaaagagaattaaggattttgctctgtgtatctagaataggtcctctggcaagaggaacaacagtaaaatcatgatgtttgagatttgacccaaatgtacaattttcccctcctacatataattctatccaaattattatattaaatttcctactgagcccatccctctctcctccccaccatgacaaaaacaaaacaaggccaggcgtggtggctcacacctgtaatcccagcactttgggaggtcgaggcaggcagatcacttgaggtcaggagttcaagactagcctggtcaacatggtgaaaccccaaccccatccctactaaaaataataaaaaacttagctgggcatggtggcccatgcctgtaatcccagctgctcaggaggctgaggcaggag

SEQ ID NO: 70896 - DNA, 1050 bp, Homo sapiens
tttcttaggaaattgaagactatataacttttgtttggttactaactggaatatttccctctcactccaacattacgatacctggtctcaaaccctgatgaattgttctattccacatatccttccatttttcactagttcttaaagaagaatgcattttataatattatcttgattgttaaataactattaattttttttattcttataacccaagttaatacagcttaaaagtgcataggaagtctgtgaaatttctgtttgtggcttcatcagtttcataatgtttcatgcatttgacagtgctttttacaacataaagtagtagtatccagatgttaaaataaaaagagcttgttaagtgtgttaaatacaaaatcctggtgaaatttctagaggaaggctacatattcaaatctgaaatagccctagggatgtcatagtagtaactgggaaggaacttacgtgactggctttcagtgtgtcatgatgtgcagagtatctggcagatcttccttacctgtgcctgaaattctgctgttagagatttgtggcagtggctggaaagcatggacacccttaccccttccactagaatgcacatacttatgttttgagagaggaaaaggtatagtggagtgggctctggactttttaaagtcataggtttggattttggatacacttaaacacttcctagttgatgactggctaagccgtttattctacccaggcttcagttttcttatttcctttactcagaagggtcattatttgctcaaggttacccagctccagaaccagtactttagaacccaggtttcttcacttcagagtctataacaatgctactgttctgcaaggaccctttcattcatttgttaaggttttccttgataacatctaccttttttttttttttttgagacagtctcgctctgctgcccaggctggagtgcagtggcacaatgttggctcactgcaacctccacctcctgggttcaagtgattctcctgcctcagcctcctgagcagctgggattacaggca

SEQ ID NO: 70897 - DNA, 1616 bp, Homo sapiens
aagatgtctctagtgtaaagtagtgtaaagtcttacagaaacaaagggtagatgagagtggcaatagctcagtacaacttaaatatctagtgtgtttaaacaaatggcatgagttactgactgtcaaggtagagctataaaggttgactatcagaagtaaagaatagcatttagagtaaccctacaattaacaggtttcttaattggaatgaacttcatggtttactttctcctttgcttgggaagtgcatatattatctcatctaatccacatcaaaacctccatttctgcctatgatggagtaacttgtaacagactaaaactgctgaaaactagaaatgctaggggaaaaaatcattttgaaggcattgtaaagcttctcagtgaatcaacacttgaagagtcaagattcaggagagaagggagacagacacactctgtgctggttttcctcttgatccattttccagctcttaagctattgggggtaagaagataaaagctgagcaaggcataagagatgagcaaaaaacgactgaggaagttgaatggagctttcaatagtttgttgtggtggtgttctggccctagtgaagagccacaccatagagtgaggacaaatcagaggcctacctatctttgtagtgtctgaaactcagtctcaagtcagctcagtcccaattggattgcatcagtctgctcctacagagactgttaaaaaaaataaaaattaaatcctttctggaggaaggtaacatcatctggaggctctacgttttttccgtatacatatgcatatgataactcacaatgtcttacatacaataaaaaattactaagcatacaaaaagatcaagagaagaaaattgacaagagaaacagattgatagattgttcagactttggagttaaaagcaggggctttaaaatactgtattcggttcatgaaaatagatgctgaggtggagaatttcactagagaactggcatctgcaggaaggagtcaaatggaaattctagagctgaaaaatatagtaactaaaactaagagcacaacagatgggtttaactgcagattagacacagctgaaaagaggatttgtgaactggaggatacgttagtagaaaacattaggcataaactcgactttaaactgagctaaggaatagaaacttttcaatatctcaccaaagtatgtctcttattttagagcatgtgggtgaaaagagtccttattaaagtgcagtcgcaactcttgctattttaatgtgtatttagtattttttggtatttttattttagtggatttttaaaaaattattaaaaaacattatttaagagagcatcttattctgtcactcaggctggagtgcagtggcacatttgtagctcactgcagcctcaaattcatgggctcaaagtgatcctcccaccccagtctcctgagtagctgggcatacaggcagatgccaccatgcctggctaattttctttgtttttttcagtagagacaaattctcgctgttttccaggctggtcttaacctcctgaccccaagagatcctcctgccttggcctcccaatatgccaggattacaagcatgagctactatg

SEQ ID NO: 70898 - DNA, 1533 bp, Homo sapiens
tgagttttcatagttcctacgacttccctttgttcctctcagctctggtattgacagttgctttttgcatttactatgtctgtgatacatgtctgtcctcctttttgccttttcagttctccaattttcctggttagcaacttttattaaattgtctgttaaaattacaggtgtagtttctgtctcttgactgaaccctgcctaatacactggtcagaatactaggcctttgccagccaaagtccaggagatcacattaatagctactgagcctctgcaatgtgcagagcctttccctgttcttggtatcctgttggatgtcttctgtggtcccagagctgcctgggtatacgtcattatcacactgcattgttgtctgcttttctgtagtgtttctcatcttgaggccagtgctgatgtcttttgtctctctgtccttagttcctaacacaggattcatataaactaggtgagtcatgataaaattacctgatgaagggagggatcttattttgataatttttggcatctaaaattcttcagaaaatgagatgtttaaaccaaatcttaacctggtatcaaagattatgtgataccctccagaagtcacctacctgaggcttgattaggtttttctagttcagttgttaatgagattgaatatgcctcattctcactggcatatcttaccagctcttgtaaaactgttccagggaagaatgtaaatccatctatcaagatacctttcaaatgatcaggcctcttcccgtcaacccttccacctccattacgcttgtagagtgaaccctgtttccttcaatgtactttcttcgttagtacctaaacgtatgctggatacagggtcatgctgagagtttccaagacttctagatattttgattgcagtatgctttcctctccattatttagtggggtcaccttggcctgtataaatcccacttccagatcccttcccccatcatagtgcatgttataggctcttgtgtcatttctgtcttaataccttttagtgtaggttaccttcccctaagtataattaaacaaatctataattactatgtctgttcctgctttatttcctttatagtggagatttgttgactatagatagcttgaatgtctcggtttactttatagggatttttagaggaaaaagtaaatatttctttgaaatttctatgtacttatcaagggatatagataatttgttttctgtctttcagaattttgatggggatttggtttaaactttatctgctctttgagttttatagtataaatctttttaagaaattgtgtttatttttgtttactcttgaattttaatacatcatagtatgctaattaatatagtgtttgtctccaaatgccaaaatgttatgaaattgtgaaaattgtttagctatattctttttcttgggaatatgataggaattgctacctacttgaaattaggcatggccatgtgacctgatttagccaatgaaatctgagcaaaagtaatgtgtaata

SEQ ID NO: 70899 - DNA, 1156 bp, Homo sapiens
aaagtgtcaaaatacttcattttctagtgaatattagacgaaaatgtggaacacttcaacaattggaatattaaaaggaggatatttcctacttagatttattttacttattagggaactgaaaatgccgtctaagaatgaggggcaacaagattggcctgtgctcaaattttaggaggcacggtgcccagagagggctccagagctcttttgctggctgcctcttctggagcagctgactggccagctgcagagcacattgatctggtcatgattgctttcatcctggagtagagcaagttcacacaatttaaatcaagagccacattagaagctcctgacctcaggataacctctcatttcctacctttgaaagagggaacaagagggaacagttcagtcacttcctaacatctagccacaaaaatacatgggaagatatagccacatctaaagattgtgatctcctgattttctttataacttaggtagattcagaataccatcttccagttttcccttggaatacaaggaacattagtcttaatctactgttctgtgttgaatagagaaataattccttcccttccacacactcttttttttttcctattgaacttttcctaggccattcatatagatgcagcctagatgaaatagacttggactgttcgtaaactcacccttttcttgaaatatcatactgcagtgtgacatttcttacctgtgttatatggcagaccagtgttttttgatgtatacgtttttaaatgcatgctttcttttggtaaatttaggcctcccattattctctgaatatccctaccagtcactataagggatttttttttttttttttaagtagagatgaggacttgctgtgttgtccaggctggtcttgaactctgggctcaagtgatcctcctgctttggcctcccaaagtgctgggattataggaatgagccactgtgcccagctcattaatataaaagttttactgaagtttattttctagagatttcaactttgcttctgctgtgactcacatgccaggataggtaatctcacatatggaacactgtaagttactggattgataagagggactgagaattgtgagcagttctcacttcttaagttgtaattgtactcttt

SEQ ID NO: 70900 - DNA, 1282 bp, Homo sapiens
taatgaagcaaagagagaatctaggctcataaagccatcctttggttaactagaatccatttaattcacctaatggaaaattcagatagcccaaacaatattctgtttgtcagaattctggttaattcaaatattactgttttaaaatgcttttctatatcctcataggaaatctttcaacattttttaaaggctatcatttgtaatgtatatgcatattttaccctctttttcttcactttgtgttaatttctttattttttctatttataatatactgaggtttcctaaataagtaaaattagaagaatagagagttctgcaaataaaaatgaaaacctctgaaaaaaagtggctgtggagtattttttttcagttgattattcaggtacaccttttcttactgttttggtgaaaatctacaatttggcctttaccttagatcttataaagatgatagagtatgcttggaaattggctcattgttatgctcccttcctgttaggattggtatgtgaacaatttctaattttccacttagcaagtaatgtgatggaggattagagtgcctcccacccctcaccaaatcacaaaaaaagcttttctgaagataatggtagttttatagttttgagatcaattgattcggccctaggaagactctattttgaggccttttcaatatctttgaaattaactggccatataagagggagatttttttccttcacagctcttcttcccccaaagaaaacctttaccagaagattgaagaatgctggcatttttaatatgttgccaagtcttctactgttgccatggaaagttggccactacttagtagaatttgtcttataaaggctttaatagtgttagtttttaaaagatgttataactattattgtcataaattacagaatgacaaaatagcatttgtccagttcagatgcctcttggagagaaagactagaaagttgtacacacacacacacacacacacaaacacacactcactcacacactgtctctctctctccgtcccccctctttttaacatgataagcaaattcatatttaccttgtgccaagtatgctaagaacattcttaatgaaacctacatgaatatttagaaagtaggtgattttgtgagatttgcagtttaaaaacataagaggcaatacataatactatttgatcatgattgaaaaatatgtcatgtaataattcagttatttttgaagggaaatgaaatttcattctttttctttttattttttttga

SEQ ID NO: 70901 - DNA, 1027 bp, Homo sapiens
aagtgaaggcaaagtgattaaaactttctacctgggtgcagtggctcacgtctgtaatcccagcactttgggaggctgaggtgggcagatcacctgagcccaggtgtttaagacaagcctgggcaacatggcaaaatgccatctctttaaaaagtgttttaaaaaattggccagctgtggtggcacatgcctgtagtcctggctactcctctggaaggtaaagtctgcagtgagctgtgattgtgccgctgctccccagccagcgtgacagagttagagaccctatctcaaaacaaagcaaaaaccaagaaaccttcctgtcgttccatcttatttttccctccctttttttttgttctacttggagcgttttagttttaccgggagttggcagttttcttaattttatgtataattgtcttttgtttcaattattttatgttttttcctttagtggatgtttttgtctgactcttttagcttgtttcttatcagtgatactgtttcctatctgtatggtctcagttattagttttagaaaattatttttaaaatgtgagaatgtataatcatataaaaaatgtacaatgtacgttctctaacacagtggttactattttcaaatattatcttggcttttctccaatatgttttgtatttttgtttaagatcctttttatgttttttttaaggtaccaaataattgtggctgttacttttagtgtttgcaaaagatgcttaaccatttcatgttgtttgataattattacttctcatttttcattattttgttttaaaaataatttcaacttttatttttgattcagggcatacaagtgcaggttcgttacatgggtatattgcgtgatgctgaggtctggggtatggatgagcctgtcactctggtagtgagcatagtatgtgataggtagtttttcagcccatgcccccatttgccaaccccttctagtcatctccagtgtctgttgttaacatctttttttgttttttgagacagagtctcact

SEQ ID NO: 70902 - DNA, 1525 bp, Homo sapiens
cgaggaggcggcggtcgcggcgcctgcagctccttggagacgctggcgctgtgcgcgggtggggagcgcggaggaggaggaggagcccgcgcgtgggagcgggtagagacaaagatcagggcagcctcctgctggcgggtcacaccccggagtgttggtcaagagcggaggtagagggaaggtgggaaacccagcaaaccgatggggaggggaaaatggggggaggagggtgcctagtgctgtctccgtcgcagttgcttttctcagcatttttgtgcccgatgctatgcccgatgcttttgctccccaactcagctggatagctccagattccctccctcctgtcacccccacactgccacattgactctcctgtggtttttccctcgttctccccctacttttcacccactccttttcgggtaagcagtattttgctttcagcttggggaacatttgttaatgacaggatgtctgagcttgttctgaccctgaactgccttgaacttctctctcttcctcccaccctttccttttctgggatctataatgtcacatggccgttaacaattagcttttcttttgcaaaagtggcaaaaagcgtttagctgaaatctgtggctctcgcctcctttacatgaatatgtccaccaaagacacctcgttggtcatgttctatcacctcttcgtcaaattgacatcaggtcctaacaggtcactttcaagatacagaagaggcaaattttgttttgagacttggccattcctagggtcagcaaagtgtattcctggcagccagaccttcagtcacttatcaggaaatgcttgacctaaagacagacaattctttccccaaactttgctgtttcttttttgagtctttgttgaaagatttcttttaaaaggcgttcgtgtgagaagatcacagcaacaaatctggcttgttctgttttagacttactttcttaactcttgggcagaagaaaatgaatgagatttgaagacctttgataccttgggtagacaaagcttgccttgaaactagaaataagacgaaactagattttaaggggaaaaaatttgctagtggtaatataattggttttgtttcatttttttatgagtctgaggagttgacattaaacgttgggatgttgctttgttaatgaagtcatttcaatttttgcaactcttaacatctgcatgcttccataaacagtgggttggaacaaaagaaaatgtgactaagggatattccttaaattcttttttatgttatgagagagaatattggaatataaagaatgttactttatctggtaaaccatctcataggccagaagcactaacagtttgaatggttggcttaaaaaaaaacgggagtctttgaatttaagcttatgtaaaattactatgcaaatataggttattatttatttttacagtgaaaataaaacactattgaagtataaatggaaagaaaataaaagcaaagcctgtttaatatagagacattaatgttgat

SEQ ID NO: 70903 - DNA, 1028 bp, Homo sapiens
ttaaacttgaatgaattaaaattaaacgaaattaaaaattcagttgcactaatcacatttcaaaagcttggtagctgcaggtttctagtggctatagggaacgataatgaacagcacaaatatatagcacgtttccatcatcacagcaagctttactggataatactgcatcaaattatcaagctttgacttgcataagaaaaatattttttcttttcagttgagttcttttccatgttacatttttattacattcagttttcagaaaaaatatgcagtaaaatctgaaattacacattttttttttcactgtgctacttgcagcctattgaagacaaaggagaattcagtgttccaagctgttatgggaatattaaaaatgacaacggtggttctagtcttacctttgagcatcctttggatgatgtaaatgtggttgatttgaaatggatccacgactttgtattaaaatctctggaagttttatatcaagtggaaaaatgggaaacactagtatctcttgccattcagttcaatacagtttcacagtaagtactgctgtaagggcaattaaaagtagaagacttcattgaaaaaaaaaaaagtcttttaactaatgttttctttttaatgtattctttacccctgtctagtgagaggtatacagaacaagtgacaccacttctggtgtatgcacagcgccagcttctgctgagaatacagaagttcaagggcccagatattacccaacaaccttgtgcaaggtatgaggctgaatatggagagaaggtaagtttaagttagttctattattcatgctgttgtgatttctaattagtccacatataaaatacaaagatttagaagtcagataaatcttattatttctgctttagtatttccacttactggcatttatcattcaaatcaacaaacattattgagagcctgcagtcaaggcaaacaggaactaagtccctgtccacaagaagttcatatcaggccaagactaacttagccataaagca

SEQ ID NO: 70904 - DNA, 1037 bp, Homo sapiens
aggtttttcttattctgtgaagaatctcaatggtagttcaataggaatagcagtgaatctctaaattgctttgggcaatatgactgttttaatgatattgattcttcctatccatgaacatggaatgtttttccatttgtttgtgtcatctctgatttctttgagcagtggtttgtggttcttttagagacctttcacttccatatttagctgtattcctaaatattttattctttttgtaaaatgcatttttaaaaagttcaatctgtaagttagataagagaaataaaaggaaaagagatattgataggcaaaaacaaagatggaaaaaggttgttttgcacatttttttcttctttttatcttatttatgaatgcttttggtatttggccttttgctattttccttattctgtttcaagtcccataatagcttccatttccataatcaatatagattattctattagttttactatggttaagttgtagaccttttaactagagcacaggagaagatttgggaatgtcatgacttctttgcttttaactgataagccctggattagtcagttctcatgctgctcataaagacatacctgggactggataatttataaacaaaaagaggtttaatgaattcacagttccagatggctggagaggccacacaatcacggaagaaggcaaaggaggagcaaaggcacatcttacatggcggcaagctggagagcatgtgcaggggaactgccctttataaaccatcagatatcgtgagacttattcactatcatgagaacaacatgggaaaatccaccccgatgattcagttacctcccactgggtccctcccaccacatgtggggattatggaagctacaattcaagatgagatttgggtggggatacagccaaaccatatcattctgcccctgacccctcccaaatctcatgtcctcacatttcaaaaccaatcatgccttcccaacagtcccccaaagttttaacttatttcagaattaactcaaaagtccaca

SEQ ID NO: 70905 - DNA, 1032 bp, Homo sapiens
gctgctgccataaacaataatagttaacagctagcacctgcttttgtgagactgcaagaaatccagtggggctaacagcaaaggaaaaggcaaaagctgaggttagaaaggttggcagaaattagataataaactctcttagagggaaggatagagatctagttttatctggagaactgaggggagctagttaaaaggatttaaagaaagaaagtgaaatgatcacattggcattcttttcacttgatcttagcccaaaggccgagaagtgttatatttgcgtgtttttgaaaacctttgtcagctgcgtgggaaacagattgaaaggagaccaaatggaagtaggagagtggccactgctttcttgtgtcttaaagtagagatgatgaaagcctggacttgggtggtcagcatagaggaggggacagatgtgaaggagagacagaggatgtccacaggactgtgatccacactggctggaggtggcggatgggtgaggaagggaggagttcaagtcgccttggtttctggcttgggtagccagatggatgatgatgccttcacccagacaggaaaactggagaggggcaggttagaggaaaaggtcgctttggaattacttgcttggatttagttcatccaaacttggatgacaatgagtagagctatccagtgtatggttggatatactaatgcggcactcaggagagagcagattggagatttgtattttagtcatcaatgtattggtggtggttgaagtcaagggtttggatgaggtcacccagggagagttacatggagcataaacttgaggatggcgtcctggatagcaccaacatttaggaagctgcgtcagtcaaaataggcttcagctatacagcagtaacaaacaagtgtcattgctttaacacaatggaaagtctgtttcctgtgcatgctactgtgttcagtgaggttgaatcctgggctgctcatcatggtggaatctccagcttggtgcaagcttccgtgggttgtttccaagtcaga

SEQ ID NO: 70906 - DNA, 1036 bp, Homo sapiens
acaagttatttccctaggcgtcacttccttatctataaattggtgaaagctatttctccgataggattacattagaagcaatatttaacacatttagtatagtgccagtacaatgccagtggtaagcattcaatacattgtggtcatctttatttttccagccttaaaataatgtgaaatgaatcatttgttcatttgacctttaacaactcccttcattagtaactcttacttagcctatctaaatgtttgtaaatttcaaagagtaaatgaccattttaatatgtatctttttttggtaagtatttgtggcagataatatatatattcttgatattatttctcaaccatcctttttaaattaaactatttattttgagataattgtagagattcacatgcagtcacaagaaataatacagttactgtgtatcctttactcagtttcttccaatggtaacatcttgcaaaactgctgcatatcacacccaaatattgacagtgatacaatcaggatagagaacatttccatcacagcaaggatcccctctgttgtcctttagtaattccaccccctccttaactcctggcaaccaccaatctgttctccatattggcagttttgtcatttcaagaatgttgcataaaaggaattttatagtatgtaacattttgagattggcctttttcattcagctaaattctgtggagagccattaaactatccttttgatgaacaaaaaaaaattaagaatattatcacattttattttggcaacagaattatcattagcccaaagtgctttgtgcggtatctagcacacagtaaatagtgaatgttcagtggcactcagcgaaagtgctcctcttctgcctactactacccttcctcctttttcctcttctctccttcctactacttttttcttgccctttgcttctctacatcatcttattaatattaactgacaaaggctaattgtttgagttagaaatactaaaaagagttaaatgaaataatttatgtgcaatttct

SEQ ID NO: 70907 - DNA, 1062 bp, Homo sapiens
gtaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaatagtatcctttaaaaaaaaaaaacacacacacacacacacaaaccgcttattaggttaaacaaccactgtcaatgaaacttttgcatgtgcctcatactgagtaatgtgttttgcattgctaccaaggatagataacgtaaaatagtaatttacaaaacaatatatcatatgaatgcactctgattttatctgttgcgttcatttaaaaaaaatttagttacaacccacttcatttgaaaacactgctattaaaaaaagtatattctgtctacaccatagaattagttatcaaaaatttcttattgaaccaaatggaataaggttggtagttgtggaaataattccaaaaggttttggaatgagtttttgcatctacatttgggtatttgtggatctgaactgaaaattaaagacagaacttgaaggcagaagcaagttggggaggagataaaaaattgcccaatatctccatcttactaatgtactctccatatcttccttcctctctgtgtgtgtgatgaaaattacatttcctaaacagacatagtaaagttacctagattgaacttttctaagctttttatgtttctgattgacaccttccctgtcttggtgagctcctcaatgtggataaaataaaatgagggagtgaagactgtaaactagggtttctgaaccctgtgctattgactttttggggcagaaaatttgttgtggacctttcctgtatgttgtaccacgtggaggtttattggtcttcacccgttaggtaccaatagcctctagttgtgacaacccaaaacgtttccagaattgcctgaatcactcccagtagagaaccactgctgtgaccacagtgctcctatcaccttttatgtgaaaatgttttatgtaattggtatgttagaaattttc

SEQ ID NO: 70908 - DNA, 1072 bp, Homo sapiens
atctgatttttatcaacaccaaagtattctactttctgataaaaaaatcaaagctttaaaatgtgactggttcaggaacaaaaatattaaaagttttatatgacttactattcttgcatgtatataacaagaaggacaaattttcttactgaattaaatttacctccttatcattccttgattttgcagtaaaacaaattactttggtactctgttaatcaaactcatggtgaagtgactacatttttgaaggactttccagatgtgtaatagggaaaatattttaaagagagcgacaagtatatgaagttgctgttctctatttttagattttcattatgtttagagcttaattttccctcttactatataagagaaaggtagcaatttgtagtaagattattttttggttgacttttgttttaagttttactaggagttggcatttactgatgtgctacttaatagtctaacaacaaaactgatgtagctatgagatagtgttgtatgacttttggaaattggtcttacagttttcttgcatgagcagatgtgcactgaaagccttcatacagtcttattcttaataaggctttgatcacttccatggaggttaattactgaagaacaaggagttcccagccttagcaacttggggtccacatagtatagattccaagaatggggttaatgtgagacaccagagagattagttttttgtttcttgtcctttaacttacgttcctcactttctcatgatttctaaaactacaagagaaataaaaaagaactagattacccacccacattatgtttcagtccttttttttctatattctaaggagaaaagtagtggtaaacaggaagaagtcaaggaaagggaaatggtttttctcgctatggtaatatctaggtaggaatgatttgatttgcatcatgtatcataataaaattacagtctatgctctgtttacaaaatacctgaaagttatacagaacattcaaaagttaatgcagttagggattctgagtgtctaattaacctttctccattgcttttactcacagattt

SEQ ID NO: 70909 - DNA, 1065 bp, Homo sapiens
tttataatcgcaattcttataatagtctagtgctatagatgttcatggattgtttgatgctccataactcctcatttagataactttttagtaacagcatcttccagtggcgacaaaatagttgtctcaagttgcaaatgtaaacctgttccacttttagagcttgctgaaggggtaagtgattttttttttttttaaacttttaaaaatcttagttttgcttgactggcaattgcttattgtggtgcttgcgactaaatataaaggtttttaaaagcattatttttaacttaagctcaaaataatatagtaacacttaaaaatgagatatgtgtacttactaaagtatttttaggtaaaatagttttgaatataggggaacaattgaagacttgaattttgttgactaggcacttcatttctccattttccctcagtgggagaggatctctgttgctgctattttaggacgatatcccacataggttactaggttgacctgagcatataaactctaatgacacagcactgctttactgatcttgggctcaggaccatcaggaacagactcacagctgatggtagctctctgcttcagattctgtccacctgtactgaggggcctgtctgagcctcccccatactctccttaaacaggttggctttgtcaaaatgagcttaggtcccagggcgtttaaatgaagctctcactacgtactgttgccttatccttttttttttttcttttgagatggagtctcgctctgttgcccaggctggagtgcaatggtgcaatcttagctcactgcaacctccgcctccccagttcaagcgattctcctgcctcagcctctcaagtggcagggattacaggtgcccaccaccacgcctggctaatttttgtatttttagtagagacggggtttcaccatgttggccaggctggtcttgaactcctgacctcatgatccgcccgcctcagcctcccaaagtgctgggattacaggcatgagccaccacacccagcctatccttttgttttataagttaatccctctgattaag

SEQ ID NO: 70910 - DNA, 1059 bp, Homo sapiens
atggaacaatttactgagagcccagtaagccattcttcttttctactatacacaccagtaaagagctcagcttcagcagatcaccatccgtatttctttattagcttcctaaggatcaagcatgtgaactgtgttcctcttagctttttggccaagactgtacaactaagaacaaagtaacagctgctcccctgtgaaaggtcatagtcctcatgaggcctaagcaggtcaataaatggaaagtggatacttaggccctcctcaaccatgaggccagagcccctgtttgtggcgtaatagacagttctgctacattcactgtcagagtaataattaaagaaataggtgctgcttctataagatgcagaatgtacctattggaagtgaatagaaaagtaagatggaatgtttagcagttctctatatgccattttattagaaatgtctctaagtcaaattctgaaattatgctttaaacaaatatttgggatatgtgtgctctttgaccagtttgaagtgttaataactctggttttggtatatagttacttatataagctaatatacctgtacacactaacatttctacacatactttgttctcctttccaaaggctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaaggtgagacattttcttttcagcattttttattttattaaataaatctaactcagaatatggaaattatatgtggtcaattaaacagtatagttttgtttcataattacataatgattttacatgtaatgtataataattttagtacaaagccatttgatatttagttttaaaactttttttcttttttttttctccttatatatctctctttttaaaagtattttaaaagacattttaatttag

SEQ ID NO: 70911 - DNA, 2136 bp, Homo sapiens
acagtttcatatgcaactggtatgtatggcaaattttattttaatattttaaatgaaagtagagttgtgtgaatttttaaaaatccatgaaaggtaatatattttagttgttttgtttagtttctaagataaatagggagttttatagactaaataagtaaaatagattttaactggtcacctcctttttaacctctgagatacttaagccttcttttttccatggctttcttcctgataagtaagcaaaaagcattttaaatgtgcaaatataaattttccaaatatactaatttcaccaacgatcttccatttatattaacaaactagtaagttgttaagtacaagaaatatcattcacctagttaattgaacatgagagaaatgatagctgaaagtatattaaacatagcctgccaaataaatgtgaaatatcaataatttaaaaagcattttcctgtttttctagaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattacttttacccagtgtggtttatagcatacatttgtactgaagcatatagggatgttaatgtgatcttttcctgacagattatgaaagcattatgacttgtaacaagtttccttgtatatcactaacaggtttagaagacataaatattagtgtgttttgcctacatggtgtatttaaatctattaatattttcctgttgcttttttaaaaaaataaatacacataatgtatattaaaagaggtgggatgaaataattttagtaattatgtg

SEQ ID NO: 70912 - DNA, 1023 bp, Homo sapiens
tgatggttgtatccagagggttttattcttcaaggttgattggttgttctagcacaaaggctacttttcattcactcccctctcctgtggggggcagactgttgagtggagactatggaagaaaagaaagtgtggttgtccaccagggagataggcacagttcctctcaaaagtaatctcttaccttaaatggcatagaggtgaaggtaagaaaatctcttaccttaaatgccatagaggtgaaggatttggtgatcctagagcagcaaagatgggtcaaatgaaagtacagtccagtagcattatgtacactcatattgttgccacaataataaaaagtaaaaaaaaaaaatggagtgaatgaattgaatctccgttttctcttagttcatgctagctgagtccttgacaatgctaaactcttagaattatgaatgttcagtgcaagtgaagagttggaatgtgatataaaggcaaaagggattgttaaatttcctgtgtctcccctttttccaaagcaccatgaagaaacaggtgcatgacacggggctctttgatgactatgtaagtgcaattttcactcccgtattcaggttgccaacaatcgtttacagcaggacgggatcttaattcctaacaggtttgcatgtattcaaagactgactttgaatgtaatttatacaggttggagagatttggaggaacagagaatctgatgccaaatgtaagaataagctttatttggaaatgctcatccatctgtttagtactgactataaaaccacaatgagtttaaacaatgagatgtgcaaaaaagcaccttgtattcacaagcattttgtctagcatgtgatcaaataaacataatctactttgctgattgttgtcaggttaaaatgctgtaccaagtgtgggagggctttgaaaactgtaggtgggcagtttgctatcaaggctagagagagactctaaagaaaatgtttcacaaagataaggtattcattcaacaaccagttatttaat

SEQ ID NO: 70913 - DNA, 1705 bp, Homo sapiens
taaattgaccattgagggggttcccaagggttctccttcgttttgttatcaaacgttaggtttaggattcttgcgggtggtgggatccaaagccagagacggtttcaacaaaaatgcaagcgcgaatttgtcttgcgtctgaacgcactgttcaaattaaacaatttagacatgccccaactatgacactaagaagtgaatggtatagtacacttttgtcacaaattcaagggtaatttaagtgcccgattgtagaggtctggcttcccctgggtttctggaacaaaagaagcgttcgcgaggagaggggtaactccccgccctccccctcccaaagtaaatcaaatcaaggaatatgagtgcctgcagacaagcctcgcttcttttcttccccttcagggctagcgtttggggaaggcaaggctgcggctactcttggagcttcagtgtcccgggaggaagaaaggcccagccaagggtcctcacactggcgtggaattcggcgcgttcgtaggcgatcgaccccagagacgaaagctgcttctcaagctgggggagggagaggaaacggcgcacaaaagcagtacgacctgtcccttatcggcgtctaaggggaagggtggagaaaacgaaaacagaagcgggccgggagcctcggctcccgccccagcgccttttaaactgcgtttctacctcctctcgctcagcgcggcggctaatggaacccgcgcgagccgtctcgccaatcaccgccgcgcttcctcccgtcgcccgccaatggcggcgcgcgttcttggggcgtgggcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcagggtaaggacgcggggccggggctacaaaggcgggcgtttggcggttgccgcgcgcgctcgccgccgtttgcagcccctccctcccgggcgccccctcgggcctcccaggtgcggggctgtccctgcgccccctcgcgtcgccccttccccgcggggctgcaggcgccggagcggagaggccagaagttggggccgcggggttcgcgttctttgacgtgtgggtctgggaggtgtggagttgcgttggcggcggttgttttgcacgcagtcgacgccgcttccctggaccaccagccgcctgcagcgggcgtttagacggggacttccgtgccctttcgaaagc

SEQ ID NO: 70914 - DNA, 1026 bp, Homo sapiens
acttttgcgtgtggagggctttttgaaccgtttatgttttctagtttgttttaatttttcccagcaacaggccatcttttggcggaacaggttcatgccgaattaaaaggagcattttaaactatatttttaggcgcctattataattttttagtttttatttatttatttttttagatggagtgtcgcacttgttgcccaggctggagtgcaatggcgagatctcggctcaccgcaacctccacctcccgggttcaagcgattctcctgcctcagcctcccgagtagctgggattacaggcatgcgccgccacgcccggctgatttgtgtattttttagtagagacggggtttctccaagttggtcaggctggtctcgaactcctgacctcaggtggtcctcccgcctcggcctcacaaagtgctgggataacaggcgtgagccaccgggcccggccctgcaaacaaatatttgaaaattgcagtttggattgcgttttccccacatattggtaaattttgcttgaggaaacgaaagacttaggattcaggaaaaatttatttcatgacattctggtgcatcagtattgcaatttggaatgtctgatcctggttaaatctcaaatcggctccagcaaagcatgttttgtttcagaatagtttgcttttttacctgtggattttaatatgctttttgtgggtttgcttatgcctgccgagttaccaggcttcaaatcgtaataggatgaagctaaaactagtaattggtgtaacataaaatgccttgtaagagacagtgaatgtggtgtttggagttgttgggaatgatcactagtttaaaccgaaattattccttccttcaaattttactttagtttttaaggaacctgtctaatgtgttttcccggctactcaggcagaaatgaaagacaaatgtaatagacacatgtaaatttaattgaaaatcttattctcggcttcagagaagttgaaagttttaccaaacgtcttcagtccggtgtctgg

SEQ ID NO: 70915 - DNA, 1039 bp, Homo sapiens
aggtgggaggatcgcttcagcctgggaggtgggggttgcagtgaactgagatggagccactgtactccagcccgggtgacatagctagaccctgtatcattaaaaaaaaaaaaaaaaaggttatttaaaagaaaatgttacccaaagtcagttttacttttagttgctcttttgcatttttgatgccattactatctcttttagataggtaatccaaaatggactattttaacaacaatgtctttaagttacttgcttggctgtgcggtttgtatgattacagttcaacttagaaagtgttctccaataatgagttgctcttaatttaatggaattgctaaggcctaatattactataaaccaatttggtagtgagtttgcatgtttatgttatacaggttattatctagtaagtgaacactttaattcatatggaaatgattactggactttgtttacagaaagccacaaaaaaaactgataaacccagacaagaagataaagatgatctagatgtaacagagctcactaatgaagatcttttggatcagcttgtgaaatacggagtgaatcctggtcctattgtgggtaagttgataaaatttcaaatacagtatcttttctctgaagcaggaccccaaattattttctcctttttgtttagcagtttaggttccaaggactggtttgtcattaatcatttgttatcagcagaacctgtgtttctttgactgtaaatgagtgaaataaaatgagaggattgaattagataatctccaaaattacctctattgttgagattgttttatatggtgcttatatcgtactttttttttttttttttggttttgttttgttttttgtttttttgagacggagtcttgctctgtcgcccaggctgtagtgcagtgacgcgatctcggctccctgcaagctctgcctcccgggttcatgccattctcctgcctcagcctcctgagtagctgggactacaggcgcccgctgccacgcctggctaattttttgtatttttcagtag

SEQ ID NO: 70916 - DNA, 5501 bp, Homo sapiens
catcagccaccacgtcctttttttttttttttttttttttaagacagcatcttacttcctctcccagctggacagtggtgcgatctcagctcactgcaacctctgccttccaatttcaagtgattctcctgtctcagcctcccaagtagctgggatcacaggcgtgtgccaccatgcccggctaatttttgtatttttagtagagatagtttccctgtgttggccaggctggtctcgaactcctgacctcaagtaatgtacccgcctcagcctcccaaagtggtgggtttacagtcgtgagccactatgtctggccgcattatatggtatttttttttttaagaacttgagtttagaaaaataaagggtgaaaatagcttaaaatgttgctgaagatagtgtctgagctgcatcctaaatgaaacaatacaggtactaaagcaagttctgccttaatccaggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggtaaaattttaaatgatgttaatcaaatgtatggaattttttcacactcaaaattcagtgaccatgaagaaagtaaaatttaaaacaatattggcaagatacacaaattttattcgtgtcattagagtaattctgtaatttgatttaaatactttttattgaaaattctaagaagcaacatagtacaaattcataattttccatcacctgaaattgcaagttaactttgtcttttttgctacaaatctcatttttctgagagaataaagtattacaagtaaaggcaaagtttctcgtacttacctgtacctatcacctccacagaagtaactactattattaattcaatgcctgtctttcaagttttatatttcacatacacatctgtctaatacatggtattattttatactttaagaataaaaaatttatataaacagtatgctaaatcttatcacttgctttttcttactccattatttttgaaatctaatcctgttaattacatatctgtttattcttcataattaatacatagtggtagcatttaaatatggcatattttctctgttctctattgataggcatttaaattgttcgcagtttttgttaatctgacctcagggcaactttaaagcaaatattttgactatatttttagtagactgtatagtatcttaaaatttgatcatgatgtttaaatattttttaaggatagtatgtgaaataaatgtcctttaaaaattataaatacaacttgatttttgtaaacttttaattaatatgacttgtgattatttattttgatccagattgtttatatctcaataagctttgtctaccagggcaaatctggcagattagttcagaatatgaaattatagtcttttcctttgacagcactatttttagcaaagaggcaaagaataaaatcagctcaaacacaggtaatgcttaaacttcctgcctcttttgcctctacaggaaagaagaaagaacacaagaaagtgaagtccactagggatattgttcctttttctgaacttggaactactccctctggtggtggattttttcagggtatttcttttcctgaaatctccacccgtcctcctttgggcagtaccgaactacaggcagctaagaaagtacatacttctaagggagacctacctagggagcctcttgttgccacaaacttgcctggcaggggacagttgcagaagttagcctctgaaaggaatttgtttatttcatgcaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaacagtgttgtgtggtctccagaaacatgttgttctgtgtgctttattcttggagttgcaacaagttaaatatttgtatatgaacaccccttttccatttcatcattgaaactcactttgacatttcagtggtataattgaaaatattctgattatggtatggtttttcttctgtttgaggaccatgtttttattgactgttggaatctaaatttataagaggaattaatctgtaaccagataccttattcgtttaaccgatttctattccactactaatggttttttttactttgtgctttctagttcttagattctgagttaacaaagcataaaatagattttatattgctgggggttgtaccaaacatagatacattgacagatccattgatagaagtgttgggagatggacttgaaatcttagtcctaaataaagactgaactgtttaaactaacttgataaaaatcactgttcgtttttgggaacctgcaagtattaaatagattctgtactaactagtattaacactggaaagttagcaagacacatatagatgtcttgaccactttttcacacaagttcagagttcatgtaaaactttagaattgacttcctttctgtctcttcagtaagaaagtaatctaacttaaatttttggtagtagaagttttagaaataacaactgactaattttgctataccatgataaatgtctacaaaaagggatttttttttttttgaaatgaagtttcgctcttgtccccaaagctggagtgcaatggtgtgatctcagctcgctgcaacctccgcctcccaggttcaagcaattctcctgccttagcctcctgagtagctgggattacaggtgtctgccaccaaccctggctaatgtttgtatttttagtagagacggggtttcaccatgttggccaggatggtcttaagctgacctcaggtgatccgcccacctcggccttccaaagtgctgggattacaagcgtgagccaccatgccctgccagggatgttaactaaaatcagtcttttcaaaacctagatcttcaaatgatgatgaatttaagactagga

SEQ ID NO: 70917 - DNA, 1150 bp, Homo sapiens
acgagaagtgacctgtgattggtcgtatttttctgtgaacaagattccttctttacctgagttgtacctaggttttttataactacatcaaaaaagcttttatattgtacttattaatgttatggcagttacttatagaagcttggtactatatggatttttttcatttttaaactttcccttctatgttccaaattttaatttagtaagtcaacctttgctgtacagtagtagtatactgtatggacaaaacaatggtaacaattgtgttattttaaatggcctttttccacatctaaattgttcttactgaaaagctttcgtgggagcattttgaactcacttcatgttcaaagctatgagtcccagataaaggaaaggagaataggtaggaagaagtggttgtcagatgaaagggtaagggagataagcaaaaatgggataaataatgaaacagttttcaagacaaattgcagttaaacaattttggactagtgaggtattaccagtagacttgtttttcaccttttaatgtgcctaaaaccagggttcccgattaatattaggataacatcatcatttattgagtgtttcagagagtaatggtttctccaatgttatttccagactctaaaatagagctcaagcttgagaagagagaaccactaaagggcagagcaaagactccagtaacactcaagcaaagaagagttgagcacaatcaggtatctttagttttattaccaccgtgtacaggtataaataacctcctgacaacactaatccatgttttagcctttaatggttgacacccagattccagcacgctcaataaacttaattctgttgttaaatgatactaaaaatctaaactttgtgggttttgtcagtagtgtagcctgtgattacagcaaaagcaaatttttaatgtctcatttgtgtttgagtctgtgctagatgtagttcaaagccagttatatggtgttttgaaagaaatattttaaaaggtggaaatatctagacacttttgatacaatttctttaaaaggcaatggaagggttttatatttgtgtctttgtctctagatttctgactttgattttatgtttgcctgtcttgtcttctgcgattctttcctaaactcagaag

SEQ ID NO: 70918 - DNA, 1046 bp, Homo sapiens
tgattataaccatatgaaaataataatgtttatgctaacaattacaaaagtttgtatttttgttttaaaaggaaactgacttataatagatgacttttttctaagtcatgatcagtctgctttttgtttagacagagatgtagctccaatactagagccaaatagcacacagtgagtcaaaaagggaactggtgatagttgatgtgctttttttcccataatgtttataatttgtgagctactataggtggattctttagtgtattttagcactttttaagtgtttcctgatgcctaaatatcagttcaattaatacatttaggaatattttgaggacatagccttgtttgtaaatgctggcatttggagacttctatttcatggcttctcagtgtgccagtatggccgttattaaagtatttgatgttagaatatgactttttaatgtgttgatgcttgaatagagctattctcaagctggaataactgagactgaatggacaagtggatcttcaaaaggcggacctctgcaggcattaactagggaatctacaagagggtcaagaagaactccaaggaaaagggtgatgcaaggcttattccttgggttttcagatttgtagggttttagtattattttatatttattgtttttgttttgttttcaaactaacaggtggaaacttcagaacattttcgtatagatggtccagtaatttcagagagtactcccatagctgaaactataatggcttcaagcaacgaatccttagtaaatatgtttcataaactatacaagtggtattctttgtaaattaccctttaattggaaatggggaggtggtgaattttggcaaatctcaaatttacatgttttttttttttaacaattttaaactgattttccccatatagttctgaattttagaattttcctataatatccaatttatgtaaagaaatctaattcattgtacaagaaagtataaggatattttttgttaaaatatttgaagaatgaggcttcatatgtgaggcactaagt

SEQ ID NO: 70919 - DNA, 2070 bp, Homo sapiens
actggaaatttcaagcatgcatctcctattctgccaatcactgaattctcagacatacccagaagagcaccaaagaaaccattgacaagagctgaagtaaatgaatacaatttagatcgatgctatcattgatctttcaaagaggaaatataaatatttgtttgttttttttttttttttttggagtgggagggagcagagctttctttattgggtggtgtgtgtaaatatgcataaattattttaaggacacttttattagtgaaaacagaaattaactaatatagtttgacatgctaatactatcctcttgccactgtatccctcttaagttccagttttcaagggagtggtcatttctgttctgcttataatatgttctgtttgtcatggatgcaagtttgaaagtgctgctgggctatgagggaggctacactttcttttgttgacgggtcaaataagagactttaacataacttcatgtggtgctggaatgggttaactcctgtgtaattaagcttgaaagtactaactgcatggtgcattttaatttgaatgaatctttacaaaaggagccgaaacatttattattttgttctggacataaaggtaaacagtaaaacaagctaaacattatattttttttaatttgggcatattgcattgactataattttaaaacatatagtaaagtttgctaaaggttcatgttaagtatcttctgtattttatcttttactacagaattcttaataaatgaagaaacagtatacttttttttttttgaaacggagtcttgctctgttgcccaggctggagtgcagtggcacggtctcagctcactgcaacctccgcctcctgggttcaagcgattctcctgcctcagcctcctgagtagctgggattacgggtgcccgccaccacgcccagctaatttttgtatttttagtagagatgggatttcactatgttggtcaggctggtctcgaactcctgacctcaggtgatccacccgcctcagcctcccaaagtgctgggattacaggcgtgagccaccgtacccggcccaacaatatactcttaatagtaaaaaacaaaatcaatgagggaattagcattgccatgttagattactgaattttttccccccagttatttaaatgtgtggcagtttttcactccaataaccacatatataaggtatcttcaagaaatttgaagagagccttggaagcatgtggatacctaaataataatttagaaatggcagctgtaaaatctatgatagatttaaaggcattttgttctctaaaacttactatttatgttttaattattgcatgtttacactaaattttaacttgtggttgtttgtttgtctgtttcttattaggtgggagaaaaaacagaggaaagaagagtagaaagggatattcttaaggaaatgttcccctatgaagcatctacaccaacaggaattaggtattcagatacatttaaacaagtactagtgtattctagtagggaatctttatttttaattcttcatcacaaagttactgtacttctgctcagaattaagctgtttttttggagccaggtacaatggtacatgcctgtagtcccagctactcaagagactaaggcaggtggattgcttaagcccaggagttcgagaccagtctgggcaacataatgagactctgtctacccaccgacttttaaataaataagtgaacgaactgttcttttgggagcagtttaattcccctaagcccaccagtaaatattcttgaaagttgaatgagtttcaaaattgcgattggtaaatggaggattttaaataaatcacttacttactacttaaattcatatgttaaaatctaaacgaaaatctagtgagaaatagtttttcccccctaagtttctcttttctaattgaaaaggctgtgtttatgtatcttaatttttaactgaaagaaacacagccaaaactgttttgtttttcctctttactcctaaacatgagctttgaagagcctttaagaaggcaggtttagtgactattta

SEQ ID NO: 70920 - DNA, 1501 bp, Homo sapiens
catcgaactttttttttttttttgagacggagttttgctctgttgcccaggctggagtacagtggcgtgatctcggctcactacaacctccacctcctgggttcaagcgattctcctgcctcagcctcctgagtagctgggattacaggcacccaccatcatgcccggctaatttttgtatttttgtagagacagagtttcaccatgttggccaggctagtcttgaactcctgacctcaggtgatctgcccgccttggcctcccaaagtgctgggattgcaggcgcgagccaccatgcccagcccatctaacttttaaaatagaaaatatgtagaagttttaaataggttgactgacctcactgctttatatgtatcaattttctactgttacctcagggaatgtgcttggaattaggagtggcaatgacattttatgttatttctctaaatcatgcctttatctaaaattatttttcttttcctcctttcactcccaacagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttt

SEQ ID NO: 70921 - DNA, 1020 bp, Homo sapiens
agctgggcgtgatgatgtgcgcctgtagtcctgtctactagggagactgaggcaggagaatcgtttgaacccaggaggcagaggttgcagtgagcagagattacgtcactgcactgtagcctggcgacagagcaagactccatctcaaaaaaaataaaaaagtacaaaaagtacttgcttttatattacatcataagcagtagttaataaagttgtatactcttaagaggtgggcattatgattattttttatttttttattttttatgagatggagtctcactcttgtcacccagactgtagtgcagtggcacgatctgggctcgatgcaacctctgcctcccaggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttc

SEQ ID NO: 70922 - DNA, 1037 bp, Homo sapiens
aaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctagttttgtcgttgcaataaatggttttcagatagcacaaactgtgatttctggataacatttcttatgtgatatttatggattattgtgttttatttcagtctgttcatatgttttacttcttattgtaatcgggttctcgtttattcaaaggtaagcaatgtgtagctactgtactcacagaatgacattaagcgctccaaggcacctctcccacacctagttcctttttcccaccacttttactgtctttagtatttacctatgacccttatgattgttagtcttgctttgagactaagcccgtgtcactgtgatacgtcatggagctgtgctcacaagatgaaagtgccattatgtcttcctcattcatgtgtccccagaggtgatttgacttaaattagtgtttctcaaggtagtatagacaccataattaattataaggcaaatcgcatcaaaggcttaaaacaacaagttttattgcatgcttaccatgtgctaggtacttttctatgtgcttaatatgtattgattcactcaatcctcacgataatcctatggagtaggcattttcgtaatatcattacaaatgaggaaactgatggttagaggtgttaggaagcttcttcatgtttgcacacagctgagaagtgatggctctggttgcatataatatggcagagggaacctaaaacaaacaattctctgtttacatgctttaaaccagttctgtgttcagccctgctcctttcacaactttggtggtgccttctgagtttcaaacctctgaagcgttcttttgggtaaagtagctcactcctagtttttcttgtttttgtttttgttttctttgagacaaggtctcacttaatctttctctgtggctattta

SEQ ID NO: 70923 - DNA, 2341 bp, Homo sapiens
tctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaaggtgagatcagaccctgcccaatacagtcgtgtggtctacttgtgggccgcccagcctttgaggcctggacccggcttggaggacagggaaggacgagtccagcccgctgcaccgtaggacggcgcccagttgcttgccctggggtatcggccttttccaccataggcgggtgtcagatccttggccttccctcaagggcgtggaagcgctgaggccctgtgtcccttcgtgacctccgtgtgcccgagggaagagaggccgtgactagctctttctccgccgtgagctcgcttggtcagcaaactaagtactgggtaaactctcctcccgaaactactgaccacccacagttctactaactatattacctgtcctttgatttgcccttagttttcttaaaaatagtcctttcctaagttttatatttgtcgacgccaggtcagtcatttttgcacttaattgtatatgagataactagatgtcctgttttcgtgcgactggaggaggcagcttgcagccctacataggcaatagaaaggagataattggtgggcgtccctttggtgtgattatctcttgggattcttggtggttgggcccagctttaacttagttgtgtgtgttttaaatcctagtgaagtatgtacatacagagaaacctgaaaaccgaattgtaggagtcctaagaatgttatctaccttgtgcctgtaaaatcgaaagatttttttctttaaatcattcatgtgcttctgttgtctttagtatggatagagtccttatttacactatctgtcgttcagtttaaaagttaaagctaacattatttgtgtattaaatgtatttgactgcaggaatttgtgcgtatccgtttttatgttacaggagttcttaagtggggatagtattggttagtggctgggataaactttgaagttgtttgcaagccttttacatgtcgagtgatctttctgagtttcgtttgtactctgaagtgtgctcttaccagtggttaataatttgaagtttgactttaattgtaaaagccgttaatgtagaaaacttttaaaaaaattaatatggcagaatacgagctattaatagtatcagatacagaaccctcataatttttaaatgatctgaatttggcagtgaatttttttttaagccacttaattgtggccaaagctattcagctgtgataatagtatctcacagggaaacattttctttcattccagtggccttagtcatctctgaagaaatacttacttgatttttttttttccaatcaaacagagcagtatagctgtgactatggatctggcagattctttatcctttgtggacttggaggaattattagctgtggcacaacacatacagcattggttcctctagatctggttaaatgcagaatgcaggtttgttttgcatgctggactagagcatattgaagcatgactgactgttaagttataagatatagtcatctaacaagctgtgtggaaacctaactgtccaggaggtaagtttatgaccagtaacatgagttttatattaaaatgcatggtgtgtcttctcttactacagagtacagttgtgaatttggctccgcgaagtattatgcactgtgtggctttggtggggtcttaagttgtggtctgacacacactgctgtggttcccctggatttagtgaaatgccgtatgcaggtttgtattgagatgacaacattgaaagtatctctcatgtgacttaactctaaataaaatcttaaatgagaatttgaagacatcacaactgctagaaacttcagtaggaaaccacatagaatttctttaaattgtgggctttattttgactagtgttttaaatccaataaatgcctctattgtttgagtaaattgttcacttttagagtctggctgtaaatggctctttgctgctgctcttcacttctggccggagttcttcaagcttactagtgccccaaatagtcatttaacaagcacctatgtgttggagtgggtaaacaagtctgtgtattatgtgaagtaacaatgtcctttatctactaataagaccaaggcaaagagtacatgtagatttatttaaagtgctcttaatatcttagtatgaaaattttgtcagattagcctcttgtttatttacacaacattttaaaat

SEQ ID NO: 70924 - DNA, 1021 bp, Homo sapiens
tttttttttttgagatggagtcttgctctgctgcccaggctggagtgtagtggtgccatcgtggctcactgcaacctccacctccctccctcaggctcaagcgattgttctgtctcaccctcaccctcccgagtagctgggattacaggtgcacgccaccatgcccgtccaattttttgtattttagtagagatggggtttcactgtgttgcccaggctggtcttgaactcctgagctcaggtaatccacctgcctcagcctcccaaagtgctgggattacagatgtgagccaccgtgcctggcaggaattactgtagttaccttttgtgtagttgctgaaatttattatggaacccaaacaaaaataatcatgagattaaatttttatgttagctgtttggtgcatttaattttttttttcttgttttaaataaaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggtatgtaattaactttaaaattgaatgttccgagtgtttaagactttccgagtgttcttagatttttgtctgtcttgccttattttagcactgaagaaaatggtcctacaaagtgagcaacttgttttaaatcgtatgcctgtgtcagcagagacaggttgataaatgtatttcattaaattacaattctccttttaatatactatcttgttttctaagtaagttggattttgagttttttagagaagggctctgggactcctttgcgtagttccggggcatggcatctagatattttttgaatattcatgttgttcacatagttacgtgttttgttaatgaggttatgagaccacatatatattccatatcatcgtgtgttactttataaaatgtctgaagct

SEQ ID NO: 70925 - DNA, 1422 bp, Homo sapiens
ctcactgcaacctccgcctcccaggttcaagtgattgtcctgcctcagcctgctgaatagctgggattacaggcatgcaccaccacgcctggctaattttgtatttttagtagagactccatgttggtcaggctggtctcgaactcctgacctcaggtgatccacccgcctcggcctcccaaagtgctgggattacaggcgtgagacaccgcgtctggctgtgaacttcattttttagtattaagcctaccagactttttaaaaagactattataacatttaatgtctatttacctgtatgtagaacataaacttgagaggtaaagataagttaatacatggtttgagccctggactgagttttttttttttccctagagtaaggaccatttgtcggtctacaaatgacttgatgtttggcctaaacatttactattaacttttagggagggcttgttagtatccttgtgatctattcacagttaagaatttccatgaccacaacatgcttccttagatccacctttgtggatgaatcttgaactgagttccacttgtaaacttcttgtttcttgtggttccagtagtcaaagaaacatccagcaacttttttggttgtatagtcaaaggtgcttgagtcattggcatgtaagagaaatatacctgcatgttagtctaacgttctgatagaaatgacatgcatttatgctgccatttgttactatcaggactcgactcgtgtgcggacatttctgttaataatgacagtctctgatagatgagtgtatgcaactgtgtaaaacaagtctcttgatttcctagattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtacgaattacttagaacacacttgtctgaaattatgaacaaataatcatttccattattggcgttttttgagagggaaaaatactccaaaggttataaagcagtgtttttgtttttttggtttccctgaggcatagtctcgctctgttgcccaggctggagtgcagtggcatgataatagctcactgcaacctcctcctcctgggttcaagtgattcttctgccgcagcctcccaagtagctgggacgggcatgcaccgccatgcccggctgatttttgtttttgttttttgtttttttttgagatggagttttacccttgttgcccaggctggagtgcagtggtgcaatcttggctcactgcagcctccgcctcctgggttcaagcgattctcctgtctcagcctcctgagtagctgggattgca

SEQ ID NO: 70926 - DNA, 1517 bp, Homo sapiens
cccaaagtgctgggattacaggcgtgagccaccgcgcctggcctgatttttgtaaagatggggtttcaccatgttgatgagtctggtctcaaactcctgacctcaggtgatgtgcctggcctataaagcagttttatcttcccataacattttatatgctttttaggattcataaatacttgctaactagttcctaaaagggctgtttcatgggatgtcattattaggcttgggaatgtattgatcttactgttgcaccatttttttgttgttgtttattaagaattttatacagaaagtgttgaataaaatctgaaaaactttaaaagattgttccgttttacataggatagacagcttgataactgtacccgtgtcaccctgagtctgatttttattttagaactagaaaaatattattttaaaatcataaaaatgattattggctctgtgaagttttgtttttaactggcactgtatgggatcctttatcttttttcagctggagtcttttgtgcaattgtttctcaccctgctgattctgtggtatctgtgttgaataaagaaaaaggtagcagtgcttctctggtcctcaagagacttggatttaaaggtaggatgatgtttttttcttgaaagaaagaacaacagttttggatatgttgcatttttttcatttgcttttcctgtttgaaccaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaaggtaaaccaaattaggctgattcttagaatgacagtaaaggaccaaagtgattgacagctgaaaacaattttcaggtacactaattctctttacacagatctgactttttttttttttga

SEQ ID NO: 70927 - DNA, 1047 bp, Homo sapiens
aactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacctatttttgcaactttacatagcaagaactttatccatccttctgacatacatgttgttacccacacacacacacacacacacacacacacacacacataggagaagcagaatgtgctagttagcatggggagatctcgaaggggcaggatctgaatccccacttgccctctctggctgccagggagcccagcatgtgtgtttagggacctaactgaagggacccctcaggggacagggctgcggcattcattatccagttagaggaagagaaactagaaaggtcacagtgagctgcaggggaaaaaaaataaaagcctatctgggtccttcatggctttaggaaacagggaaaggaacagtagtgtctcggtctatttgggctggtgtataatagtatagcaagaac

SEQ ID NO: 70928 - DNA, 1137 bp, Homo sapiens
ttccgtctaaaaaataaataaataaataaaacaatgcagggttaacgtatttgtgaaaactattaatgtaataaatatctttgtcagtctgattctgatatacttggatattttagacatcttcagaattttaacgtggcatgtgttatgctcctgattgttaaagtgtgtttctctaatatgaaaattattaagtagccttgggaattgttttgtgttataaatgcagcttgagtctactgaaagcatcctgcaggaagctacatcatccatgtctttgatgacccagtttgagcaggaagtatccaacctccaagatatcatgcatgacattcaaaataatgaagaggtgctcactcaaaggatgcaaagccttaatgagaaatttcagaatattacggatttctggaagagaagcctagaagaaatgaacattaatacagacattttcaaatcagaagcaaaacatatacattctcaagtaactgtccaaattaactcagctgagcaggaaataaaattgctcactgaacggctaaaagatttggaagatagcacactaagaaatattagaacagtaaaaagacaagaagaagaagatctcctgcgagtagaggagcagctaggctctgatacaaaggcaattgaaaagttagaagaggaacagcatgccctctttgccagagatgaagatctgactaataaactttccgactacgaacccaaagttgaagaatgcaagacacatttgccaacaattgaaagtgctattcactctgttctcagagtctctcaggatctgatagaaacagaaaagaaaatggaagacttgactatgcagatgtttaatatggaagatgatatgctgaaagcagtgtctgaaataatggagatgcagaaaacccttgaaggaattcagtatgataatagcatattaaagatgcaaaatgaactggatattctaaaagaaaaagttcatgattttatagcatactcaagtacaggagaaaagggaactttaaaagaatataatatagaaaataaaggaattggtggtgatttttaaattcatgacatttattctgatgaaccatatcattatacataaattgattagtccattgattttgagttact

SEQ ID NO: 70929 - DNA, 1049 bp, Homo sapiens
cccgggaagcggagcgagggcgggaagacccccgtggcccggagcagcggaggcgggggctgggcagacccccgaacgtgcctgagcctgctgtcgctggggacgtgcctgggcctggcctggtaagtggacgcgaggctgcctgggccggcctcctgtgggccccctgctgtttgggctcccacccggctcaacatccagccggaggtgatccaacctcccagacctgggccttctgtgcctctgtcttgaccccaaaggaaggaaacagcccagccttgtttttccctttcgggcgtttcttgtatctcatttccccccgtgctggtagcatgcccctatcgctcagaaggagttgaggctaaggtttgggaacgagccatttgttaagagctgcagattcggccacgctttctgaagctcccgctacacgtcagaagcgttcacgttgttataaaccgttacttcctgtccgctgtgccccattccgggacacatctgccccaccctactcaccccataaatacctaatggaaatacttgcaaccttaaaacagatcattatgtttggagaccgaggcaggtggatcacttgaggtcaggagttcgagactagcctggccaacatggtgaaaccccatctctaccaaaaatacgaataatcagccgggcgtggtggcgggcgcctgtagtcccagttcctccggaggctgaggcaggagaatcgcttgaacccgggaggcggaggttgctatgagccaagatcgcatcactgcactccagcctgggcgaccgagcgagactccgtctcaaaaaaaaaaaaaaaagaaaaccatatcattatgctcccaaaggagcaaacgttatagtagcagagcttggaggagtgctcatattttgatcaccgtgcatgcattatgaatttaaggtcttttattaagtaagttacagattgaatatggtaaagctacaaaaacatagcacttgtgttcacttaaaactaaccagttgcagttttaaaatcaggtaaatggcgatatattggtgtc

SEQ ID NO: 70930 - DNA, 1035 bp, Homo sapiens
ttctgttttacgtccatgaagagttttggctttccattttgttgtgggttacaaaaggttttgagacttagttcagataagttgtgcagttttaaaacgtatttaagatttgcatattttagtttaacaggactaggtgaaattggaaattagtttcagaaaaccagagtgtcttatttgcttagctattggacatcacctaaaaaattcattcattcttgttttttcacatcgaatttcattactataaattaaggaacattttatgtttaagaggacaaaaacgttattaacattttaaaaaatgagagttttgattcgaatcaataactttttatcagttttgtgcccctgctgggcattttgtaagccttgacaagcataggcaaatgccctacgtccgtccctgtttttccaagtgctacatttggtgacttcaaaaacagtcattgaagcttgataattattgcccccttctgtgagctccaagttacttgtgctctgtttttgcacttcgggcattcacattcccactctctctctctttttcttctttgagtagactgtgaattatttcaggcaaatgactcaatcttttctgtagtcttggtgtctgacatatagggaggggcacaaatgtgtattgaatgaatgaattgataaacccgtttagactctttcactctatacattgtgtaaagttctgttaatgttttgaaaacttgcagatattgtgaactgggttttatgcccatggaaaaatttgcattatatttgaaataaagttgctagaaacgtcaagtattttactataaaggctgttattctttcctcatgtcctcctggtctgagaaatcacatcagaaagtgtttcctgttgctttgtgggaaatgtgtttagcaaggaggacctagagctgacatcctccttgaacgagaactaatactcaatagtaacaatgctctattcactcttatgtttgataaggaaaacaagaagtctcttaatattaggacttcaatgtaatcactatt

SEQ ID NO: 70931 - DNA, 2010 bp, Homo sapiens
atacctttccaagcactgggttttgtccatttaaaaatttttgccaaggaaaaaaaatcagttttgttctttttacgtttcttgtttattagtgagattatgtatcttttcatatttttattggcctgacaaatattttggtgttttggctgtagctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgaggtaaagctctctgaagcagtccacacttccttaaaaatttttagaatttcagaacttgtactggtctccactactttatgttgcatacatattcattgttgtatactaaactacttaattttttttagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatggtttgtatccattataccttctatcactttgctatcaaaattgctttgggtttgtcttattgtagatgtaatcttttgaagagagtgtgaccagttcactgaaaactgcatgttaaaaaaattgtagtgatgttttcaatttaaatattttttatttgcatccacattaactctcaacttttcttcttgcccagtgaactgtactgctgagataataatatgtctaccctaatttttagagacaataagacaatttataggcccttgtttattttccagttctatgtgtttatagagtttataggaaaaaataagaatctttagaaatatatgttcttgaaaggtattccataaatgttcttccttttacacttgccttcccagtcttcaatatgagagggaatgaaaagtcaggaaataattgggtgagtaaagcagatatagatagaaacttccattttctttagtcatcttgaaggatatatgtttgtctttgctctctgttgtctgagaaatcagaaaattgaagttaatatgctagccacattttcttaacttctcttggaaattttcaggctaagcctcagctttgctctttgttttttatggtattacttcagtaattattccaaagttctattcattcatgcttgttttgttttggattttagtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggtaagtgtcttagtccatttcatagtctagtaaggtagatagacatgtaaaaatattatgatatatcaatacgtgataaattgaatggtagaaacaagtataaggtacagagttagaacaaaggaaggatatgttaactctctgaagggaggggatggataggacaagcttcctgaatgagatgacatcttagcaggagtttggagaaagaataaaagttagctaggcagtgaaggtagggatgggagactagggaaggtgggaaaggtagtgggtggttactggggtggggaagggcatactgggtagaagagggtttaagaaatgttggcaggtataccactgaccttagcgatcctggtaggttctcagggtattcatcaggaatagttgtatagctccatcagttctaggctgcccccattcatcagtgtgttctcattcatcagtgtgttctctctgtatgacacttctaggggaattcaaaga

SEQ ID NO: 70932 - DNA, 1026 bp, Homo sapiens
atggtgaaaccccgtctctactaaaaatacaaaaatttgctgggcgtggtggcgcatgcctgtaatcccagctacccaggtggctgaggcataagaatcgcttgaacatgggaggcagaggttgcagcgagccaagattgcaccactgctctccatcctgggtgacagagtgagatgccgtctcaaaaaaaaaaaaaaaaaaaaaaaaaaaaaaaaaaaatatatatatatatatatatatatatatatatagtttttaactatttatgtctatacagttttaagtaacccagttgtcttttgaaatttcaatgctttaattttttcttatttgtagggaaatagtaaagaattgacgtatctttaaatacagtagtgacattttacattactgtattcgtatgttggtttttaatcatggatgctttcttcataggctgtgttcctatttgtttctgtcctttccaagatttctttgtgttattagattattaattgctaccaggataagcctcctgtgaaagtagtgtggagttttccctgaataaaggcaacttttctctgaattagtttctctgagtgaattgtaaatacagcctcctcatgcaaagctaaattgctccctcttgtgcccatagtcaagatgtttagattctttctgaaatgtggaattaatggttcagtttttaactaaatgttatattgtgatggttagagatttacatatcagatggtcatttggtctgtttgcctttttaaagctggtagtgttttctcttttcttgcatgtatttaaatgccctaaatttttagttatacatttagggaaaaaggcctttgaccctaggtaataggtacataaattaaaatatgaaagaatttactaggtagccatatcaggatgctttctttacctttaatcttgggatgatttttacaaattttattttattttattttattttgagacagagccccattctgatgcccaggctggggtgcaatgatctcagctcactgcaacct

SEQ ID NO: 70933 - DNA, 1007 bp, Homo sapiens
attacaacatatgaaattgctagtttttaggtaaaaaatggtcacatatcatcattattgtatgattcattctaatgctaacctgagctcagttctagtttggttttggtgcttaaagactgagttggaaaatcccattacttggatagtaatggtcgcttttttttttttttttttggcactcagtaagtgatggctgaaccttttatggtaggatctgtaattttaatatgttctgatttagggtttgaggagaaggcagtctctaattttttttttccttatttgaatcagcatattgagaagagtatagcaaagaggaagaatcattttcctagatctagccatctatttgttttaaaaaaaatttaatttggtagattttaaaagacactggtgggattatctttttaaaaggaagcttaagataagtgtcattagtgattaatattttttttttaaattaggtctctcttgatcttggatgatgtttgggactcttgggtgttgaaagcttttgacagtcagtgtcagattcttcttacaaccagagacaagagtgttacagattcagtaatgggtaaggattattcgtttactttttagtacctttatatttaatttaattacatttaaatatgtgacataccaaattacttactttgtcttgtgatttttgtttgcaggtcctaaatatgtagtccctgtggagagttccttaggaaaggaaaaaggacttgaaattttatccctttttgttaatatgaagaaggcagatttgccagaacaagctcatagtattataaaagaatgtaaaggtatggttatttatttgtttatgaggagattatagggagttatataatttcccttttgttaattgagctaatgaatatggtaatttagcacatgaacatccaaaaacttttctgggagatttagtattttaggttctctgatatcttaaatggatacatgatattatggtatttatttattcattaaaa

SEQ ID NO: 70934 - DNA, 1036 bp, Homo sapiens
acagagtctcacactgttcctcaggctaggatgcagtggtgctgtcatggctcaccgtagcctcaacctcctgggctgaagcaatcctcccacctcagcctcctaagtagccggcactataggcacacaccaccacacctggctgatttttctaatttttatttttagtagagacaaggtctcattatattgcttagactggcgcatatatatatatatatatatatatttttttttttttttgtaatgacatcttagccagatttgatctatgttattttgacttaataaagataatcaggaacttactgaatgaaatctttcttatttctaattttttttgggataaatatctagaagtgaagtcaagagtgataaatacttaaggcttttgataacatgcagcagaaattgtttcttagtaatgtaagtaagtaagtcgattcttattagtgacaaaataggatggtattagcatagtgacttcattttttttttaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtaatgggatcaatgatcctcatcattgggtatttattgcatgtaagctttgatatagtactgagcatgttgttacagagaaccttggaaggataagacccaggggactgaggtggtggggtgttgggtgtagaaatccctctgctgttagcttccattaagggctttgtgttgaactcaggagttaacctatttctgtggttctagtgcagctgaagaagcatctgacttctctttctcttttctatcttgaggagtagctgagtttcttcttaagaaatggagacattcttac

SEQ ID NO: 70935 - DNA, 1014 bp, Homo sapiens
ccgtgttccccggtgccagcgtgtaagctgcttgtggtgtgcctggtccagccacagcctcacagagagccagagcccatgctggcacctggagctgcctgccccgctgcagcagtcagcacgtctgtgcgcagtggctggaccccacgctcactcacacacgcctcgctgttccacgcctgactcgcccttggcaggcttgggacccaggctggtagtgtgagctgaatgcagcctgtcaggccaagtgggtgaaacaagaccagtgggcccaagcaaaacttgggcaaaggcgccaccggccacagaagtttctggccagaaaatcaacaccccaaagatcctgtaacattttcattgatatttacaaacatgtaacagtgaatagttctctagttatgtgaaggcatacacattctgacagaaattctgattttgggagtagctttgccaaggttcctttctgttttgcaaaatgacaatgattaaactcacttaaagatttttattgaatgatgaccagtagttaagcagtttattataaaaaatattttattgttacttgtgcaggtgttcaaagctgaaacaggagagaaacttctagaaatcaaggctcatgaggatgaagtgctttgttgtgcattctctacagatgacagatttatagcaacctgctcagtggataaaaaagtgaaggtaggaaaatcttttcctcttgagttgtaatcacaacagaattcattttatttttccatgatcatgagaccagagtaagtagagttaaaggactctcacctgttgatctactaacctgattcattgtaaattaacactatctgaaaattctttacttttttttaaagagacaggattttgctctgtgacccaggctggagggcagtggcatgatcatagctcactgtaaactccaattcctgggctcaagtgatcctcctgccacagccttccaaagtgttaggattataggtatgagccactgtgcgtggcctgaaa

SEQ ID NO: 70936 - DNA, 1110 bp, Homo sapiens
tctcctgcctcagcctcccaagtagctgggattacaggcacgcaccaccacacctggctcatttttgtgtttttagtagagacgggatttcaccatgttggccaggctggtcttgaacttctgaccttgtgatccacccttcttggcctcccaaagttctgggattacaggtgtgagccactgcgcccaatgccgcccccccccttttttttttttgagacagggtctcactctgtcacacaggctggagtgctggagtgcagtggtgtgattgcagctcactgcagcctcaacctcctaggctcaagtgatcctcccaccttagcctcctgaggagctgggactacaggtgtgcaccaccatgcctggctagaagaaattttaatctcctatttgtaggatatgactctggccagttctgagatgatatctgggcagagatctcaacatttagaaaaaagactttctcttaattttcctgttttcaggtgacccttctctcaactgtgttgggtatagaatagccttgtattctgccagagtagggacacaggccccctgggttgcagagtgaagggaggagatttcaatggacttttaaagattcctcttgacttagcttcacctttatcagaaggtactgggtgccagcacttcctgagtctttttgaaggacttaacttcacctttatcagaaggtactgggtgccagcacttcctgagtctttttggagttctgtggggtgattgggctgcttggatttctccactgcaggctcagaatttaatttctaggagtctgcctattacttgcctttctgctttctagacttgatgattttgttgctgctgtctctttctccattttccttcgccttgtggattatgccgagagaaaaattcctattactattgtttacctgagttttgggagagtttggaaatggtctgtgtctgttctctgttttctgaaacataatacctgagactgggtaatttataaagaaaaggggtttacttggctcatgattctgatggccggaaattccaggattgggaagctacacctgatgagggccttcggctgcttccactcatggtggaaagggg

SEQ ID NO: 70937 - DNA, 1339 bp, Homo sapiens
aaaacttctgttcatttttgcattttacaatgtttattcataaaaataaagtctagctgtgtgattttgggcagtcttcctaacctgtcatggttctttggaactgtgctccgtgagataaggatggccttgtaaggaaaggtctccatggttacaccgtttgggaaatatgttttgtattgctttcccctattaggcacactgtatgaactaacatattcagggccccaggaagtcctcttacacaatttatgccatcgaatccagtgttcctcaaatgtatttaaaacatagaatgctttcttcatcactccttttttttcttcaattttgattacattggtttaggtgatttttcaaagtgttttcttacacctacaattttatgatttgatgactctgacagaaatgctcatcaatgactgaacaagatagtgaaatttttataaagtaaatgaggaaaatatgaaaaaagtaaataagaaaattctttgcttttcttccccacatctaatagtagctggtatttgtggtattcagagtgccctcacatataatttcttttgatataagtattcaagaagcagcgggttacagtagccctatgataataatgaggcaactgaggttcagagcagccaaatgatttgtctaaagttacattgtgattaggagaaccagatcttctgatttatggctcacttacattctcatctaatagtgatttcaaaagacttgaatgagggatattactgttttaaagagcataattgaaatataaaatatggttatataagaactcactgagggatcatgtatatgattgttattgatttagtgctacaatccttggatgttggttgcttatgagtttgtacccctttagcaggaaactaagaggaaaaatacctccctttaagtttgttaaaatctataagaacagaaaagaaaccactgcataagcaagacttgaagattaaaacttttttattgtgataaaatgcatataatgtaaaagttgccattttaaccatctaaaaatgtgcatttcaatggcattacattcacaatgctgtgtagccattactactatatatttccaaaactttttcatcaccctaaacagaaactttgtaaccatgaagtaataactcctctttcccctctcttgctagacctttgtaatctctaatgtaatctgcgaatttgcctaggtatttcatataaatggaatcatataatatcggtccttttgtgtctgactcatttcattgagcatgttttcaaggttcattcatgttgtagcatgtatcagaactgtatttcttcttatggctga

SEQ ID NO: 70938 - DNA, 1534 bp, Homo sapiens
tcttgatcttaaatcagtatattgtatcaatacatgtagtaaataaaaatcatcttatttggcaaaaactttggaagagtatattcagcatttataaatcttaaaaattgaagaaactgcggctgggcgtggtggctcacaccggtaatcccagcactttgggaggccaaggtgggcggatcacctgaggtcaggagttcgagaccagcctgaccaacatggagaaaccccgtctctactaaaaataaaaaaattagctgggcgtggtggtgcatgcctataatcccagctacttgggaggctgaggcaggagaattgcttgaacccaggaggtggaggttgcagtgagctgagatcgccccaagctgagattacgctattgcactccagcctgggcaacaagagcagaagtctgtctcaaaaaaaaaaaaaaaaaattgaagaaacttggattacccaaagtagttttttggggttcaaaaacaggaaaatgattgactataatggagcaatttggtagttctagagagaaataaaaatgactgagctaattttattttagcaaacctctgctctatattattttgatcatcttcatttatgagtattcattttctcttttgaataaacaagcattagggagaactactctgtatgttaattgggccagtctattcatttattcacaaagcttttatttctctttaggctagcttgagagctcatctgtgatgaattttcctttatagaaaatatgttttaagatgagcagtatttttaaagtatatgtatattgatccatattttgtttatgactgtcaataattatgccagttatcagtaattgtcatatttttttcaggacttatatttgaaatgggaggatattagaatagcttatctcttaaagtattttaccttcataggtatctctatttatgttgacagctttttgacattcatactagtggcctattgggagaaatccacacgggccatcacagcaccatccagtactgtgacttctccccacaaaaccatttggcagtggttgctttgtcccagtactgtgtagaggtgagtagttgaatttattctgtgaagcctgggtttccagagatcaaaggatgacagagaatgggcagcttaaaccattaactgctgaggagccttgcttgagaaattatagagtattttctttatagcctaatgacctctaactttgggatattaaaccacatagccagctttattattttaacagtgattgcagacttgatttgacagtatgacagggaattcagcaagcatttgctgaatgcctaacatgtgccaggaactgggaaaacaatggaatgactgctggtcatgaaacatgacatctcttatccagtatagatatgtggcatttcttaaacagtgtaggcacagactcttttcttcttaaaaaaggtggtgagaaatgagtccagttcagatttcttagatcattgagtaggataagataggatgttcattgccaggcactaatgaa

SEQ ID NO: 70939 - DNA, 1091 bp, Homo sapiens
tcgctctccctccttccctgcatatgtaaactattttctgtttttggcttaactgtccaatatttcttgcatatataagcagatatctatatgcatatatatccatacctgtatccttctatatgttcttgtacatatttttccatctcatataaaagatagtagtgtatagtatatagactcttctacactttgctttttttctgttaacaatatatcctagagatttgtcgtcatcaaggtgtttttctcattgtttttaatggctgcatgatattccattatgtgattaatgtagtttattcagttggttccctattgatgagtatttagtttcctagtattttgctataaaaaataatgatgcactaaataatcttctgcataagacattttgtagttttgatagtgtgtttctgagcaatattcattgaagtggtattgctggctcattcttgctattttcaatatttttgctctcttcaaaatgcttatgtatgtgatttcctatatgctgtgtttattctgtagttgtggaatacagactcacgttcaaaggtggctgattgcagaggacatttaagttgggttcatggtgtgatgttttctcctgatggatcatcatttttgacatcttctgatgaccagacaatcagggtgagaaatattgagattttcattttgaacatttcctgatggtgagctaaacctcctacaaactaagaaattgatgggtagcactgaggtaagcagaataggaaactagtactatattcctattcaccctggaaaagtgctgttatatggactgtaacagtctcattcattcgttacatgttcattgaggattaccatgggccaagtgctgtgggaacttcagtgattaaactgtattttggttaatttaaaatactgcatttgattcctcagaaaaatttttgacccttttctttaccttgaattcctacatccaattacttgccaattctgagagagtctaccttttcattttctattattatctctacctttccatttctgctgcccaagttcaggactttgttaactgttacttctcttgttgtattagt

SEQ ID NO: 70940 - DNA, 1041 bp, Homo sapiens
tgggattacaagcgtaagccaccacgcctggccacttttgactttttataatgcctttaggattctgttttcttgactttgctgagtcagttaccattctcttgctttccagcctcccacattttgttgctgttatctcctttctcattcttttgatcttgccattttagtagggctttagaagtgaaggatagaatgcatatgttcagtggaaattattatattcttttatttagtatatatattaattgtggtggcaatatttaattgtattgttaaaaacccttttgggaaaaagatcttttaatgttatgtctgtgtgagtcctaggaagcagtatgattgcaatgaaatttggctttagtacagaaacttacttgttataggctcccatgacactggtgttctagctgtaaaactcagtgtaatagtcacctttcttcctctccagatgtctttggaatgggtaaaactaaaaactacatctgatgaagttcttttgagacattgtatactatgtattctatcaaaagttaaattcataaggtttttatgaccagcttgacgatttcaggtattctcagctagggggaagaataatttctagagatatttttagaaaaggagttagattatatttagaaatatgagttaagtagttgtgtttcttcctctttttctgttctactcagaatactttttacatttacagtgttttaaatgtaacaaaactctatagatattttcgagaaatgactggttgggttttgttttcattttttaaggtttttgtaaatgattaagtggaggtttgttttaattatctttgtatccccaaagcctggaatccagtaagggttctgtaaatctttgctgagctgaagttattgccaaactttgaagaatcagctcacctgattatagcccttaggattgtgaacattgaggtctactttggtagtttttgatcctttaccttgaagtaaataaaggccaagtattacccatgcttacatgagccagtatataggactatgttag

SEQ ID NO: 70941 - DNA, 1475 bp, Homo sapiens
gggtttgttgttgtatttctcattttctttgctaaactcttaagtttctttatgctagatccttgtttgattcctatttgccttgcatataggtactaaatagacatttattaaataagttaatttgaagtcaagtattaataaagctctaaatacagttgcttttagtaattaagaaatgtcctttacatagacatagcataaaaataaacttctgtgtacctctgtgtctcagatacgtttgtatgcatattttgtgctagttactcatgttatttcattccccccacccctttccttatgtctgaggagctcctcctgaagctccacatgaaaaacaatgccttctcacttccgtcattttgaggattgcgatgggggatagctgagatatttgaagcttgggaactcttgtgttttggtttgaagctgctttgatcaactggccttcccaggccagcttcagtggggccaggatctgtagacttccccagcttgtaggttcagaaatctgtgactatgtaattaggataattttctcaggaaaatttaatcagatggtgagctcactggcatattgtgtgtttttttttttctatcttctggtataattaactgttctccaagcaactgaagaaaacaaattttatttaggaggaaaagtattttattttgcccctagtcaatttacataaccgcagcttctgtctgtaaaatgtggacaccacagtcttctctcttattcctctctgttttactgaaatgccatgtgagtaaaagactttagacaagagaatgtacactctctccacccctccaatgagataggatcgggggaggattataacagacttatttctttgatattcaggtatggaattggcaattggacaaatgtatctttctacgaggccatcaggaaacagtgaaagactttagactcttgaaaaattcaagactgctttcttggtcatttgatggaacagtgaaggtaatttaaagtataaatttgttttttgaaaaagtattctcatattgcaatgattatattgagacagtcaaaagccactgtgaggctaattacttacttaaaaatttttaatttttctcatgcttgttttctgttaattgcagtcacctacatctgctgtgtttaatgagcatttatactgttagtcacatttaaagtaaaggggtcagaacagccagtgtattaaaactcttgttttatagacctgtcttgtagctgattatgctttttaatataaaatgttcttaaaagtgtcaacctccaagtgttttttttttttttttaaggtatggaatattattactggaaataaagaaaaagactttgtctgtcaccagggtacagtactttcttgtgacatttctcacgatgctaccaagttttcatctacctctgctgacaagactgcaaaggtaggtcaatcaattgaaaccatgcataaaac

SEQ ID NO: 70942 - DNA, 1088 bp, Homo sapiens
ggctagtatagtgactaacatttaaagattacttgtcacatgctagtaatttcactctctataatctcatttaatcttcacatcataggtacaattgtcctcattttacagatgccgtgtctgaagctatagaagcttatatgagttgtcctagtcacaagaatctagtgaacagtggagctagcactcacattcaggtctgcttcactccacagactgctcttagctgattcagtgttcttctgtctaggtctaaattaaggaaggagtgacattgatccttgagctgaatttaacttgagtaaataaagggaaactcagaaaaattaacaaggttgcatgctggaacttgggcatctcatgacagtttatgaattgccagatattagaatgtccatgtgattgaatttatggctgaatagcaatcaaggcagatgcttattttgagtgtttatagcattgctaaacaatcctaattgccttccagatctggagttttgatctccttttgccacttcatgaattgaggggccacaacggctgtgtgcgctgctctgccttctctgtggacagtaccctgctggcaacgggagatgacaatggagaaatcagggtaggctgtttgctgacatgagagcactgctcttcttgtagcttgggctagcactgttcacagtggggacctttgttcacgggccagggaagcatagtcctgaagttgtggttggatgaggcattctttttgtttcttgtgcacattgtattcacagctgcactccactgcagaaacggattcattttagagttagagtgaagcattccctgtatatgtgaggaagcaagtgctctagtcatttgtagttcattctctgccattagcttgagaatgattcatcttaattcttggacttgaaccaaaggtttttggtagcagaatttgaggaaaataattttgtaaattatggtctggattataaatgaattgcaaattctgctttttctgtgctgaaagaaaagatctctttagcactatacccatttgatagccatttccagtgtggtttgttgcagtcctctgtggactgcct

SEQ ID NO: 70943 - DNA, 1050 bp, Homo sapiens
aaaggggcatttgagtgaagagagggggaatcttctgcccattctcccgagaaggacatgcagacaagagagttgagtctggccactgctgtaatggactctatagcttcctgtctgcagctctcaagcaggctgcatgtttctccagcacaactcaacggttggagttgggtgtaggcggagcagtgaggccatcaccagtgttcatcaggaagaggctgaccaggttgaatagtatattcagcattaaatccgagacattttcctcctgtttgcttgagttcggttggggggaggagatagggtaaaggatctgctggcactataaattgtcacacagtgtaattaccaatctaatgagaattttatttttctctgaacagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcattt

SEQ ID NO: 70944 - DNA, 1123 bp, Homo sapiens
gcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgta

SEQ ID NO: 70945 - DNA, 1079 bp, Homo sapiens
tctgttttggggggcatttttctggtttgctgctcttggtgcttatgtagtttacatgaaaatagaaacttcattacttctcggactatcataaacccttatttccaatcttgattaagtaagtctcagttcttgataaagtagctaaggttgcattcactacatttcaccagagtctttcaaaaccagaagcatagggttgatctgctatctggaactattctattgtgaattagaactttcaccaactataaatgatgtagatctcaacttgcagctaattttcagtttgaaccccaagttgctgttttctctgttctcagcatggtggcatttcagccaaaagtcccagttcaatcaaaactccccatgaaaaatactttaggacacagacggtctaaaaagttgattcatggtaatattattaggccaaagtattgtagattaagagttacctgtttattcttttaattgaaaaaaagatgttttctgttcaaagtatgcattttagccaaaatgaaaatgtctctcccagtaataagtaaatcactgtggttcccaattctgatcaatgtttccttaaatgtactttgttaacaaagatgactaaaatccaccgagttcacaatccagtggaggaaaccaacatgtgaacatttaattaccccaaagtggtagaagtattaccatagaggcactttcaagttgccatcagcctaagggatcataatagacgatcttaaaaatgacatatactcatgccctcctaaaatcagtttattagggctaataacaggtagcagttgagagctgtacaccctgccctgcacaactgaattatgtgcattagttcactcagtccacacagtaggtattgccattgctcccactttacatatgggaaaacaaagtccaagagaagttaagtcacttgcccaaggtcacacagacagcaggtggcagagccaggatttgaaaccaggcagtccactccactacccacactgtgaatccagagactggactgcctctccaatgtgccaggaacattcattgccctgggttttgttttttgtttt

SEQ ID NO: 70946 - DNA, 1115 bp, Homo sapiens
tttgctcttggtcattgaagataagaaaataaaaatatcggacctgtgttaaaggttttttcctgtttttcctgaagttgatgaaaatatttatcctctgaaagtagtgacgtgaagggggaaggtatttctggttttccggcaaatataaaatacagtttgcttttttccaaggcatgaatttattggtaattttccttgcataaatgcataaatgatttttttagtcaactcaaaatgttttaaagcaaaaagaatgacttggaagtcaattattaaaccttgagcaccctaaaacattttttgagttttttttaaatgtgattctttgcattttattattttcctcttttccttcctggatgctaccttggtagctgccatgttttaaatattgacaagataagatagttttctgtttatatcagcagtcgtctgtctgtgaaatatggacgaatcagaacgcaggatttcctttctcagcgatccatcaggttcataatgtaaggttacaaatggttcttttcttctcctgaacttgcgctatgtactgtgttgcacagtgttgtcaacagctataggtactgtgtcctggcaatgcagaaaatttgtaatgtctggtgactccgagactctttgtctattatacttcatttactgtgccttgtgattagttgatgtgcaaacattgtcctaaaacaagaaacatacttggttttaaagtgtatggttaaaatatgtcccatgtgagttttggctttcattccaggcgtctgtgttaaacttgcttttacaggaaaaagaaaagggtaaattgatatatatatatatacacacatgtatatatcagcattattcctccccattttgtacctccccatattcatggactcttcaaccctttgtgtctaatgattctcaaagattcatgtgcttcacttgtgagaaatttctgagtatgatttgcatgttattctgtatacattttatgcaaatgtggggggaggtgagctgggagaggcacggttacagctacaaagtggttctcagcctttttccatttgacagtactgaattgatctttgcaaattgtatgaaattgtgacccattttac

SEQ ID NO: 70947 - DNA, 1132 bp, Homo sapiens
tggggaggggagggacataatttatcacaacagggactaagcaagaggaacaagaagtggggaaggtgatgagttctgcttgaaacatttgtcaggcaataagatcgagagtctgaagatagaaatgggagaccagaggaatagcaagaaagatttggggtggtagagagtaggggctgactaaggaccatgaaaaggtgttctgagcggtctgagggcccagccacatacagtcaaccattatgaatatgtactggctggtggcagggcttctctccagcagaaaacaacagtgaggttagagaaggcacatgatttgattagatgttgaagatttacaaggcgagcagaggaaagacaaaggaggtagtatgctgaagatgaaaacagtatcttcaagtttatcctgcctaaggaaggagggatatcataaatgggataaatggcagggatgtaacagagaaactgagggaatggagattaggatgaggccaaacagcgtgtgttctgagagtcagggtgagtgttgaagggatggaaagaggcaggcaattatctttccttcatcagacaacagatttttactggacacagtattagggttctccagagaaacagaaccactaggatgtaagtatacatacatagaaaggtatgttttaaggaattggcccatgcagttatggaggctggcaagtccagaatctgcagtttgatcccaaaggctgcctgctggcagagttccctcctgcttgcgggaggtcagtcctttgttctactcaggccttcacctgattggatgaggcccacccacattaggaagagtaatctacttcactcaaaatctaccagtgtgaacagcagtctcatccaaaaacatcctcacagaaacatctggaataatgtttgatcacatatctgggcactgtgatctagctgagtagacacattaaccatcccttagcccagtagggtgactactgtgtagttaacaacagtatattgtatatttcaaaatagctagaggagaagacttgaaatgttctcaacacagagaaatgataaatgtttgaggtgatggatattctaaacttgattgttacaaattctatacatgtatcaaaatatcaca

SEQ ID NO: 70948 - DNA, 1041 bp, Homo sapiens
gtgaagaatagaatagccttagttaacagagagctattatgtacacacaagaattaattgttctttttttttttaacagagtctcactctgtcaccaggctggagtgcagtggtgcgatctcggctcactgcaacctccacctcctgggttcaagtgattctcctgcctcagcctcctgagtagctgggattacaggcaactgccaccacgcccggctaatttttgtatttttagtagagacgaggtttcaacatgttggccaggatggtctcaacctcttgacctcatgatccgcccacctcagcctcccaaagtgctgggattacaggcatgagccaccatgcccagccaaattgttcatttttaaagaaggtggtatggcagtatggagacagcattggctttggagtcaggggacctgggtttgaattctaacattgccacagaatatgctttccatgaactttagcaatttactgaagcatactcatcagtgaagtggggttagataatttttactccctaagactggtatgagtactaaataaactctcaatagatgttctttactctccctttcctaaacaataaaataccataaattgtgctaaccactaaaatcgaactgaacattgcatataatttcatcattcttgcatcatgcagaaggcattttaggaaattttattaaattattattataaacgaaagaaattcttgcttcttgctggaaaaggtgttgactaaactaacttttttatacacaataatagctaccatttatttaaggccacctaagtgcctggggttttgtttgttagtatacatatatttcactaaattttcacaactcgatttgtagcaagtattactatgctaattctgtaaatgaagttaattggtagagacccacaaatagaatccagtactttttgtccaaagtctcctctcttaattattacattaggttaaagggtatgaatctaaaacttcattcacaaactttcacagaacactagcttcttgagatataaatattc

SEQ ID NO: 70949 - DNA, 1033 bp, Homo sapiens
gtgtcctgaatagtattgcctaggttttcttctagggtttttatggtattaggtctaacatttaagtctttaatccatcttgaattaattttcgtatgaggtgtaaggaagggatccagtttcagctttctacatatggctagccagttttcccagcaccatttattaaataaggaatcctttccccatttcttgtttttgtcaggtttgtcaaagatcagatggttgtagatatgtggtattatttctgagggctctgttctgttccattggtctctatctctgttttggtaccagcaccatgctgttttggttactgtagccttgtagtatagttagaagtcaggtagcgtgatgcctccagctttgttcttttggcttaggattgtcttattaagataaataatagtgttttcattgtcttttggccattactgtatcataaatgctgctcagactagattaaaaagcatagaaatcagagtcatttcaactagtagatcatattcacatccaattaaatttatggcataaatatggcttgcatcagactttcacccaaaaataaaaataagtgacacttgcaatgagctaggcatgatattggatgctttatatacattgcctctgtaaattcttgcaacaaacatgaatctggtacaaattaagagataagttcagacagtaaaacatatttcctgaggttatgaggtagagttaggatttgaacctaggcaatcatgagaatggaagtccatgaagccaggatcacgattctgttcctagcacctggaacaatgtctgctatttggctctcaataaatattatttgaattgaatgaatctgactccagagtccaggggttttttttttatttttgtaggtatgtagtaggtgtatatatttatggggtacatgagatgttttgatacaggcatgatacaggcattattgcatgggcaaatgggtatgcatcacctcaagtatttatcctttctttgtgttacaaatgattatttttaaatgtacaat

SEQ ID NO: 70950 - DNA, 1009 bp, Homo sapiens
ttattttagtggacatctgttcattcacccttctcgtgattaaaattaaaacattccaaatttcctctgaagaagccacctccatctcttccctattccatgcctgaacatatggcctggatcttcagagccaagctcggcattccagcctctgcctccacctctatggactactaagtattcttcatcaggaccagctaccagtgcaaaatgaaaatatagggccccttgttcaaaaattattaaaaatttttagccagtaacatcaaaacattaaagctagcacaaggcccttctatctgcaggaccttgtgtaaccatacaggtcacacacccttgaagccaaccaagctcttcattcctttatgtagacccttagttccatctggtgtcattttccttctacctgaaggactgtctttgacattattctatagtgtgaggctgctagtgataaattttcacagcttttgtatgtctgaaaaatacttcattttgccttcattcatgaaacatagttttgctgggtatagaattctaacgaacagtactttaaagatattgctccaccagcctctcttctgctttatttctaacaagaaacctgccgccattttgttgttcctctatacataatgggtcagtttttttccccctggctgcactgaaggtgttgtctttttcactggtttacagcaatttgattattacacacattggtatcattttttgcatgttttctatgtgcgaagttttttgagcttcttaaatatgagacttatcattgtcatcaactttggaaattttttagtcattatctcttaaatttttttgtttttctgagacagagtcttattctctcatccaggctggagtgcagtggcacaatctcagctcactgcaacctccgcctcccaggttcaagcgattctcctgcctcagcctctcaagtagctgggactgcaggcatgcgacaccacatctggctaatttttgtatttttagtgga

SEQ ID NO: 70951 - DNA, 1043 bp, Homo sapiens
aattaggcaggaaaataggttctgatctattgctatccccagcagccgtcatccttcaattctgagaagttcacccccatttaataaagaacagtggctcccttggagttatcctgcaatctgtagtgagagaaatagggctttagatatctgagcactttcccttccttacataattcgtcaaagaataatcacagtttagagctggaagggacctttaaatctccagctcttcctctcactggagtcatttcacaggtgaggaaactaagtcccagtcctattaaatgacttgccccaaggaagattgctccttagtaactgaactggaactaaatcccagatatctgtgctcatgacaattgcctcctgagtgaatatggtgctatatcagagacccaaggctgtgagttgcttgtgtgtttgtgaaagaaactgaaaagggacaggaaatgaaagaaccaattgactaaaagcaagaacaggaatcatttataaaatcggccttccttttacatttcaggcttaaaaggcagtttttgcagcctccatggaccactgaactcccttctcaaggctagaaggaagggttgcagcaggaatccaagagctctagaaatacaagaaaaagacaaatatgaaaaagaagaaaagcagatataggccatgtgagctgtccagcagccaccggggtcattcacttatttatccttgaaggtagcctgagagaagcttcactgatagcatactgtgctgtttcaataagtaaaataatcttaatttattttccttcttaatctgggtagagaggaaggaaaaataggcaagatggaaggtcattctctaagagagcaaagacacatctttagagcattaaactccagggaaatgacatttttatgggattaatctaggaagcagcataatggaatggttgggaacatggtcagactatccgagtttgaatcttggctccattctttgcctaattgtctgaccatgggcaagtttctaaatctttctgtgcctggttcctcaccttt

SEQ ID NO: 70952 - DNA, 1033 bp, Homo sapiens
gttcataatatttaatctttccatttgtttaacacattgtaatatagatcacctttatctgagttcacttcttctatactttgtcccactcttccttgaggtgccaaggctcctcatgtcattccctggctgccaaagtctccctaagagaggtgtttcattcaaggccacttccctaaggggctctctctgcacatggccactatgtgtctcattctcatgtgaaacctttgaatgacctgagaacccatctgctaagatatttcaatctcttgggtccccttaatggttgccagtgtgttcttctttcctcgggtaacagttttttttaaatagaggtggtgaggagtggtagaattctggatctatgttaaaggtagatctatctgtctatctatctatctatctatctatctatctatcatctgtctatcgattgatctatcaatctatctacatatatatttggatgaattggaggtaggatataagaaaataaaagggaccaaagttgtaattcaaagatatttggtgttttgacctttggaaagatggagctgatattagtggagatggggaaatctcagttttgaacattttaatttgaaaatctgttggatattcaagtagatatgtagagtagatagttgagataatgattttttttcagtgagggagggtagggtgggaggaagccatgtgataattttatgcttatcagaagtaaagagtatccgttttaaaagaccgaaaaatagcatctcagcctattgtgagtgaatttatgagttctgaactctggatagttgtgttgtgaattgctgggggaaaagaagctgagcatcgccagtgataacaggtgttctctatctttatagaaagctgtgtccaaaaagttgtttccacatgaagaattttgtgcattagcactttctcaagggcacctgctaagcaagtcaactaccttgggtaactaattatcttcagttttgctagtagtttcaaaccatcacctcctgcaggagaaaactga

SEQ ID NO: 70953 - DNA, 1087 bp, Homo sapiens
atctcttttatctagttatctgggtatttatctttatgtctctaatctatttgttttgctcctttttaatgtttcagttttagacattatctattgacatcccactatggaatatggcattcctctctttcctaccgcttactataacagtaccccacacaagcacacacatgttttccatgactatctctttaacacattaattgcaaaatttgggttagattagtcttctctatttacttgttatgtttgtcgacagacattatttataatgttactgatccataggctaaaccctgattcctcttcctttccattacaatgttttatttcccctaggattaattattgtctttcctaattgtgattgattttctatgtatatatagtcaacacaattccagattcatcttttcttaacatgtttatgtgtatcaggtattctatatgcttcatgtctctgaagaatctcacctgagcctttccattcatttaaatccggactggtcaccttctactccttctgataggtatcaaccttgcaattcttctccatcatttggggatttttattgcctctttcctttgttggatatcttgatttctgtatgccatgccttttcttgttttatgcagcacatctcccagtaatttcatgcaaatgtctttattctgtcctcactcttgcttcatagactggatgtgaaattctagtgttgagaataaattccctagagaaattaaaacaatgaccatattgtcttctagatgccattgtcactataagctttgctttaggttgattccattggtccgtttagttggagaagtcttgacaacagcatctttagatctttccttttgaccggaacatcctaggaaatccctcttttaagctcctaatgggaagttcttagggctgtttaaggaaagagggcacacaggaatgtcaacatccagtatacctgttttctcaatcacctattttcattatcttaccataccctaaactgtgattagtttagagaactgttttactcttctaagagaagaaatcttcagtgttttgcaagattgagggacggat

SEQ ID NO: 70954 - DNA, 1048 bp, Homo sapiens
attctttaatatttgggagataattttatgacttctggatgacgtagcccagaatgaagtcatctgaggttgccgtgctgaaccttaggtgtagcagtgtcagcttaagtagctggatgatgcaaacaaactggaggcttgggcaatcagtcagaattcatacctctgacaagcagaactcaacaatctttgttttgtaacacctgagttggagaggtgctcaaatcatggtctcttttggttagatcctttattcatctattgctgtgtggccattttaccacaaatttagtgccttatgcaaaatatttattatctcacagtttcgtgtgtcaggtattcaagcatggcttgggtcctgtgtttcatgttctctcacaagactagaatcaaggtgtcacccaggaatgggacctcgtctgtggctcgactggggaaggatctggttccaagctcacatggctgttggcagaattcagttccttgtggtttgtcaatggaggaccccagttccttgctgaatgctttcaattccttgaccgagagcctcagtttgtaagcctcccttagttccttaccacatggcctttccatatggtagcttacttcatcaaagccagaaagggagagaatcaacagagggtatgtttgcaaaatggaagtcacaatcttatgtgacataactatggaattaacatgccattgtctttgtcatattctattagctagaaacaaaccagaggttctgcttccactcaaggggaggggattacacaaaggcatgagaaacagggataattgggggtaatttcagagtttttctgccataggtccctaacacagaagcgagttataagacattgccaaattcttaatgtttgagcttacaaaaagtaattatgggtgagaattgatgcattcaatttaggtaaattatataatatcataaagtcaagattatataagttttagaggattttacttgaattgtcaaatatttatatattatttattattattttaaaaagcagtaccccaaccatcttct

SEQ ID NO: 70955 - DNA, 2935 bp, Homo sapiens
atgtgtttttttttttttttttttttttctgagacggagtcgtgctctgtcgcaggctggagtgcagtggtacaatctcggctcactgcaacctccgcctccggggttcaagcgattcccctgcctcagcctcctgagtagctgggactacaggcacgtgccaccacacctggctaattttttgtattttagtagacacggggtttcaccatgttggccacgatggtctcgatctcccgaccttgtgatctgcctgcctcggcttcccaaagtgctgggattacaggtgtgagccactgcgcccagccctcctgatgttttcttatatgaacactagcacatcataaggggttatcatctgatgacctcccaacaccccctccttaataccatcacattggggtttaggatttcaacatataaacttggcggggacaccgacatgaggttcatagcaaggaggctttcagtttatcatcaaggaaaatccaaactgcagtcaaaccacagtcctcaattataacatttctatgttatattggactattaaatgtggaaaacatttctgtatgtctgttatttatattactggttaaatgatgagcatttgggttcagttaaaatttaatttcataggatatgaaacatccaacttgctgattgtgatatgacaagtaattccaaaagttattttggagaaataaaaatgtaaggaaatatgttttgtagcatccatatttttaattaatgtgttttacatattaatgatgtggcttgagttttggaagtattttacctatattcttagttcagtttagcttttgttgtctcttttcttccaatagagggcactctgattcagtaatttcaaatacaaaaccagccatcttatgtaagaacttttatttttgaatcggagatttttgtttctattaaaatattagctataatatggtagtttgaacacttttactaatataagttaaaaattaaattcttattatgattgaatgtattcaattggaggttttgcatgtaatataaaggctagctcaagttaaaattgcattttgtcttgcatacattttaattcaaaagtcagtctgttttatatactcttataatatgcatctgaaaccattttctaagttgaattaggacattatataatctagaatgtaaattttgaagaaatataaatatcctaacattctttaccaactcatgaaatttaggttttcgaaagaatgtgaaatcatctgaaaaaattttctattctctttatgttttcccaagccttatattcatgttttttcctccatgtgtataaacaatctatacaattcttaaatgtgaacacagcatgccatagagaaatttgatgataaagatcattagagcagatttcagaatccaggtaccaggaaaagtttttttgttttttttttaaacatttgtaatagaacattacctcatcagcgtatgtctttaagaagtaaataagaagcttaagggatgaaacgtgttatgtatttttttctcttgacacaagcagcatctaaagcttttggtttgaaaggggttgcattggcaggttttgtgcaattttgttcagcaactatgcctcttttctgttattttactttcttttccaatgcaaaatatttaattacatgtcagccttctgaagtgtgaggtattttattttagtattttaagatttcaagatttaccttgaaggattttcagttttttttaatgccaagctattcttgagaatactctctgggagtgaggtccctacttttggaaaatatacttaatttagttctaaaattcatcaagttttaaagatcagtagagtcagattagattgcctaaaaaccaaatggtgtttctgaaacaaagtttaccttcaaacacattctaacccaatttctagagcttattatcaggaatgcatcaatttcagaatttggagagagcttcgtggctatcttacccaatttccatcagatttagagaatcttgggaggcaaattttttgaaatgtaaatagaggcttattataggaacataactgattctttagcatgtataattttttatagtggtgctaaatcttaagcagtggtatacaatgttcaaaagaacattctaacctgaacaatctatttcttatgtagttgaacagaccttttggatgtggtgactcaaggtgattcaactaaggttggaaatctcctaacaggttttgcaagaattagggaatgtagaactaggatcatgttgacctgcatttatatattgaaaacaataccattaaccacacgtatgtactgtaggtacattaatggaaaaatccagaatcagaagggtaagtttttgttcctaccctcacctcaggaagaactttttgtaaccttagggaatctaggaagtccttgagaaaatggctagtagaataaaagagtcatttttctgaacttctagcacacttgctttttaccattcttgatacatctctttctgccttgccttgtaggtgtatatgttttgcattacttcttatatacccctttgacagtaggttcattattagattgatctctgtagtcacatcctgcctcacacggtgccttgaatgtagtggtctctcagtgaaagttcattgactgaataaatgcataaaaaggcaaagactgcatataaaagtgtatatgttcttgcaaatgaaccattatcattgcaaaatgcatttaattatttggagatgaattccagagaccaaagtggaggtttttcccagcaatcatgatgggaatctcaaccatctttcttagggagataacttagtctagcagttaagagcatgagattgtgagtcctacagatttggttgtacaactctgttctgcaatttactagcagggtg

SEQ ID NO: 70956 - DNA, 1671 bp, Homo sapiens
tagcatgttacttaaaaaccccagatgtttttctctcctttagctcctaccctgttcagcagtgattatctcctacacttgttatggattggctgcaagtatgatagaggagggtggtgagataggttttattaggtgtcagttgggaagctgaagaacagcattgttttgcagggagataaatgaattaaaaccaagtcaggcagggaacatgtagatacaatagtcaacaaaggccaaggaggagtaaaaggaatagatgcactatatgtggccattatgctctcttctctatttccaaaatatttcagggaagttcatgcccctacaattttcttatcaataaagaagttaattacaagtcaaatgcatgcagagatgaatcagagaaaaatcccatcatagccttttatataaattaaaattaaaattaaattgaataaaagctaaaaaataagagtggcacatactattttttattagtcttctccctctatgcactttgtatttcatgttggacttttgactctcactgaatttttttttttttttttttttgagaaagagttttgctcttattgcctaggctggagtgcagtggtgcaatcttggctcactgcagcctccgcctcccgggttcaagtgattctcctgcctcagtctcccaagtagctgggattataggcacttgccgccatgtctggctactttttgtatttttagtagagagggggttttaccatgttggccagtctggtctccaactcctgaacgcaggtgatccagccaccttggcctcttaaagtgctgggattacacgcatgagccacagcgcccagcctctcactgaactttttttttctttttgagagggagtctcactctgtcacccaggctggagtgcagtggcgccctctgggctcactgcaagctctgcctccccggttcacaccattctcctgcctcagcctcccgagtagctgggactacaggcacccgccaccatgcccagctaatttctttggtatttttagtagagacggagtttcacgatgttagccaggatggtcttgatctcctgactttgtgggccacccgccttggcctcccaaaatgctgggattacaggcgtgagctaccgtgcccggctgcctctcactgaacttttaaaaactgaagcatgggccaggcgcgatggctcatgcctgtaatcccagcactttgggaggctgaggtgggtggatcacgaggtcaggagatctagaccatcccggctaacacggtgaaaccccgtctctactaaaaatacaaaaacttagccgggcgcggtggtgggcgcctgtagtcccagctacttgggaggctgaggcaggagaatggcgtgaacccagaaggcagaggttgcagtgagccgagatcgcgccactgcactccagcctgagcaacagagcgagactccgtctcaaacaaaccaaacaaaacaaacaaacaaacaaaaaaacaaaactgaagcatgtgtgtaatatgtcttttgggaaaagcaaaataaatgtcacccactagaaaatggggtgtgacataaccatggactttttaaaaacatactgcattggtttatataagatgaaatgttgttacatgggagtaactatctttgctctcctaaatggt

SEQ ID NO: 70957 - DNA, 1063 bp, Homo sapiens
ttttaaatgagtttcccttttgaaataattttttatgcttggagaagaaaggtgaaggaatacagaagtaggaacaaggaatactcaaagtgtgttgtgtgccatcactgagaagttattaaaatttttttattattattttttaaccctgggctagtactacagttagcttgtcaagggtcccttacatactgcactttctttctcttttacataccccttaaatctcttattccaattatctgtaggaatgatgtgtaaattttataaatgcctccttggtattatgataactttttgtgtgtgtgtaaacaaggaatatacttgtaacttcaacttttccttcaaactaaatctcagatatgggctatctggaaagagctctttttttaaaaaaaaaaatgggagttggtatcctcttcattttacttagctcatctaattaatgaaataagttaagttttgcttatatgaattctattaagtagtttaattggttagtcaatgtgtgctctcgctctctttctctctctctctctctctgtgtgtgtgtgtgtgtgtgtgtgtgtgtgtgtgtgtgtgtgtgtgtggcatggggtgatggttttccaggtaagtaaaatagccaaatgttgagtaggcaaaaactttgaaacccaactttatatcttagtaccttgaatgattactctaaattcccacccagcatctagtattcttttaaaattacctatttaatacagtttgtcttgctcagcctattttgttgttgttgttttttcctttttagggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacaggtgcacttgccaaatgtttgctcatgatgtaatttttctagttttacaaggcaaagccatattgaaaatgtgatttttttatctttaccttgcccaaaggcctttccattgctgaa

SEQ ID NO: 70958 - DNA, 1032 bp, Homo sapiens
caggactgctgtgtttcgagtctttttgcaccatctgactatgtgcatgtattactttgataaaactaattaagaaaaaaagctcagaagtaaaagaactcatactttttatacttatacttttccaaacatacagtgttctttgcacagtttctttcctctctctctctttttttttttttgtgagaagcagtgtcactctgtcgcccagtctggaatgtagtggcatgatcttggcttactgcaacctctgcctcccgggttcaagcaattctcctgcctcagcctcccgagtagctgggactacaggcacgccaccactcccggctaatttttttgtatatatattttttagtagagacgagatttcaccatattggccaggctggttttgaactcctgacctcaaatgatacgcctgcctcggcctcccaaagtgctaggattacaggcgtgagccactgcgcctggcctctttcttctttcttgaattctcttctttttatgttcctgggaaaatcctactcattttatatgatttggctgatgtaaagccaccattgtcttcctaagcagagagggtcttgcttttgggtgctgcacaactttgtgcaatttttctgttacatcatttatcttttggggattgtttattttcatacttatctctcttccaggaccatgttagggagaggtgtttttaatttttaccttttctgcagcacttagcacagtgcctaatcatagtaaatatcacgtaaaagttgaatgaaggaatggatgtttgatatagagttaggacacctgtgtccaggtctggctttgcttttccttttgccccctacctcaatcgaagcagtttacatattgctgtcttggattcctcttggaaaaactggactgatgaacttcaaagtccctaagaaattgaaaatgtatgattcttttatgttacaccttaaaatccgtgtataatgcgactgcttcctacatcttgatacttcctagcccttattattttctgttttcaca

SEQ ID NO: 70959 - DNA, 1085 bp, Homo sapiens
gtatatttctaagaagatatatctatttttttaactcgtgatttttatctagaaaaatttagtgattttgtgtgttagctgtttatcagcttatcagctcaaagacaatttgcttttctagaggataattatacttgttgaggggacagcctcattcttcagaaacaaaaagtatagttacagagaaaaaattatataatggcaaaatgctggtctgaaatttagaaattcagcatttctttctgatgaaatgtgatttgctcatgcattgcatacgttcatttgtcaaacattaactgaacattcttttatataagaaataaagatcaagtagagtagcaagtatataggactcacgagtcagaagaccaaggttctaatcctggctctgcctcttggtgactgtgattttggctgagacaagtatccattatgaatcatagttcttccttaactttaatgtggggataatgtaatcttccctgcttgcttctcaggattagggtaagaattgaaagagttctggaaattatagctctttgaataaatgctaaatatttttgtcactattgtgtgcaaggagctacttcacatagtttttttttttttttttttttttgagatggagtctcactctgtcgcccaggctggagtgcagtggcactatcttggctcactgcaacctccgcctcccgggttcaagtgattctcctgcctcagcctcctgagtagctgggactacaggcacctgcaaccatacctggctaatttttgtatttttagtagagacagggttttgccatggtagccaggctgttctcgaacacctgaccttgtgatccacctgcctcggcctcccaaagtgctgggattacaggcgtgagccacagcacatggccatatagaagatttttagatcactgttatgccaggagtggtggctcatgcctattatcccagcactttgggaggccaaggcaggtggatcacctgaggtcaggagtttgagaccagcctggtcaacatggtgcaaccccatctctactaaaagtacaaaaattagccgggcatgatggcaggtgcct

SEQ ID NO: 70960 - DNA, 1188 bp, Homo sapiens
aagttaataaatcattatgtgttatattgctaatgggtgatatcgaactttataagtaaatgttaattatgctttcagtttccagttatacttaatatttttacaacctaataatagtcgtaaactcatagggcagaaaataaagaaagcatttcttctggcaagtttattttggactgaagactcagatttttaagtaagtttttcttggacaaatggacttttaagctgataggaccttgaaaaatttctattccaatttccatgtttgtagatgagaggattggaatttggctggcctggttagtttgtatcatgactcagactgcggtctgggtttcagcttttggttctgggatttttcctactctgttagatgcctgtctgcaaaagtaatgtaagattcttttagctcactgagactcaattgcccttacagagggatagctcaagtggcagcagagtgcagtgaccggagtttaaatcattgctctgccaactactagctgtaaaaccgagaatgatttatttcaccaccctaaatctcagttttctcataaattgagaaaaactgtagttcttgttgtgaggattataaaaaataatatgttaaaatggttagtaacagactctattatttggtgactttgtaaggttttaataagattacgtatttttagcacaatagctggcacatagtatgaactaaatgagtacttgatattattattgctgtcattattgttattattaccattctcatacaatcaaggaagtaagaaattttgaattttaaaatttcagtggataaactgcaggctgataattcagaactctctgtaaatgagtatgtatatatatgcatatattatgggtgtgtacacatagactgttgcgttagatacatgtttttaaacagctttattgagatataattctcataatgttcacctatttaaagtttttaattggatggtttttaatatattaacagagttgtgaaaccactaccacagtctaattttagaatatgttcatcgctctaaaaagaagccactgtacttattagcagtcacttcccattcctcccatctccccagtgtagacaattactaatctactttctgtttcaatagatttgcctattctgtacaattcatataagtggaatcatacaatgtgtggcct

SEQ ID NO: 70961 - DNA, 1142 bp, Homo sapiens
gctgagccttttggccatcagcttgatggaatgctagtggttcatcagcttgatggagtgctagaatggccataaaaggtgagactggtggatcctatgctagtaaatatgacctggcagaggcaaaaaaggcaaaagcatgtttgaataaccatcaggcccattgaggatgaattgctgtgccttccaaggtggaaaggaatttgatgtaatcaacctgccacaaatgtctgattggcttttttgagggatggttctgtattgaggggccactttgggccagtacttattggtcagacattcagcactgtcaatagctagattacccttggtgagagggagtatatgcttttatgcccatgcatagcctccatccctgacattatggctagtcagtttccatgtccactgtgcaaccattgtgatggctgaggacaaagattggctgacattcattggatgggtcatcttttccatctggttgttcaatgctgcctctactatagatgctttgttaggtattcacacctatagggtcatccacatgcctccttctcagacctccttgtatctgatcatgaagtattgcttcttccaggcatctgatcaattagcagaaccactagcccctgcccaacaattgatattgttctcacctcaaaccacttctttcttcatgtaaagttatgaagctctgcctgatggatttcctttcaccactgtcctttagaacagtgctactcaaactgatcatgtgaaggaactatatatgggtttgttttcagttcaacatgagtgatctttttgtaaaatataaaactacagttattacagcaatgtcaaattgctctaatgtttccaaatatgtactctcacttttaataattattttgtcgacttacaaaaataaatttatgaattggcactagtctatggattacactttgagtaacattgcagtagttcatccttgccttgggctatagtgtgacagtagttttcctcttgcaccaacgtatttagctgactcatccatgagccgtatggtttttttgcaggaagcattctgagggtggcacaaattgttattccacctggccaaaatattctttctgatttattatttgggccagggacagagc

SEQ ID NO: 70962 - DNA, 1122 bp, Homo sapiens
aatgagatattttatatattttttcatgccaagtttttgaaatccaggtttttttttttttttaactctgcagcacatttcaatttgggctagctatatttcaagtgctcaatttgccacctgtggctagaggctaccatgttagtacagtgcaaaattatagcagtggatatccatgtctacccctatggggtgaccaaaacagttctgatggtatcctggagatattgctgagtagtatttaagttttctttcctatggctgggtctacctgctttctaatctattattgttatttcctcttcttgtgaatctgtgttttaatctgtttatgcaagcttccaatttatttccatctaaacttataagacccttaggattttctacattatttattgtttattttagttgcaagtaattatgtaaacatgaattaattaataatacctatgaagaaggaaactattacttattaagtagctgctggatgctagatggtacactaggcactttgcatacttcaatctttttttcttccacattctatatattggaaaactgaagatccaaaagttaaataacttgtcctaggccacatagcaggtaagttgcaaaactgggattgtctgactccagaattcatactctttctatcatatcacttttaggaaattgcccattgtaaactttaaaataattgtgatttgaatactagttcccagggcttcattctgatgcctcaagcatagggccagctgaaggacaggtgatgctaaatgataaggattagctagtacaaaggagtttatgtttatttttgaaaactcctagcctggttgatttacctacttcctagggatgaaaatcactggcaactgttaccttgaacttatcctgttaactgttgttcaaaaatgcataacttgtgaaaatttgttataaagacatctttttttgtgtgtgtgtttaggtatgtttttaaggagcgtgtttatagatacatgctaaatgaagacagagctagacattgttactgtctgattacattgaaacctgtattaaaataataaaaaactatattaaataatacttgttcagatttaattgaactttattttaatt

SEQ ID NO: 70963 - DNA, 1052 bp, Homo sapiens
cctgtaatttgcaacaacatggatggaattggaagacgttatgtcaagtgaaataagccaggcacagaaagagaaactttgcatgttctcactcatttgctgaagctaaaaatgaaaacaattgaactcatgaatataagagagtaggatgatggttaccagaggctgggaaggggagtagggcagtggggatggttaatgggtacaaaaatataattagagggaatgaataagacctagcatttgatagcacaacagggtgactacagtcaacattaatttattatatattttaaaataactagagtataattggaatgtttgtaacacaaagaaataaatgcttgaggtgatggataccctgtttaccctgatgtgattattacacactgtatttctgtatcaaaatttctcatgtaccccataaatacatacactatgtacccataaaaataaaacattcttttccacaaacctttcattgatgttgcttatattaactctaattttattttgatagacacattaattaaaatgttctccttaatatagactcaaaactttttagaatatttcactgtttagaatgaatgcttctatatagcagaaaatatcaaagtttcataattacaagacatatttcctgggttagaactgcgtagaggaatatttgtgaattggatattactatcagcatgtgtaccctttctgttttggtaatccctctgtcattctctttttttttaaattttattattattatactttaagttttagggtacatgtgcacaacgtgcaggtttgttacatatgtatacatgtgccacgttggtgtgctgcaaccattaactcatcatttagcattaggtatatctcctaatgctatccctcccctctcccccgaccccacaacagtccctggtgtgtgatgttccccttcctgtgtccgtgtgttctcattgttcaattccacctatgagtgagaacatgcagtgttcggttttttgtccttgtgatagtttgctgagaatgatggtttccagtttcatcca

SEQ ID NO: 70964 - DNA, 2106 bp, Homo sapiens
cacctgtagtcctagatactcaggggctgaggcagaagaattccttgagcccagtaggtcgaggctgcagtgagttatgattgtgccactgcactccagtctaggtgacagagcaagaccctgtctcaaaagaaattttttaaaaaagaaccttcagatgatatataagcctactctggtttgtttgtaatgaatgcaggcccccaaataagctattgtttaagaaaaggtggttattatatctgaaagaaaataggaggcatatatttttacttttttggattaagtgggaatgacagttttcttctacaccttaagcttgccctctctaccagcgtctgcggggccgcttgatccttcaaatttctcatttttacctaacaggcctgatggctcattctgagcatttagtcgggaaatggaaggtccttactctctgagaatgtacaaggcaggaattagcagctgatctttagtttttgatctgttaattgggcagccatactggctattttggcaatattggtggcaaattgccgcttgaatcttacaaaagggtctggctgtgtgaccaactctggttttctctagcatgtgggctggggatttcatgtcaccagtggtgactggatgttcagaatacttgagtttacctcttatgatatgttagcaacttgaataatataagaagaaagatgtgttagtcatctattgttgtataacaatattatcataaacttagtggcttaaagcaatgtgtacttgttgtctcatagtttttggggccaggagtcagggcacagctgacttgaatcctctgctcaaggtctcacaaagcttcaatcaacatatttgccagtacttagttctcaactggggctcaattagggaaggagatgttttcaagctcatttcagctgttggcagaatttaattcctgtggttgtaggactgagggtttcaatttcttgctggctatcagtccagagccagcttcagcaactagaatcgtcctgcagttcctggccatatggccacttgcttccttaaagccggtaaaagacagagactccaacaaaatgggtatgacaagtttgtgtaacataatcacatagtcatgtacatgtatcccatctgtcgtgtcacctttgcttattcttttgactagaaacaagccacaggtcctgcccatactcaaggggagggatcacaatggtgcatggaaactaggaaatggggattatgaggattgtgttcagagcccacctgacatcagaagagaaaggaaaattgggtcgattctgctcccaggattttcttttcacttattatatataacttgagggcaggattcatgactgatttatcatgtatcttctctttgctaccatcacccacctactagacaatgtgttacacttagtagaaactcagttggtacttgcaggcttaactgttatgctataaatctagtatcaaagaaagaaaataaataccccttttctcagaagaaggtatcctagtgctctacatgtatttaatttgggagaatacagatcaccttgttaaatcagtgtagcaatatgatagctgtttgaagatttggaaccatatgccacgttgtcaggaaagactagcaactgtatcaggaggccttcttttcatagtgttctacttctttgtctatcagcattgcctcccaatcagcaggcaaaattatcaagggcttttgatttttgtctgtgagaagaatataagctgccagatcaaaggagaagtgggtatttctaactctgagacttgttttcctaaataatcatattcaacattgtagaaatattaattatgtgtatacttattgaccatgtagctgtagaattgacattttgcttacaccaaagctatgctgtttgtttttcttctttcttgggtagttaagatggaggttactttccaactttggcctggcagaatggcccctgcagagaagggtgggaagaagaagggctctcctgctgtcaatgaggtggtgacacaagaatacaccatcaacactcagaagcacatccatgagtgggcttcaagaagcatgcccctggggcactc

SEQ ID NO: 70965 - DNA, 1053 bp, Homo sapiens
tgccatctcagcttttcaaaactgtgtatatctttccaagttttacctgaaataactgcttccctaagaaactgttcctggtttctctccaccagcctccaaactcccatccaactagccaaccagaggtgatttgcctcttctttgggagagactgagtttggagtcagtcttgaatttgaatctgtaccctacaatatacttggtatatgatcttgaaaaatatttttgatctgcctgaggctttttctcatgtataaatatttcatatggctcttaagagggttaaaagtggtttaatttgttttcttatcttcatttggctttccacaattaatatagctcaacctcacagtatagtcatttgtgtgcttctcctatcccccaacacttagcagctgggctcagattgtgtcttccccatcttaaatatcctgaagccatgatcggaaagtattgatctgattgaatgcaattgaattaagaatgacatatttacagtgctgatccttagctgaagcattctgattttatggtaaaattagagaaattttgtattctccagtttgcctgtttcctaatctctgttacatcgtctatttttattagttcatatctgttttctcctacattgcaaaggaggtgcgatgttggggaggagaatagagtgacttgatttttcctttgatgggaactaagccatatgtttatattgagtcagctactccagcctctgaattctcaatcagatggtcagcagtgtttaattgaattcccaatatgtgcaaggctacgctaggtgctgtcactccagggagatgtaaccatctggaggaactttttcaaagagcctagaatatgtttctttgtatctaaattaaaatgatactaattttggcaaagtaaatagttggcataaaaggtgtcttttgcctctgcctttttttttctttttttttttaattctttcttcaaatctccaataaaaggcatccttctttttttttgctatggccaggatggcatactttttccttgatttctttccttcct

SEQ ID NO: 70966 - DNA, 1179 bp, Homo sapiens
tatgtcctcaacatcctcatcttcctgtgtttctcagcagcatttgatatcattgattgtctttttttctcttgaaacctttttctcccttgacctttgtgacttagtactaacccacttactcttctatttttatcattcctccttctttgagctctttgatagtttctttttcctagcttaggcatttctaaatattgtatcattggatattttgtctttattttatattttgtttatttcctttgatagttgtagaaaccatttctgtataagcagttctccaatttacatctctaattctgacctttatcttgagcttcacctgtgttttcaatcattggatatctgctttattattgtggtgttacttggaattcactgtgtccaaaagcaaatggagagagtgtctatagaccatgtaaactcctcttctttccttcctcaaatctcactgaaatggcagtagaagactttaaaaggtattaacttataaggataaagaaattgggatagcagaagagagatcttaacaaaattttggaagatgaaaaataaaggaagaatgctacctgcagagagttacctttaattttctgaagtccctatagaaaagacattgatgagatgcaaaccctttagagactcacatttggaaactcccggcaccacaaaaactgggagtaaaacacagagcagaacatggatcttggttgaaagtacaagagcctttagatcacccagatacctttctctgctgtgggaagttgggtgaaacttcccttcacctgctgagggaagcagaggcaattcaagaagaatacttccaaaaactcttactaatttcattagagtaataagagaagatattgtacttttaaaacaagaacggatgctatgaaacaggtaaaattagataacaagaaagtagtttggaaatttaaaatttattatgaactaacataaaaaattttagaagtttcaggataacattgaagaaatctcatagaaagtggatcatcaacaacagcagcagcaacaaagaaaaaaaataaacctaagagatggaacataggaaagaaaagaaaattagaggatcaattcagcatttccaagatctgaccaataggggttccatgcatgaattcatgtatccaagccttttgcaggtgccctcca

SEQ ID NO: 70967 - DNA, 1121 bp, Homo sapiens
acatcacttgaggccttttgtggtttggctccctcctaactgccccattttttcaccagttctttgtagcagcactctccaacccgactcaattcctgtacttggtgttttcagcaggcatcatggactttccactgttgcctgcccctgtctctcccagaatgtccgtctttcccttgtgtgctcagtgaatccctgctcatcctcccagactcaactctggcatagtcatctcttcaaggaagctttgcctgatctctctctatggtgcttccctggcaccttgtacatgcatctatttttagcacttagtatactgccgtgtaattatttgtttacatgtttgccttcccactagacaatgagttcctttaagtctgaaactttggtttagttatctttgaaagtgctgtacaaatgtctttattttatgcctagaacatatacagcattcaggagatgattagttgagtgaataaatacagaacagggcacatgctaatgggacatgatttggattgtatctttgagactaattgttgactgagaaggtagtcttggttagcaatgccagtgctgagaacaattaaatatgatatatttgagcacctattatgtgctaggcattgtgcccattgccatacatgttctagtttttgggacagtgagagccacagaaatttaataagtcaaccaggtaagtaattcgactacataagcaacagaattggatttggaatccaagattgcttgactcaaaagccaatgctcttaatgctggaaaattatcagagatgaggagggaaaagccactttaaaacaaaggcaaaacaatgtgtttagggtaaaggcaaatttggaatcatagtttctacttttcactatggattccagagatttgtaggagatattttgggagaggcagtggtaagctcgtgctcttagtaacttttgataaatgaaaaagtaaattgccgataaggtggagggacttaaagaaaattaagcaaagagaaaagaaaaagttgtggtggaaggtgaaggggagcaggcatcacatggtgaaaggaaggaagggaaagaacttgatcaatatgtttgtatcagatttggctaaaagg

SEQ ID NO: 70968 - DNA, 2107 bp, Homo sapiens
atttgcagctttgaacgcagccttttttgtctagttaaatgaaattggcagagaatctcttgcgtgcatgcaattaccctgcaaaagccacagccttcggtggctcctaccttctcttgcagaaggcgtttgctgtgccgtgggttatgatcccacaaaatgaagtgagtgaaccttctttctggtgagatgtcttcagcacagggtgtgtataaaacttgatggggcaggttaggcagccccagcaatactttcagttacctggacatagctgagtgaaacttggttgttatagctcaggatgaaggatgccaggttggtattgggatactgtatatggagtacggtagaggccttttaacgtgaagatgtcgtaggtgagactggtattgcttggagaatctttctaagatgacatttaaaaaaaatgtcaaggtcttcattcagcagtaccttggaaatagcggggttgatttccatacttgagaaactattaaaagttgtattgatggacaaatgaaatcaactgggagggaggaagcctggagagtattcactagatacaattcaagggaagctctttagtttctaaaatcgtggctatccaatttatcctgggtatttttggagtcatcaattgtcattcatatcttcgccttaaaacatctcttggataacccaactatagttgtaaaaattttagaaagcccaagtgatttccctggttttttaaaaactgttccatgctacccttgacaagtgcttaatagaaacttttgggtgatgacattgcgttctttacacaagttctcataggttgtggtggtcagacagtgcaattaattatagggctagctaaaagggaaaatggaaagtttctattacagtgaaataaattgagttgaaaaatagtcgatgggattttaaaaagccccatatgttattctatatactcgttgacagtgacattttattggaatgatagttcatgtcagaagaatgaatatttatgggacattttttcaataggtcatagagatgacttgtgtgtactcccttgttaaataatcttctctttcaaacacaggtagacaatgtgtgcatatttcagattgcagctctaataattgcctgtagtcacatgtagtttatgtgaaagcaatttatctctttacagttttaagttacacgtaaaataacaacgtttgctgtggatccatcagttataaaaatgattatgtctaaaaactggtatgctgaaagaattttctcaaaataaacaatttcttcgggaaaacatgaggaattatttgagaacagtgagaatttcacttaattttattgtgataaatcgtattttaaaaacactccttgtgacaaaactcaaaagcaaacatcctttaaatactcctttcccagctgtgatttttttttttttttttaaagaatagatgtcaagttttagggataaaacaccaagtatttaatgttagtggacactaaagtatcaaaatagtgacccacagtgtatatcttgagtgagaggttttctcttttgctggtgtagtagtagtagtagtagctctacaacaaagattgcacatagaaaacaaaagtaaacaacatgtgtttattagagtacttcgaaccaagttgtaaaaatcacaaacaaaaccaataacctttaaacttgcttttatccatcttatactgaatagtgtctgaagaaaatgagagttgaaattgtattctttgggcaatcatttgcataaaatgacattcctaagaaggcacattttatttagttgtcactttatttcaaaaatgattgtcatcagaaatttattggcaggataatggaaaatgtgtcccccgtcaaacataatgacactttgaaatttcttaatgttttagaaggaactgtagaatatgtttggcactttttccccgcttgctttattacctgggttgtgtaataatggtgtcagaccctatgctaagtgcttacacgtgtcatctcattcaattcttgtgtcagccttaggaggtccattgtcatttcacagatgaaggaataaaaagataagattaaggacttgcccatggt

SEQ ID NO: 70969 - DNA, 1467 bp, Homo sapiens
gtctgtgtccagatttcccttttatagggacatgagtcatattggattagggtccaacctaatgacctcatcttaacttacattaactcaaattagagttcttggtgcccttctcccatatcctttccccagctgcaacctgttaatcttttggtccttacctttttagtaagtggcactaccacccacacagccaaaagcttggcttcttttgattctaccatttccctcaactcatcctcatacatctgcaatccttcagcttgtcttattgcatatctctacatgtatttccaatttatcaatatcttttcgttttcacactcctgctcagtatgaacaacataatttctcaccttcagtagcttcctaacttccacccttgccttgctctcatcagtctttttaaagagaaaccaaatttctacacacactggaagatgggggtcctctttccttgcttaatgcagccatgacttgtgatcccaagaagcatctgaagtgggtagcagctccaaagcattggatgctggataagttgaccagtgtgtttgatcctcgtccatccaccggtcccacaagttgagagtgtgtctctccctcatcatcttcctaaggaacagacttaagtatgccctgacaggagatgaagtaaagaagatttgcattcagcagttcattaagatcgatggcaaggtccaaactgatataacctaccctgctgggttcatggatgtcatcagcattgacaagacgggagagaatttccatctgatctgtgacaccaagggtcgctttgctgtacatcatattacacctgaggaggccaagtacaagttgtgcaaagtgagaaaaatctttgtgggcacaaaaggaatctctcgtcttgtgactcatgatgctcgcaccatccactatcctgatccccttatcaaggtgaatgatatcattcagattgatttggagactggcaagattactgatttcaccaagtttgacactggtaacctgtgtatggtgactggaagtgctaacctgggaagaattggtgtgatcaccacagagagaggcaccgtggatcttttgacgtggttcacatgaaagatgccaacagcaacaggtttgccactcgtctttccaacatttttgttattggcaagggcaacaaactgtgaatttctttttcctgaggaaagggtacccacctcaccattgttgaagagagagacaaaagactggcggccaaacagagcagtgggtgaaatggtccctgggcgacatgttagatctttgtatgtaattaaaaataatgtggcatgattaaaaaaaaagagaaagaaaccagtatgatcttcttaaaatagaatgagatatgtgactactatacttaaaacactagcaatgttcagtctgcttaaaataaaattccaaatccctaacatggcacacaaggctcggtgtgatctg

SEQ ID NO: 70970 - DNA, 2037 bp, Homo sapiens
tataattttcaacaaaaagatggtacaaatgtaaaagtaaaaagcacaaactatacaaaagcaaaatctatggccaagtgatttaaaagcattacttgtacattcctttaaacatttgttgttagaagcaaaagagtaatttatcctgctaaatttggcaccatttgtaattataaaaattttgattaatactatttatattaatttctttaccttcattttttctccttaaggagttgattgtttttggaaatgtttttttccttgcacataagacagtttcataccattcttatagaatcatattaggtgggtgtttgcacatactaaatttataaagctagttttgattaaagctctatgtgagatatatatacatacacaagtcttctataataagagtcgttggtgaattttgaattctattttgttaggaattaaggttgaaatcaacatgaaagaatctcaatcatgcattataaaataaaagtacatgggtgttaagaaacaagagacttttaaagatttaaaatatatttctgatagaatttaactaagtggtgtgtattttaaaattcacattcttaaacataaatctatccaagatagaaaatgaaatagctggactactctttctttaagatacttgaaaattttaaaccacattgcaacactttatggtgctttgcgtgtttggcatgacatacacagtggtcctggtatataagtgcttgggggaaaatacatattttgtttacattaaattttgaagtgatttaggctttattgaaaacaatactggccttccctccccttctctaacatccattttcatttacgttatttaaaatatacaggcactgttttgggtacagaggatatagccaagagcaaattgatagtagtttacctcagagtattaaaaaaatcataataagtcatgttaatctaaaactatataatagccttagattaaatgtgcagatgtctaattaaagatttaaaatgtatagcgtatgtccttagaacatttgatttttaggtatacattcggcaaaaacagtctgttatggaaaagaaggattgatgggacattaacttcttccgagctaacattgtttctgaagattgacctattctatataaatttaaatttttctatgtttttctttttttttttgcgatgaggtttcgctcttgttgcccaggctggagtacaatggtgtgatcttagctcaccgcaacctccgcctcgtgggttcaaatgattctcctgtctcagcctcctgagtaactggggttacaagcgcccaccactacgcccagctaatttttggtatttttagtagacacagggtttcaccatgttggccaggctggtcttcaactcctaaccccaggtgatccgcccacctcggcctcccaaagtgctgggattacaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaactacctaaaagataggatgatttttgtttaagtgaatcccaaactagcagtctgagaaatacaggaaagcctgataattgacttaccagagttggctttttttttttaagt

SEQ ID NO: 70971 - DNA, 1087 bp, Homo sapiens
atgaggaaggtgcaaaacctcaggcttttgttacttcttgagaaatggcttaagagtcactttaaatgtctgacttatttctgcttcacagccaacatttgaatgtatagttaggtacacaatcaaacacacactaagtatctgaggcatgtatcacaccttagttctatcataatgtgtttttcttgttatcaaaaaaacagaaaatacagaaaaatcaacattattgtagtagaaagttgccataaaatattgaaattagtgtgtgtacgtatattgtatatgtactatagagtatcatttaaactagggggaaatagtaaaactagtattattttaatgtactacatggcacataattgtaatattattgaataatgctacaaacatttttgtatgttcattttccttaggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagtatgttaataaataattttatattttcatgttccttttccttatctggactttcattcatgtctaagaatgtgccttctctataaaatatattctatcagcatttattaaaatgattttgtcttttttggtaaatgatgtagagatcttttttggaaattaggaaatatataacaggcaaaatataacaggcagttttctcgctatatcagctgaaacatataaagatacatgtgttatctttaactcattaaaaatatgaccgaatgaagtaacatgtcaatgttatttttctttcctgtaggatgatagtccccggagtagtacagtatcccttgaaccagctcctgtaactgtacatattgatcatcttgtggtagagagaagtgacgatggctcttttcatatcagaggtatata

SEQ ID NO: 70972 - DNA, 1022 bp, Homo sapiens
aaatgcctccccccaatcgtttttcctttgattttacttttctaaatttgttttattcatattgaggagtggaggctctttcttttttctgtattgctttttgtatttttatttttatttttttagagacagggtctcactctgttgcccaggctggagtgcagagatgtatccatagcccactgcagccttgaactcctgggcttaagtgatcttcctgtcccagcctccctagtagctgggactataggtgcacaccaccacacctggctgttttaaatttttttgtagatatggggtctcactgtgttgcccaagctaatggtttcttttaagccctcctgatgcagtgaaatacttctgggagacttgaaaaatatattatgtctagcttttaatgaaaaacattttacaatccttgtgacctaattttttttttaagtaaatgaaaggttttcactataatgtaacaaccgtgttctgtaggtcacaagtatacttttggtctggtaggtcacaattgtatttttagagggtaatggtagtttcctatattatttcttaaattttgttttgaactgcttggcatactaatattatttatgcaatcattaatagatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggtaagtttttttttttaattatttttcatatacaatggtttaatatgttttaacttttatatatgtctcaccagcaatcctatcttggctataattgaattcaaggaaaattacatttacttattattagtagttagtggttttttctatagtgtgtggagcttcaataggaagacatagcttaatggttccatggtataaggggtagtagagaggagtgattttgatgaagaaaatttttgttttgttttat

SEQ ID NO: 70973 - DNA, 1118 bp, Homo sapiens
gagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaaggtaacaacattttattggcctttttaaaaattaatttattttgtggagcgtgtgtgcctatgagtgtattttgttttgaggcagaaaagctcatgacaaaatatggcattgttaacatgtagaagagtagatgtttcaaaatatgaaaacactttgagcttatacgtttaaatataatttcagctatggatgctatatacatattttaattctcttagaagtattttttagatagaattcttttctctatatgtaataattttctaataattttgttaacagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggtaaagttatgatacggcttaagaattcatattacgtacatacaccttaggagaaaagggatgcttttagttatattcagtaattgttaactgtacccatgctttttaaagttactgaacataactaaaaataactgaatatttctacttatatttagtaattgttaattattaataatatttagttatttttagatatattctaattgttcattatagccccccaaaaagacttatttatacatacagggactatgcaagagtacctaactttcctctaatggttgttccattgtttcttttaaccagatactcctgcctctctatggctgagatccagcaattatatgtatgcagtcatttagaccataaagcaggcgacattaaggctaccagcctctattacagagactcctatatttggaaatttgattaggtgggcttaatttgca

SEQ ID NO: 70974 - DNA, 1362 bp, Homo sapiens
gtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaaggtatcatacaaacaagtagtagtaatgatttaattttgttctttttattttatgatttgtgcgtatatgtatgttacattgattattaattcatgttatgttttttaaaaagattctcttcttagtggtcatgtaagtcccctttactcaatttaataagatttgaggggaagagttagtgttttacgtcttaataggaaagtagtattttgggggaaaggtcaagaaaaagaatttctgagctaagtcatgttcttttatcttcaagatgtatggatttgccagttggatgagattaatttttcttctcttctagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatac

SEQ ID NO: 70975 - DNA, 1062 bp, Homo sapiens
agtctcgctctgtcatccaggctggagtgcagtggcgcgatctcggctcactgcaagctccacctcccaggttcacaccattctcctgcctcagccttcccagtagctgggactacaggcgcccgccaccacgcccggctaattttttgcatttttagtagagacggggtttcactgtgttagccaggatggtctcgatctcctgacctcgtgatccacccgcctcggcctcccaaagtgctgggattacaggcgtgagccaccgcgccggccctgcatatagatctttctactgcttagtgtcctgggttcctttttcagtcccacatctgctatcggggttctttctgtgctctagtcttgggcagcatttgctccctagtctactctgtgactaccatcatcaatcaatctacgttgagatattccctttacttcctttccttccagagtgtgatgcagtctctgcagcacccactttatttctattcccaaaaggcaggcacctccacttcacaattgcatgtctctgatagacttaaattgtaatttttctctgtttgtatatgtctcatgtaataaactacgaacttttaaggaaaaaggaccatgccctatttttttgttttctttgtgcttagggtaagacaatgtagttgacattcagtgaatcttaaaggaaagtgaatgaataaataaataacataagcaaataaaccatattcaggacattgttacagtgttccctctccactggtatctcacacctttgatttatttttcttaaatttagtctaaatgctctagatatgcataactttagcttttgtaggaataaatatgtctgaatttttagaataaaagatcttcaaggtgctctgaaaacaaaatgtcttttatggtagaaaaatatgtatatttcaggaagtgatataccctctaattgtaaatattagtttattttaggagagctatgaaagagtgaattcattttattattcaggagatacttggtttttacattactccaagcactattataggccttgattaaaagtgggg

SEQ ID NO: 70976 - DNA, 1038 bp, Homo sapiens
agtggcacggtctcagctcactgcagcctctgtctcccgggttcaagtgattctcctgcctcagcctcccaagtagctgggattacaggcatgcggcaccacgcccagctaattttttatatttttagtagaaatggggtttcagcatgttagcgaggctggtcttgaactcctgacctcagatgattcgcctgcctcggcctcccaaagtgttgtgattacaggcatgagcctagttttaccgtttttaaattttagttttattcttaggtaattcagaaaatattttagggaaaatatattattgatgaaaaataagatgtactatggttatttttcatgactttcgactgaaaatacttagatttttgtgtgaaatttccagtatttaaattggcagtgataaggcagtttcgaatctttttagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaaggtaaaataacttgcttatttcaaactattttggtttttctagaattgactacaaaactggattgtttattaaatctgttgtgtaggatgtcctgtaagataatttgtcataattgtgttcatatgaatatatagatgaaaggcacaactggaagcatatattggtatgaaattttattttgctttagcagtacttaagcttaattatttgttagctatcaatgctaacaataaaattagctttaaaaaaatcagactgaatagatgatcctctaggaggatgatgaaatattagactcgcctttgaattaactttttgataatgttgaaattgtctccaaattaaattttagtccatacttaattcataattatttgtagatgtgttttcagcattgcagtttttctacctattttgaatagaagcacaa

SEQ ID NO: 70977 - DNA, 1004 bp, Homo sapiens
attactttttttggggagggtgcggggagacagggtctcactctgttgctcaggctggagtgcagtggcgcaatcacggctcactgcagccttgacctccctgggctcaggtgatcctcccacctcagcatcttgagtagctgggactaacagcatgtactactgcgcctgcctaatttttgtatttttggtagagacagggttttgccatgttgcccaggctggtctcatactcctgggctcaagctatccacctgccttgtcctcccatagtgctctgagattacaggcctgaaccattgcacccagctctctgtattactcttaatcattcatttataaaatgtgcacattttaatgtctttactctagtaaatctttccatttaaagccctattttaacttctcagctactcagaattgaatttttaaattccccaaactaaaatatgttgtttgtttcttggtaacgtgatttcatgcatttgagctttacattaactgaattacttagattaaaagtattaacagctttacatatgatgaatatgaatatgaagaggtgtaattgaatttgatggaataatgcaatttacaaaaataaaaacatggtgaatatatctaaaatgtcatgtgaaaattaactgagaatatacatttgctttgtttttaaaaatctacatttttctcattctgttttgcatgagtaagtgaagttaatctctgtgttctccttaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaagggtgagtcaacaagattacatttttgattcatgtgttaactgttggatttgactttttgatttgtgtgttaactattagttaactataggaaattttaaacaatgtcttaggtgaaatattggcat

SEQ ID NO: 70978 - DNA, 1056 bp, Homo sapiens
ttgctttccacaggttgtattttgatagatgaaaatcagatgctaatacagcagaagtatggggatcatttcataaagtctttttgaaaagttagaagttattaaatttttaaaaatatgttgtctgcttttttgcactcagtgaaatttaaatctagaactatacatgatttttctacaacaggatttctgcattatttttgcgttcacattaattgttgacatagatttttaatgtgattaatgcctcctcatattgcgtaaaatagcagctctgaacatgtatagtattctaggtgttatgtaaaacaattgataaaacttttcttgaggatgaatgcattcgtgtgtgtacacagacacacactcacttactcctgttttacaaaggttgagccacctttatgttagtgcatgccatgagaatacctacagtgcatgccatgggaatctaatggtgattcgttccacttctaagagttgactaaaggccaggtttatcagatgtgcagtttatatttggactacagatattagtgactgggaaaagagctttcatgttaacttctttgtaatgtagcatcatcctgcaacttcagattttacaggttagattatgatttcagttttcatagaatagttgttggcctttaggttggctagagtcggaaagaactaaaatgaatcattttgtccttgtgtgcttagtatagttgatagtgttcttcctaattcttgtttttatagtatcataagctttataattttggctttctaatcatgtgatgatttaaactatttaaatcatcctcatattttgacatatggcagtatggttaatctatttcagcattttttcagacttgcctgattgtaacagtcatttagagtgcttattaaatctacaaagtctctgaagctccttttcttgaatttctgattcagtaggtctggaatggatatcaataaaatgaatacattcattgagtggtgttcagagtaaaaaaaaaaaaaaatagaatgtgaatatgtatttttgggtctcactctgttgcc

SEQ ID NO: 70979 - DNA, 1024 bp, Homo sapiens
agaaaaatattaccctgagaaagaaccttttccattatgggagtgtttattttttttcacatttcctgcttatttcatatttcccatagttttgtgtctcatagctcagatcttagattgtgataagctttttggggtagttcagtcctacttattaatatataatttcatcaatgaatatatctgggagtagagattctgttttcatgaaatctgatgattttagtagttaatggctatgtcttaattccccaccccccaacacctgtaatacacatagcttttccaccagataataaatgccttgagaactgattgagtgctttgtgttcttttttggcatttgtctttttagacctgtagagaggcacttaaatgactctgctcactttttactttcttcctaaagaaaaatgaaagagaaaataatcttaaataatactttaataatatacgtagaataaataatctaattgtttatattttaacgtttttattagtccctggataaagtaataatggaaatgagtacatgtgaagaaccaagaagccctaatggcccatcaccaattgcaactgcttcaggacaaaggtaagctacttccattaatctgcatgactgccaataacaggacattaaaaaaaaaaaaaaaaaaagccttaacctcaaatggcctctatttcagtcagctctcccatcaaacattttacaattttagttatatacattgcaaagttgcagatttgacttttaactttctttattcatcttgctttccttgctattattaaataatagtgattaactaatggcagagcagcaacagaaaatggaagcagaagaatttaggcattatataaatcagatagcctctgatcagtttctctgcatatcattttctgtgcatcagtggaacttttatgactcttaagagttaagttgggaggctgggagcggtggctcatgcctgtaatcctagcactttgggaggccgaggcgggtggattccctggactcaggtgt

SEQ ID NO: 70980 - DNA, 1026 bp, Homo sapiens
tgaggccaggagttagagaccagtctagccaccatatcaaaacactgtctctactaaaaatacaaaaattagccgggcgtggtggcacttgattgtaatctcagctactgggaggctgaggcacgagaattgcttgaacccaggaggtggaggttgcagtgagccgatatcgtgccactgcactccagtctgggcaacagaaagagactctgtctcaaaaaaaaaaaaaaaaaagaaaaaaagaacttacaatttctattcaaaagatgtctgaggagatatagctagtaataatttcttaaataaaatgggtacatctggtttcaaaagtatgagtgagttgcttagtttattttgtagtttaagaaaagtgattttatataatttggtgtgtctgtcctatattaatataacacctgtattgattactgtttacattattttcttcttaatgattgatcttaaattaaaaatttttcatttgtagatcccatggacaaaactgaaaacacatcccatctgtttggtgagttctgaaaccactttagaaataaacatttatatatatacattatctagctactctgttcatagtaatcttttgtttcatggaaatatagtctggatttttcaccagttaggtttcattttattttgataggactcaggtttttcatcctttaaatgagaagctttaaccttaaagtaggagcatctttaaagtttttcaggtctagaatactgtgttctaaattggtatagtattttattgcatcatttaactctttgttgatgtactatgggattattctttcagtaacatttgatccagactgtctttgtttctccttttagtgatctagtaaattatgaaatatgttctttaatatactttgctttttaaggaaagttgaagaaaattgatcatttgttcgttcatttaaaaaatacaatgatcaagaacatgaataaaacaagacagtttcagataataataaatgctatatatgaaatagagaatgaaga

SEQ ID NO: 70981 - DNA, 1590 bp, Homo sapiens
cagaaacagatagtaagtacataaataggtgaaatactgtgtaagtacagtatatcagtgtgttaaatgctactgaaaaagtaacatagggaaaggggatgagaagtacaataaattggggatggagtttgcaattttaaatctggtgattgggaaggcttaattgacaaagcaatatttgaggccgggtgtggtgtctcacctgtaatcccagcactttgggaggctgaggcgggcagatcacttcaggccaggagtttgagaccagcctggccaacatggtgaaatcctgtctgtactaaaaataccaaaattggccgagcgtggtggtgcgcacctgtagtctcagctactagagaggctgagatgggagaattgcttgagcccaggaggcagaggttgcagtgaactgtgatagcaccactacactccagcctgcagagtgagaccctgtctcaaaaaaaaaagaaagaaagaaaaaaaagaaagcaatatttgagaagagacctgagagagatagtgggaacaaatgcaaagggtccagaactgggaacttgtttgatattttgaaaacatacgaagaccaccaatataggtggagagagtaaagtgagaagaggaagatgcgatcaaagagaaaacaagggccagatcatgtgggaccttgtagtgactttgacttttactctgagattggaagccactggaatgccttgagccaaggatcactctggcagccatgtgggaattaaataatagaagcacaagggcagaaacaggaacccaattaagagatgttaactatttaggtgagagagaaattggattgaacgaaggcagatgcagtggagttgttgagatagtgatagtcaggttctaggtgtattttgaaggtaaaggcaggattgaccgacaggtaagatgtggattgatagagaagagaggagagcagtaatgggtgaccatccagagtttttgacataagcaacataagcaatggaaaaggtggaattgctattaactaaatcggaaaattggagaagactgcaggaggagcaggcttatgggagaagatcaggagtttgttttggatatgttaagttggatgaaagttcgatttttttttttttttgagacagagtctcgttctgttgcccaggctggagtgcagtggcacaatctcagctcactgcaacccctgccttctgggttcaagtgattctcctgcctcagcctcccgagtggctggaattacaggcagccgccaccatgtttggctaatttttttttacattttttatttttagtagagatgaggttttatcatgttggccaggctggtctcaaactcctgacctcaagtgatccacctgcctcagcttcccaaagtgcttgggattacaggcctgagccactgcgcccagcccaaatgttagatatttaattggagatgtcttctcttttatttgtgatctaatttagactatacatgttttagtctgacaacaatggaagtatgtttgtggttatcctttggcttatgcaataaacaattactgggaagcgaattgtgagttgaattttcagggg

SEQ ID NO: 70982 - DNA, 1074 bp, Homo sapiens
gtctcctcaaatctgactgatcattggaatctcttggggcacttgaaaacaaaacaaaacctgtatccgtgttctcagttcctcttcctagaattgcctgtttcataagtttgaaaacttaaaacctcttccagatgattggatagtcaactaggaaatctttctttttagaaaaactctccttccctgcaaattacaacctatttgtttattggacattttcttctaaactctgccagtttcttccttgccaaatcataagccgtgttttctcaagtgagtaccttatgcaataagccagtagaggtgtggttattctcccagttgaccattactttactcatctttagaaaaggcagaagccatataaggttttttattggcttttgaccttgtgaacacaatctggttatggactgtgtgggcttcatttactcaggatacactctgttgctgattctcatatataatgtgtattttaatagcagatgagtggacaaagtcagttggaactgggcttttggcagatgatacagtgttaccgcaaatgtttattgtagaaagaatggtttaatctttgtcaatttcgttaaaatgtacaccttattcagagtctgtgttaaatcatcttaataattttttaaagatttagaaacagttgtattttatatattggaattttttatattgttttgattttaatacttgattaaaataaatatttatttgagagcctttattcctagggttttgttaacacttgaattttgatagtttcaagaatatttttaagtagctgggggaagttacatacttgattttctagcactaatggtagtaacaatagcaataaaaataggcctgtaatatcattacagataacaaccaatagaaattccagttttctttcttatcagaaagaggaagcctactaatgtataatgaattcgactgacctaaattgagaaaatcgtcctcatcatggattaccactttctgcagagccagtataacatacactgatcatttctttaattgtactggaactaactttttgtttggtttgagacggag

SEQ ID NO: 70983 - DNA, 1049 bp, Homo sapiens
ttgagcatggaattcccaaatgatcaaaatctaaccatttatatccaggttatgagtggtagtatcatggaaggaatattttgtatgtgctttggattatgatatgaatgaccttgaacaagtaatgtagccttgcagagcccaattgcatcattaatttaaaaggaaaatatgcccgtgttacagggttatatgagagttcagtgggataatgtatgtaatatgtttaatgaatgacatgttgctgtcttgcttactattattcaagaattcatggagtatctactgtgtgccaggtacttttttatgatagttagtggatatgtgatggtgaacaatataagctatgaaggataatatagggtgatagagaatagtgaaggatctttttatttgggaagcagagaaaacctctcaggaagctgaaatctgaatagagagtagatggctgattatattaagggacctatccttttatgggaggacaactgcatttataagtcaaatgaaatgaatgtctttacctgaatctaggaaagctgatggttgtaaaattgagagggaccattattttaatgatttagaatattgtggaaggagattatttttgcagccccctcagcactacagctcacagattgggtgggttagcagaaaataaataacaagaaaatatgagtcatggttgtttaaagtttgttatacataggcctcatataaagttagcattataaggtaagttcaaggataaggaccatggacttgcttacatcatttggaaactaattttgaatagagattgaatacatattaaagaaatgtagagatgtaggctctttccagaagggaaagggggaatcctaatagaatagagccacatatccagtaaacacctaaattaggggagtgaaagtagacagtactagaaacacaagacatagtaaatgttttttatttagaatgtgttctttgttccctagaaactagaatcattgtaccattataggtatattatgaagttctctcttgtctctcctcctttttttctt

SEQ ID NO: 70984 - DNA, 1117 bp, Homo sapiens
tcagaactaactagtattggttggatatatatcatgagtgggtcagacactgctaggtcaaacttccacacatttgtttaatcgttactacaatcttttgaactttttaactaaatcacatagctaattagtgaaagaacaaattgcaaacaacagtctctatctgagctcatacaacttttgaagcctgtgtatcataaaacatgagccagaccttcacatgttcatattacatattacagtgataatttgtcttccggaagagactccagtaatctcagttgtaacggttcttatttctcattttgttgcatggacttttttacatttgggaatttgggaattttgggattgaaggcgtgatggcatttttacttgcatgaccgagtagaaatttaaagatagattactactgcttgatagttgtttggttgaatttgaagtaacccatgtaattccttttcttactacagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcaggtatttgcctataaataatttgcttgcattaaaaaatttattaaatgtgtctttgatttttttccaaaatgtgttcaggaaattctttaaatgacatgagtatctcattttaagtttgcataagatcagcttaataatttattatatttttattttaacaaatttataagtaacgcagactaggccaggtgctctggctcacgcctgtaatcccagcacttggggagacccaaggcgggtggatcacttgagtccaggagttcgagaccagcctgggtaacatggccaaaccacttctccacaaaaaaaaaaatacaaaaagttagctgggcttggtggcacatgcctgtagtcccagctacttggaaggccgatcagggtgggaggatcacttgagcctgggagtttggggctgcagtgag

SEQ ID NO: 70985 - DNA, 1060 bp, Homo sapiens
ctttatgtaccatatatatactttgtagaaagttacaggtttaggaaaataaatacttgtttttctcttgcactttgaagtatttgaagtatttttgattattttgttatttaagtctttaatatgtaggtgctttgtgccagttgtttctctccattttattgctaataactacttccactagaataggaaaatgcttacagcaccatgggaataatgtgtatatgtattgtaagtgaaaaaagtaatcagtctctcatgtatataatatatatttgctagattgaaggtaatgttggatttaagagcagtagagtcacacacctgggttgaattggggcttctttatctccttacttgaagtatgacttgtgtcgttgccatcttaaagcttctatttcctcatttctaaaatgaaaaggattgttgagattaaatgaaattttctggcacatagcaggtattattacatgtttgtagcattgtataggaatagcttattagttatatatcaactatctaatttaatggttttatgattctttgtagtccttcccttgaaaggaggggaacagaaggaagtatgtggtggtaaggtgagaatttctgtgaattagggaaagaacaagtgagggagctgtagcctgtgaagcagggttcccccaaatggtcaaggtgtcatgagggaaagttggtggagccactgttccctaagctatgcatcagtcaagatagtaccctaaggatcctataatctgaattcttatttgcctccattcttttttctcttagttgtccagttaaaaataccttttgggccaggtgcagtggctcacgcttgtaatcccagttctttgtcgtgtcaaagcaggcagattgcttgagcccaggagttcaagaccagcctgggcaacatggtgaaaccctgtctcttcaaacaaatacaaaaataagccaggtgcctgcctgtggtcccagctactcaggaggctgaggtgggaggatcacctgagccctgggaggtcgaggctgcggtaagctatgatcgcgccactgcgct

SEQ ID NO: 70986 - DNA, 1145 bp, Homo sapiens
ctccagcctgggtgacagagcaaggtcctgtctcaagaaaaaaaaaaaaaaaaaaattaaacactcctttcggtatgttgttttaaaaaactgttgtatgttatcatatggatatatgtaacagctaagagaattacttgagaggagtatttttacatgatttcatacttgattttcccttcttctgagagatagcaaaacttatgtgttgttatttaaagataaacgaggacttgtgttatcaaagaaagagattaggaatgagatcagggagtttggatgtcatacactagttattatgacctagtatgactttgagtaatgtcttctgagctttttttctcatctgtaagactgaaaagtgattataaccattcatttttcaaagagttgttgaaaggaccaaataatatatatgaaaatttgtttcaaactatatgacagtttagccatgcaaatgcaaaactttgtaatatcagagagaaaagatgagtctttccctaatattgattcagtttattttctttataggagctctgtctaaacatcattccaacctttgcaaatcttatagactacccatccatgaaaaacgctttgataccaagaattaaaaatgcttgtctacaaacatcttcccttgcggtaagtaattgcatattaatttttgtttttcttttcacttgtcagtgctttaaatcattttcttattgtttaataacccttttatagattgttgatgtatttcatcttggctgtagataacttgtatatagtactataaaaatgagctgtagttttctttgatacataatttataatattgcattcctaaccttacttgctgtccctttactttgagtgcttcagtaaaaaagttgggtgattatttttttcttaatccttttctgctttaactgaatttattttgttgttagtttaaaaatattatgagagtttaacttggtatctaagcgtaaaaacttgttgaaaagtttccttttataaatagcctttatttttagttattggtctctaaatgtcttatttctcactgacttgcccacttcttaaaaaagtagagtacaagaaagcaataaattaatgtgaatacaagtaggataaatagttgtgctaaaaaatgt

SEQ ID NO: 70987 - DNA, 1102 bp, Homo sapiens
gaggtcttaataactgtatatttggaaatagaaaacacatatatggataccttcacatgttaaaatatttagtttaaaaatgaattgaacccaagttagagtaaaatactggaatgtgggtgaaaatgatcacttggtgcaaagaatgtagtcctttttattattcaaatgtccccaaaggagtgttcttatgatagtaacacataatgtagtaaaagtttctcaaattctaatcactttaaaatgctacaagattgtagtcattccttgactttagctcactagtgacctggtgaagcaatcataaattctttgtgaaacaagccaggaaaattagtaaataagtgaatttcctatgttgataaaggatgagagcttctaaatctacatttattcttgagactttaacatatttatatgaagattaagtttacacttaaatattttgttctagattttgaaaacttttaatgactaatgcaatttacctcttttaataggttcgtgtaaattcattagtgtgcttaggaaagattttggaatacttggataagtggtttgtacttgatgatatcctacccttcttacaacaaattccatccaaggaacctgcggtcctcatgggaattttaggtagctgaaaatttaatgtcatttgatgctattttatcatgcaaataaattttccaatctataaaacaattatactctcctttcgtgtatatagcatttcataattgaagaatgatgtgataaataccataatataacttttctctttaagtttagcaaaagcagtagaatcttgacatttataaaggaataagatatttaagaattctagctttacgaatatcatgatagcatgtagttttccccataaaatggtacaaagtgagagaggcaaacaaagctactggaaatgctgatactggtcttagtagtaatatctgaggtttatttgatactcaatttgtaagaggcaaagtattttctctgcgttatgttattttattcttccccaaattcaattaaataggtactattgtttctattttataaggaaactgaggctcagagaggtaaaataagtgattcaaga

SEQ ID NO: 70988 - DNA, 1050 bp, Homo sapiens
agtattgaaaacaatcttaatcttaatcaggtaggagtatttttgtgctttattcattttattcagcttacttttttcttggcattagatatataaatatattacaaagattggttaaaaaaaaaagggtgaggggagaatatgccacagaactaaatgaagaaagtttgtgggtggaaggatagattgttaaagacgtcattggtaaatagtaaatgagcaggatgttgagaaatatgtaggatttgggactactttaaatttggggctgggaaattgacatgaatgaagaacaaagttatagaatgtgtttggggagtatattcattatttattgattgctacagaacaaatcaccacaaacttaagggtttaaagcaacacacatttattatctcacagcttctgtgggtcaggccagaacatggcttagctggattccctgctcagggtttctcacagtgctgtagtaaaggacttggggctcgttcaaggcccagctatggagtgatctacttctaagcgcacttacgtggttgttggcaagattcagttgcttttgggctgttgtacttagggcctccattcttagctattagctggatgccactgtcagttcctagccacatgggactttccaacatggcaacttgtttcatcaaagcctgcaaaagagagtctgctagcaagactgaaattatagtcccttgtaatcaaggaagtgataccccatcacctgtgccatagtctgttgctttagaaacaagtcacaggttcagcccacactcaaagataggggattccacaagggcatgaatggcaggaggaggagataattgggaaccattttaagagtctatatatcactgggaaggaataattcaatttgattggcagatatatataatacagtaggagaataatgggagaaagataaattgagactagaataggtagactttaaatgcctgtctggtttaggtatttgaactttcaaggtgtggtaaatgtttgagtaaaggaataatgtgtccaaagattattatggaa

SEQ ID NO: 70989 - DNA, 1069 bp, Homo sapiens
tgaatgaagtaccatagggatgaatgatcagcagttgaccaaaattaaccaaagcttaaactatgttaagacatagtgctaggtatgctttatgaaatctaattatttgaaagttggattatgtacatttaatttttcaactgtcagaaaacaggatttattttagccagatatgtcattgcaatctgaataagcaggaattttctatgcctattaaatggattatttctagaaggcacaaattcagatggttaattttgaattatcccaagaagatcaatatataactgctaagggtgaatttatacaaggcccctgaataatagctattaaacaactccgggagtaaaactcattattgagacatgttttctggaacttaaaagcctcatcaactatcatatcatcaccaaagatattataaaagcttgctatgatatgccgaatttaaatgtatcattcttattgaatatcagcgctgtgactggatcctattctactggtaaaaatggagaatattatgattaatttactgaattatcttaattgattacatttgctgctaacttgaaacattgtaaccatatcaatttctcattataccagttcaattctttcatttccgtcataaaagaaatgcttaatagattggagtctgaacataagactaaactggagcaacttcatataatgcaagaacagcagaagtaagtaggttgcacatgaattatatgtggtccgggagtgaaattatagttgtcttatgattgattttctggaatatggaatagaaaacttgctggatttaaatttgaccacatgtaaaacatttcaaaatttaccatcatgttaataagttgaactgaattaaaatagaatgtggttgaaaaatctagtgtcacttctgagtacaaaagtgtaatatggtataattttagcattttatctacataaagaaaattctgtttctgaaaaatttcttgtcagcagtagccactagcattgtaaactcaggttgctgaaaactaaaagcaccaattaggaaaattttttaaatttatgaacttct

SEQ ID NO: 70990 - DNA, 1189 bp, Homo sapiens
ttaaaatgcattataggtagaaataaatttttaataacaagtatttatatttgagttggcaaatgaacccttcctttttcttcctcctatctaaatcttacctatttctcaggacatagatctggctcacataacagtgattatagcattcattgttagtatcacagactcagaacttaatcacattgaattccccatattatatcttgtctttgagtgagatgttaagctctttgacaagagaaccatgcttgactggttttatgacaccttgaataaattctccagtaaatccccaatgttgagtttaagaaatggacttacatacaaatgttatttttggggcaagcagacattaacagtagaaaataatggaaaagatgactcttcttaaagagtttaattggggtctaataaattccatgtgaataaataatttttggcatgagtatttaaaaatatgcatttctttttattgttttatcataattcaactctcctacagatctttggatataggaaatcaaatgaatgtttctgaggagatgaaagttacaaatattgggaatcaggtaagaagcagcttaatttttgcagaaagtatgcttcatctggagggcttttaatctttaagcagcaaaatcacatttttattgaacttatttaaattattgacatttttctatttcagcaaattgacaaagtttttaacaacattggagcagaccttctgactggcagtgagtccgaaaataaagaggacgggttacagaataaacataaaagagtgagtttccttactgttctttcagccctcttattttatgctgtaggacttcctgtaaaccacagatttttgttgggaaatactgttcagcagcttaacaagaaacatttgtaattatctttctgaaattcctttatcagttaaacatgaccctaacccattttgagaataaacatacttaagatttttagcttccattattacttgacttgccacaaggtaatatttatagactccttgactcctttgtcctttctcttgtactttgccagtcacaccccttggtgaatcccactgtctctctttgcttctgctcctgtgttgatggattctactatagatttgtgctgtccagctatcctaggctgtctctgattgttgctcttcagtattttaatttct

SEQ ID NO: 70991 - DNA, 1973 bp, Homo sapiens
aagacaagacatcaaatttgctgtagacatcagcagtgaaagaactgctaatgttgtttcattcattctttgctttttgtgagttcctaaaatattcttggggtgagatagattagagtttaaatagatttcccaattttcaagaatgaaatcactaaatcttattgtcattgtctggaaaaaagtgattctaatgaatggttttaaaataattattattttcatgctggaaatacttttgcacagatcctgtgagtttttatctaaagttaaattatatagtaatttgaaatacagcttactgtgacaatcaccaagacaagagtagtttgcttttcagtgaagtagtaagatgtactttacccgaagagattatcttttgttttacaaatggacttaataaattgccggttgattttttgctttattttgttttaaggcatcacttacacttgaagaaaaacaaaaattagcaaaagaacaagagcaggcacagaagctgaaaagccagcagcctcttaaaccccaagtgcacacacctgttgctactgttaaacaggtcagagttcatttcttttgtgtaatttccagaatacgactgttaaggagtaaggtggtatagaacttagtctactagtatttgtataaaaatatatctcaaataataccttaatatgtggtttctaagaagtatgggcataaatgattttccaactcagctataacctgcctaatgtataatgttttgtgacaatgcttgttaccagtaaaaaagaagctagaagaataggaagggttcttaaaagagattaggactcatagtactcattcaactctgttcactctgaaatgatcagaatattatattcatgctcttaacatatttttgagctgaagttattttctgtgtttgacttttcaattatagttagatttgtaacttgatttaagatgtacctacatgacctggctagtatttgttttctcctgtgttccaggcactgttccaggtattggtgctatggcagtgaataagggccctgcttgtagagagtttacactgttactggtttcagagatagctttatcttaaaagctttctttaaactatttttttgttacctcttaatcactaacattttctctgagaaaaacctttgtgggccaagaggcaaaactgagaatattttgtaggtacttttttaagaatagaggaaacaaattcctataaagttttgatgaaattcaaactatacaaataatagtaaaaaattactgtattttttgtaatatagaataagaagaatgcgattctttttttgacaagataatattttgcttaattggagtttacagttagtgttccctatcatcaaatcgattgcaaatattcatctgtaaaaactatataaaaataggtggcaggctgtatttgaccggcaggctatagtttgctaatttggtgtagaccattgagcttaattctaacttgtcctttataatttaatctgtcaaatgtttactaattataaagtaatttatatttcttagagataaagtaattctctcatatttttcagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccct

SEQ ID NO: 70992 - DNA, 1144 bp, Homo sapiens
accaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccag

SEQ ID NO: 70993 - DNA, 1213 bp, Homo sapiens
ttcagaaatgatgttcctaatttatattttgataaatagaaatgatgtttggagaattggctgtttcaaaagtagtatctcctcatttatattttctcatttaattttcatttattcactatgtttttactaagctactcttcctttttttttcctatcaatttaagtttggagataataggaaaggttcagttatttggatagattactaaagagcttgctgttgatgatgaggaaagtaagagattaaacttaatatgtattcttatgttttactttcttacagtaacgtgtgtattttacttcttattattggttttcatactttgatattagatataccagtacatatctaatgagtcatgcaatggacatagaatgatattagatatacctttacagatctaatgagtcatgcaatggacatagaatctgagaaaataggaaacttgagtctgttggccaatttgtctcacattgagtttcttgatttttaattagagtttagttgtcacagagaaatgcttcagaagtaatgtttatgagatacagaccataattataactgtatttctttaatgtttctcctaaaaactcagaaagtgttttcatttgattacattgttacagagtaggtagggtgttttggttaacagaaagccaccatgtatttcataagggtgttacaaatttccaaagaactagaatgtaataaaatgtagcagcctactaaatgtgatgtcatctttgcctctgtaagcatcctagagtttatagtattatgaccatcagtcatgtgctggatattgctgaagtggtgactcatagagacttccgcctactgtcatacaacataaacgtttctctaagaaagtataatattagctatggtgaagggctcactttatatagatagttagctgttgaaaaaaagtttgatgttcagcatgtcttctttgttacacacacagagaatttagaaaagcactgtgatcccagtaacattacatatactgttctacaggttgcttttgttcacttaacaaaatagacatattttcatatcagtgcatatagctctgtgttattctttgaagtggttaaatgagtctactgtatgaatgtcccattagttatttgagcagttccctgttaatggatagttagatattgttcttatattttttatgttagtgtttatatatgtccccat

SEQ ID NO: 70994 - DNA, 1026 bp, Homo sapiens
gccatttgaatgataaagagttaatgcatttctggtccttaacggcaggaagcatctagttcaacattccacatatagcaggtgctcaaaatgtgctggtaactgatggactatcttactcaaggaacctgttaattttatgttaacacctactgagtgaacctaataaatgtttaaaggcatgacttagatttctaataaatgtatataaacatgacttaaaatagttcatatagttgttgtacttccctgaagaaaacttgtaaacatctagtgagtgtctaactaatggcataacattaaaaactggccaaaaaaatgcccagaaaatgtttggcccttcagcacccaaagctctcaaaatataatgttaaaacatctctgctacagggatttcagtagtctgaaaaatttaatacctgaatggtttaaatgttctcttctaaattttaaataagtgcaaggtttctacactcaggaattgcctaagtttttatctttcctcaaaagaaaacattgaatgatatagaagtagcataacttactaaattaacttataaaaaactaataaaaaacacaagcccccaaaaagcaggttattttccatagtcttaatacaactattacaaatgtttaaaatcttacaatgtaggctctcttctacctggttttagatatcttaatattctcaccccctcttttactgtgagaacatttatgagtccaggcaccccttggcccagtggcatctattccagtatcaatgataagaatctggagtcatccatctcaagaaaatgaggaagaggaagttgaaaacagccaacaaagcaaagatgtagcctgttactggtccactgtgagaaataagtctgtccagttgtttgtccattggcaacacagattccactgatacttggtcatacgctttttcagttctctccacaacattccttcaggtgtggaaagtctttactatgttacggatattttctggagccagcaatgcccctgacttcagttgga

SEQ ID NO: 70995 - DNA, 1035 bp, Homo sapiens
ttttgaccaaatcatttttctaggaatcattttctggaatatactttaaagcagcagtccccagtctttttggcaccaggtaccagtttcatggaagacagtttttccacagatttgggcgggggtggttttgggatgtaactactccacctcagatcatcagccattagattctcataaggagcacgcaacctagatctcttgcatgcacagttcacaatagggttcaagctcctgtgagaatctgatgccatcgctgatctgacaggcagagctcaggtggtaatgcttgcttacccactactcacctcctgctgtgtggcctgattgctaacaggccacagaccggtaccagtctgtggcccaggggttggggacctctgctttaaagtaaaataaaatagttttcaaaactatcttttttctctaaaattgtgtactttttggttacaggtgatggattgaacatttatttagcaatatcaaaatgaatgtttaatgaaagtatccttgatacatttttgaaattattcttttgtcttttccagaattttccaatgagaaaagtgccctgtaagaaagatgctgcatcaggttcattctttgctcgggacaataccgcaaacttccttcactggtgtagggacattggggttgatgaaacttacctctttgaatctgaaggtttaggtaagtgatgttcttgtcattcttgtttttaatgcttactaggatgttttaatatccttcacctctaatttttctttccaaataaggactcaaatgcctcatctcattttcctagaaaaatgtatactttgaatatatgtagaattattggagaatcagatactaaatcaaatatattaaccttttcacttaaagattttatgtgtctagaatgtcctaaaattctgaattcctaaatgagttggctacaggaaggttctggactaatgctttagtaattgatattttcattaagaattactccaccaagcctaaaaagtagtaacttccctttaaccggataat

SEQ ID NO: 70996 - DNA, 1026 bp, Homo sapiens
ataaaatcagaagaaatcatttcttacctacagctcttatttcttttaggctcatgccttgttctgattgtgggttagtgctgatttgtactgctcaatataagtgagattcgggtatcttaaataaggaaaagatacgacttgttatatctgcattcttgttatgaaaactaaaaagaaacatttctctaaatatatgtgtgctatatgaatacattcattgtctacctgtgaatatgtgatctacagatatcttggaaaataaggaacaattattttctgattcacgatttagggtcctgttacaaaatatacaacagcaattctatatacttaggaaatttttacagacagaaagtggtgactaaaagatatatctcctttcagattactttggttaactaatgtatcagcatggttctaataactgtaagccctttcccagagttcagtttatttttcaccattttatgcacatggtgtgtatgtttgtatcaacatagatgcagatgtgcacgtgtgcatgtgaacaagataaacttgattgggtgacttatgaaaatcagttctatttgtttatacgcacgttattttgttaaataaatgatataggaaaataagttctggacctttcctttcaggccctagtgaatccacaggtgttcatttgatttaggtagatatttaagacaatcatataaatttctattggtgctcagctaaattaggcctatctaaagagactctctttaatatcatgcctaagtttagttatatgaattcgttttgataaattttgtgtggcaataattgagaaaaacattcatgaccttcctttttcaaaaatgtaattttaggaaaagccaaatattttccacagtggctgatgtgtgacttttttcagtcataggtatttcaacaaatatctttacttaatatatttccatttccatgttttaaatatagaattcttaaatttgtttttatatttactgcagttctaccattaaaaaatatttataataa

SEQ ID NO: 70997 - DNA, 1090 bp, Homo sapiens
aaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattataaaaaaagagaaaaggaagaatgaatgtgttagcttcacatcttaaaagtttctcctatttgtgtctgtctaaataggtgcagacactaaggatagtgaggatggaggctgggatgaggaaagggttcatcagaattcacatatctgaattcactggaaagagcccttctgaagcaaacagttgtaaaatcactgcaaggtttttattaataatagacatgtatatgattttcagtctatagcatctttgttaacatctgccttttgcaggaaatgtaaaagttatttaacactacaagaattttaacaatagttgctctatttttgaatatgtattaaatatggagttcatatacctgctaatatcaacggtggtgctcttactattagttaattgcattttggttaaaaaaaaaaaagcaacagtttggcacttgtcctacaaaaggcacctaatttaattttctgatcaggattgcctgatccaacagtgctaagtcatggctgctgctgactagcttggcattattctgtgttaggtagaattcttattatttatttttttaagctttccaaattggaaggaactgattgtttcatgtggcttatatttacattggtaatattttgtcaccaatatttttggttaaaaaaaatccaacaaattaacttactgaaatataaacaaattttgtaaacaattttt

SEQ ID NO: 70998 - DNA, 1449 bp, Homo sapiens
ccaggcccagctaatttttttgtattttcagtagagatgggggtttcaccatgtcggccaggctgatctcaaactcctgacctcaggtgatccacctgcctcagcctcccaaagcgctgggattacaggcatgagccatcacacccagcgaaaagttttgtttgaataaacaatatccgaaagacaattagtttcttcagatgtattttgaaattctcctaaagagctagtgtttctattcattttcacaatttaaaaacagctcttaacattgctgaagttgggagaactttccatctcttcttaataacagtgcaagattttgtaaattcttttttgtgtttaatgtttaataaaacgagtattaagcttaaattactgaagtacctgggagaagtaatgatgtgtactttcaaaaaaatggaaaatgcttttattttattttctataatttgttaacatgatatgtaaaattaaacttcggagcacaatgaaatgccgattatttttaccttgtttgggcttaaagtaggtatttaaggtttatgtgttcaaaatgccttggtaaattggatgacctctaactttactgtccatatggagtttgtcattctttatggataagagaacttaaggaaaagttactgtttttcttcagtctttttatatctatctgatttaaaatctgttactttattaaaaggcttcaacaacaggttgttaggatgtagtcttacatccaggttcacataataaccccatttgaatccaaatttgtgtatattttcttatgccagcagtatttgtatccaattttaacttaggtttgttttcttgagtattaaaatttaaacatatataccaaggtctcagtttgcttttttggtgtattctgaatacagtctgatcacttaattcatgttggaaattgcatataggaagaattcataatttgagaagagtgctgtttaaaatgctttctttatatttgtggaatttatttcactgcacccaggagattataaggccttgtcattaatcaacagtatttgttcctcaagttgctgtatatgctggatgtttttccagaaagaccagactcacatttaataatgtttgaaataatagagataatttgttggttatcaaggtagaattctataggtcatacaagcattgtgttcaccaaagatgactgatatcaggaatttccaattttcaattcctgtaatcctgttttaatttcacactttgatacagttagtatattcttgcatactcatctttttcctatattcatgaccagagcaattataaaaagcagttaattccatatatatttcctgtgacatttccaaaaaaggaaacaaaaacaacgtagacaaaattttaattgtattttcctaaccctttgtgaatgtaaaattttataacctaaaattcatttta

SEQ ID NO: 70999 - DNA, 1037 bp, Homo sapiens
gatgtttaatttgtgatcactttcttctggttaaccaaagacaaattcaactgtctatcagagcttcttatcagcatgagataatcagtactacaaatgggttgatataattccagtcaaaaggaaataactggtttctgtttgtgtgcagcttgatcagaggcaaatacataatttttgtgagtctcattggcaatctggaaactgttcatcagcttttcatcacttcctttgtggacatcagattcagaaccacaacttaatcttatcattagtctgtcttctctcctttctcaaaagctgggtcatcccttctcagtatctcctggggacctttcttattcattgcctttacttcctacatctctgatctccactcttcactatttctgtgacccatatgcatctcacatctttccgatgttaaagaaactcatgcctgactttgtttctccctcttacaatcatctaatctctatccttccaatgaccatacaagtttttgaatgtggcccatagaaagaacctattctttctctccttacgttttacttctgtacttccttcctacttggccctatctaaggtcacctgattatggttaaaaaccatggattcctcttggcatttcctagtctgctctcattattttgggtctacttatttggcttctgcatcattgcatttatctgcctctcttctttcccctctgccagtccttagtcactttctctaccttctttttttcatggaggcataatgaagagcataggttttagagtcaggcagacatagggttgaatctctgctttttcgtcaccagttgtgtgaccttgggcaatgctgaactttgcccagcttcagtttccttatctggaacatggggataataataccttacttgtaagttgctgtaaggattaaaagaacaatcagtgtgtagatatggtaactgatattttatagacttccttccctttgtagtttgtaatactaagggtattatccaaagtgtactgaggctttctctttcccac

SEQ ID NO: 71000 - DNA, 1049 bp, Homo sapiens
tatatagcattttgtgtctggctactttcacttcagttaatgctgttgagattcatttatgctgttgcctgtgtcagtagctggtttctttttagtacagagtagtattccagagcctggctatgtcataatttgttcgtctacttaccagttaatgaatatttgggttcagtatggtttttaactactataaataaacctagaaactattggctcttctagttttttgtttttgtaaattttcataaaagcctttgtagccattcatcttggatgaataattaaaagtggcattgctggatcatgtgataagtgaatgcctaacttagtaagaaattgtttcccaaagtggccatatcgttttgtagtcaatatcagcatgatatgagaattccaggtgttccacattctcacaagcacttggaattgtcagtctttataattttagtcattttagtgggtatatggtattatcccattgcagttttaatttgcatttccctaatgagtagcgatgttgaacatcttttcatgagcttatttgcaatctgcacatcttacttggtgaagtgtttgctcagatcatttgtccatttgttattgggttgtctgtcttatttttaagttaaaagagtacttttatatattctaggtagaaatgcttcatcttacaggtgtttgcaaatttttttccctgtctgagtcttgcatttttattttttaatggtgccttttgaaaaccaagagttttttctttttatatagtctaatttaaattttcttctgcactcattttttgttttatttatgaaatctttgccaaactcaaagtttctaagattttcgtctatattgtcttctaaaaagcttatcgttttagctcatatgtttaggtttatgacttatttcaagttggtttttgtatatggcataacgtaaggggcagatttatttctttccatgtagatatccagttttcctagtaccatttgtcaaaaacgccgttcttttcctttttgaattttcttggtacattttggttgaaatca

SEQ ID NO: 71001 - DNA, 1036 bp, Homo sapiens
ggctggcggtgagtgattcccagctaagggcaaatatacagcgctttctctgtttgccccttgatagattgtttccaggtcttccttaggatacaatcataggtctgtatatgtttaaaaacacttttattgcagcgactttgctaggtccccatgcttatgggagggtatgaaacctaatagatctagcgagactaattgccagcatccacctaggctcaccagtctggcaatggaaattttatttgaaatgacatagctgagagaaattatgcaaacatagaagtattcattatctttgaacagtgatgcagtaaatttgtttacggccgtatgtttttcagtttatttttccacttatcctttgtgattagagatgcctacatgcagcattcaaatagatattaaagatctgataaattttaattaattatgtatcttaaatatactttcccttccagtttcttacatttgctgaacgactggggaatgttaatattgatattattcaccggattgatagaactgcaagctatgaggaggtaagagaatgtgatactagtcaatcttcaagtgttcatggtgttttagtttcttctgttagtagaagtgaattgtttttcaaggtattcctttttggacatgaaatgctttagacctgtgctgtttcatacagtagccacatatgacaaattggatttaaagtaaattaaaaatttgggtgcccaaatgtggctagttgctaacatattgaataaatatagaattggaacattttcatctttgcagaaagttctgttgggtgaagctctattagacaattgacttgactttcagctgtctttgtgattctagcctctccctttcccttatgcattccaagcactgctgcagatccatattcctgaagctataactttaaagtgattttgaggaagcccttttcccggggcttaattttctcctttataaaaataaaggggctagactacataatattttccagttttaaccatactctgactctgtcatccct

SEQ ID NO: 71002 - DNA, 1028 bp, Homo sapiens
ctccgtctccaggttggagtgcagtggcgtgatcttggctcactgcaatctccacctcccaggtttaagcgattctcctgcctcagcctcccgagtagctgggattacaggtacgtgccaccacacccagctaatttttgcatttttagtagagacggggttttgacatgttggccaggatggtctcaatctcctgacctcgtgatctgctcgccttggcctccgaaagtgctgggattacaggtgtgagccaccacgcccggccttgtcatccttttatgcagaagtctttttctgcatcatgtcgttattcctcctagcattttaaggtcgtacgtaacatgcctataccttggcgatccaatctcagttcgtaatattcttctttactataatcagactccactcgctgggtctttgaatgcattatctccactgtgtaaattcaatgtgttaaatgatgtcgtctaggtgagcacattgtgctttgagaactcatagtaaagggaacctaacctacattctttaggggtgtcaaaaaaacggtgatctagacgaggtgacacctgaattttgtttatataggttttagcatggtaaagaggacaggaaagcctgttccaggctgagggagaagcctatataaaggaacagaagctagagaatgcatgtcacattcaagaaactgcaaagcagtccagtgtggttataggtgtgtatagggtgttttttttttgtattcatggtgactgggatggggcaagggggcaactggtgagataaagctggagaaataggcaaggatcataaaggacttcatatgtgaagctaagttggggttttatcctgaagctgtagggacttagagttctaggactgtaagcaggggaatgaatgacatgatcaggtttaaattttcaatctctctggctttagtgtggagaaaagagcaggactgcagttcttcatcatgtcatgattcctctgctagccttttaaggtcctgtgtaacatgcctttaacttgga

SEQ ID NO: 71003 - DNA, 1022 bp, Homo sapiens
tgttaacaagttaagtaacatagtggtaaacttacgaaaagcccattatctcactcctcccacccctaattcccaaggaagccaacactgacagttcagtatagttgtattcttccatactgtcctctcatgttcgtatgtacaaacatttatagagggttttttatttttgttttttaaggaaaattgaatcctgccataccctctcactgcataacttttatcattttgggggcatatcttcagtgtagttctagttcaatagagatatagctctttttagtagccacataatataccttagtatatatagaccatgggctattccaaccattttcctattgtcggatattttagcctgtttaatgtttccccacactgtagttaagctgaataaacatcttttacttaaaggcttgcaaactttataagaactacctgggtcaaagagcgtaactattttgaattttaacaggaatgccatattacttctttataaggttgtagtaattcatatttctaaaagcagaatgaaggaactgtaaagaaccaacaccttattctttgcctaaaattataaaaaaacacagaaaataattttcccttagtggacaatatatataggccccagaaaattatttgctgaaaccaaatcaacaaaacagcattttataagtggcctattgataacttctgattgctttttagtgtgttacttaatggcctgttttaaaaaactaaaaggagttcttaaactcttcagtatcattgtcttaagatattaatatatcattattctatttaccttgatcattgctttcttagagttatttgattaatggactgctttaatcttgacaggaggttgaaacctacttttttgagggtctgctgaaatggagagaattaaacctcacagaacacttcggtattttctatttcgtttctattttattcacccatagtttgcactttatatgttccatacagctgaatagtggtgtgatagaaaagaacatatt

SEQ ID NO: 71004 - DNA, 1052 bp, Homo sapiens
tttgcctgaattttaagaaagattgtgtttcaaagctacatataccgcagatcaggtgctcataatttagaaacaaggaggattttccttttctgttaggaataagtgcattaccataaagtggaatcttggggtataatttcgcatttgttatatactaagataatctcatttttctttgacactataggaacagttggctacaacttatgatggaatgtaacttcttgcctgatttctttgctgagatcttaagatttaaagaattttataatttttcagacttgatttagaagtatttttatttaattaatcctatgatcataggccacctactatcgttaagtagatttgtagccttttaaaaaaatccacatgatcagttgcttctttttttaatccagtttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacaggtaacccctttctctctctagtatgttttttaattgcctgcttctttttccctggcttctttatgactccaaaccactttgccagctcagtgcctaattgtttccatgtacaaagttgattctccagccaaagtggtccacaatctagtctgccagtctgagttgccatgaccatctctcctctccagctactggaagtatacccacccaagaaggcctgactcggtccctacagcctccacaaacaggcacctttgccagaagtattaataaaattttgtactctctatcctcttggcattttttaaccacctatgtcacacaacttttaccagaattgtttggttataatgtattgctgtcctctctacacctggtataagggaggtttaagacaggttaagagccctgttttaaacactgacatttccccagccactaatacttactaaggtgaaa

SEQ ID NO: 71005 - DNA, 1010 bp, Homo sapiens
cattcagccaacatttattagtacctgctgtcagcaaggaactattaggtactggggttatgagaaaattggagagatatattccatacccttctatcattagggagaccaaatttaacaatgtgattatatataagtaattatttagttatagatgcatggctgcttgaccttgagcaagttgcttatgctttctgcctcactttcattatctgtagaatgggaggattataatagtacccatcccatagagttattgtgctgattaaatggcgtaacacagagtaagtgcttatacagatgtaagctagacctgtctacctgaccaactttatccatagctgctctcctctactgtatcatctttcctcttttagatggaccagcctccttgtcatgaccatgatcatttccacctgcctcatctttgctcttgcttttataccaataatatggactgcagtccccacctaattcttctttcattcagagctcattacaaatttcaacttttcctggagtcttgtttgtaaaaccagtaccaccagtcctaggactcttcatgtctgtggtcaagtcttcctttcaacatgtgggtgtctccataaatgaatgagattttaaatttgtttgatacctgctgtgtattccttgcatacccagcacattgttgcccatattgttgacatgtagtatgtatttattacaattatatgattaatgaaatgtatcttatttttttcatgtatagcatgtacagcacactcctggctcataaaaaactacatataagaaattttgctgctgaaagttttacttttttgatgagaaaggttagtctggtattttatctgtttgttgctaatcatcaagaatctgatgaataggccaggcgtggtggctcatgcctgtaatcccaacaccttgggaggccgaggcaggtggatcacctgaggtcaggaattggagaccagcctgaccaacatggcaaaaccccgtctctactaaaa

SEQ ID NO: 71006 - DNA, 2172 bp, Homo sapiens
tgaggagtgttgggtgttcagtaacaatgcttacccaatgtaggccttggacagtgagatgttacttacagagccattgatgtcttctttattttggatgctagggggtaagataaattgattaatgggcaagggcaggtggggagggaacagttgtaatgataaaattcccatcctagtttagaagttccttttgggacacgttattaaccatcaaagttgccatatccttgactattccagacctgatttttaaggtagctaatgtaatcagagtggtgactcccagagcaatacttgaaaataagagtttatatattaatgttaatgacttgtattcccacaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagtgagttctaatctttaaggatgggtttttgataaggagtctaagaatttactgtttctgctctcagttttgcaaatcactcctagaagttatattttataattgttttatttatacttctgtacacatattaaaattttccttccctctgcccccctgtgctattttttatttgatatgttatcttgagatgcagtagaaggctctggagccagactgcctgtttgaatcttgacccttccacttactgctagtgtaacctgggaaaattatttgaaatctcgattccccagtctcttcagataataaatgggggtagtaatattctctccctcagggttgctgtgaggatgatgagtgaatacttgtaaaaaacttagaatgggccgggcacagtggctcacacctgtaatcccagcactttgggaggccgaggtgggtggatcacctgaggttgggagttcgagaccagcctgaacaacatggagaaacgctgtctctactaaaaatacaaaatggcgcatgcctgcaatcccagctacttgggagggtgaggcaggagaatcgcttgaacctgggaggcagaggttgcggtgagcaaagattgcgccattgcactccagcctgggcaataagagtgaaactccatctcaaaaaaaaaaaaaaaaaaaaaagacttagaacaatgcactcagccaatgttagctgttatcgttagtgagtcctggtaaatgtatctttttcttccaaagcaagagaatgggaaaagttgaactgtcccacagtttttattgttggattaacagttgagtttgatactttatattctctctgttaaattctttgtttgcaggaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgagttcccaacttaatatgctcgagagtctggtttttaaaagctgattgctgagtatgcattgttttttctttttgcaggtgttatctcaaacactgcaagtagccagtctctccacatcttgctgggagaccctcttggatgtaatttctgctttgatcctgggtgaaaatgtttccttgccggagaccctcatcaaagaaaccatagaaaaagtaatttacttcaacaaatattaattgagcagttaataatatgtttagcattgagtaaccttctgaggaatacaagtgaagtgtgacaaaggctctgccctcaaggaatttataatcttgttaaggaaatgggaattgcatgcagtaatgtaaataaacaaaataaagtgtgataaaagcttaatttatatagcaaataagcaaaataaagtgtggcaaaagctaaatctatacatattctgcaatatatgtaagcacatattgcagtaagcagtagagcttactgtgtgctgggtatgagctggctattccagggtaaacagtgatgcctgcaggttttgatagttgttggagaaatggagcctggaaccgagtagttatagtctagcgaatttgtctgttggagatatattgaattataactattaattctgcctggggttgaggaacagag

SEQ ID NO: 71007 - DNA, 2908 bp, Homo sapiens
ctttcataattcactgtagctgggcaagagttgagcagcctttaggcagagccctgtgtaatcagcagaagccctttgcatctgtggaagcacctttggagaaggccgggcaactggacagagcactgagtgaagtgtccctgccattcccttctatagctgcttgctggggggatggggaaaatactctctgtgtacttacattaatattttttaccttggtcacagatatttgagagcagatttgaaaaacgtttaattttcagtttttctgaagtcatgtttgccatgaagcagtttgagcaggtaagcaagttactaagttcggagtatttttaaaaacaaatctgtcaggaaaaaacgatcaaatttgaaatcctgttatttctgtttgttttttgagaggaacaggataagtgcttgatgttttagtcaatatgttttttaaagaaattatattcaattctagattacttgtttttttaataatcctttaggtagttacagaaccgtgtggtaaaattgaaaaaacagtttaagaaacttttatgtgaatttgaagcatagaaaatagtttgtgaaacaatttgcactggtggaagtttgcaaattgatttcattgctccaaaataaggtaactgagtgagggagaaaatgttcttatctaatcctgaatttattttatttttttctcttccttctcatcaaacacttggccctcctcctaactagtaaccctacagtatacatcatggaaacatatctctgtatctgtcctctcaatattcttccttttagcctttaatactatatattctcatttgcctaaaaagaacacttttgtacctgtccaagatctgtttctttctgccccaggaagactcttcatcttgctctgtttaacaactgcatttttcctttctcccgtgttccctttggtctttttatttttttttaatcttatttttatccaaatactgcttacacgtctgtagtttaggaagacaaaccaggttaaatggcagtcatttgttttctgctcccatcttattagcagccatcgggtctaatgatttttagctattttttttcttttctttcttctttttttttagagacggagtctcactctgtcgcccaggctggagtgcagtggcatgatctcggctcactgcaacctctgcctcccaggttcatgccattctcctgcctcagcctcccaagtagctgggactacaggcacccaccaccacgcctggctgattttttgtatttttagtggagatggggtttcaccatgttagccaggatggtcttgatctcctgaccttgtgatctgcctgcctcggccagctatttttttcttatatttactttatacttttaaatcatctgaatatactgctttaccttggtttgctagttttggttctcatgtgtagacttcctcctatggcagatggactttagttcctttatacctctcatgctcccaatagaattatattagaaattttggttgaatccatattcaccacatacttatataaacaaggagtattttatgattatatgacctttttgtatacattctcgtttttcttttttttttttttttgtcgagacatagtctcactctgtcacccaggctggagtgtagtggtgccatctctgcttactgcaacctccaccctccgggttcaagtgattctcctgcttcaggctcctgagtagctgggattacagtcatgtgcccccacgcctggctaatttttgtatttttagtagagacggggttttaccatgttggccaggctggtctcttaactcctgacctcagatgatctgcctgcctcggcctcccaaagtgttgggattacaggcatgagccaccacacctggcctcatttttcttagagtttataattgcctcgttctttaaaaactggaaattgttttctttgaatggctggccaaagagtctgtcttccagcagctttataaatgtccttcacatgacaaaactgtcagataatttagcagctcaatttttctttttcttctttcttggagacatttctcctggagcaagtccagtctaaatgcattgctttctctgcccagtgcacaaatgttgtactgggacttccttttgcttctctcttgtttcctgggttccgtgttctcttcttcttatagtttagtctctaattttggtggaatttatttttcataatttcctgggggtagggagggttcatggagataaaatattgagatttaatacatctgaaaatgtctttattctctcctgacactgcattattagtagacagggtatagaattctagattctaagtcatccttcctcagagttttaagacatggctgcacagtctttagtttccattgttcctatgtagaggtctaatgccattgtgattcttgatcctttgtttttggtctagttttttgaattgttagcatcttctctttattatatctgttaataagtgtgattttttttttcttaactttagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtggggtgagttctaactttttattcctgtaatgatgataagtttacccatttaaatgtaatgtatcaagaatactgtaaaaaaatgatctatatgtaacaggaaagatgtccatgataagttgtgtgaaaaaagcaagttgtagagctacacacatagtacgtatagtatgatctcattttgcaaggtaaagc

SEQ ID NO: 71008 - DNA, 1112 bp, Homo sapiens
ctatgttgcccaggctggtctcaaactcctggactcaagtgatcttcctaccttggcctctcaaagtgttggggttacaggttgagccactgtgtttagcaaactcatcttaacacctacttatatcttctgtataccttacaaattgcttctctattaaaatatgccaacagaatcttgttggtttttaaatgtattgaattctgattcctgaggaatgggtagtgagtaactccaatagaattattcctttgaaacttttcccttgatttgtcaacacccaagcccatctccaacaggcagattccttgcacatgccaaaactgagttctgtgcagggagagtgaagctgctttgttgtttggcttccatgaggtgaagctaagggactgactgagactgggcgtcagaccttcttaccccatcatctcagccatctcagatcctcccaggagggtgacgtgttaaataaataaatttcgatgtgctaactcatggcaagttcttccacttctgtgtttctttctctgcaaaaacacccctctgccacccccaacggagatatggtatgtgtgaatggtcacctttgttttgattccttctatgaagattttaaaatcatagtttgaatattactagtaacactctatctacccatctcaccagtttgctgtgagaaaaaataaagataataaatgtgaaaagactctttaggagataaacttactgtcgtttgacaactacttacggtatcaggcactggatactggggtgcaacaaagaataagaaaaaagttccttcttttggggaaaggaatgtggtgaggcgggtaagcaaataagcgagatgatttcagatcctgatcgtgataaaagaagacaaagcagtgttgagagggagactgaatggagaggggtcactttccagagagggaacgtttggtccaattttaagctgggaaggatccagccttgcaaagatctcagtgagagactctccagacagaaggaaaagttaactgcaaagactctgggacaggaataagctcagcatgtttgaagtacagaaagaaaacctctgtgggtaaagagcaaggaggagattggggtga

SEQ ID NO: 71009 - DNA, 1090 bp, Homo sapiens
tgtcacccaggctggagggcagtggcacgatcatggcttactgcatgcagccttgacatcccaggctgaagcaatcctcccatctcagcctcctgagtagttgggactacaggtgtgaaccaccatgcccagctaatttttaatcttttatagagatgaagtctcactgtgtggcccaggctagtgttgaactcctggcctcaagtggtcctcccacctcagcacccccaaagtgctgggattacaggtatgagccaccatgaccagcctgtatttttcttaagaaaggtaaaatataggacttggaaacttctcttttctgtttctttctgttatatttggatgtttgacagacaattctttggaaggcataaattcactttaagaacttcccataagtagcaagtattcaataaataaggtgtttgatagttaataatgtcaaagaaataagtaatgtggtttctcctgtttttctgcccttaggaaacttatttgttctttgtcaagctgtaaatactctactaagtttggaagaatcttctgaacttcttcatttggttcctgtggaacgtgtgaagaatttagtattgtaagtaaacatcttccagttggtttagtaatgaataaaatataaaagcctctattgttgtgaaatcttggacacaaagaaaatccctttgatctattttatacctgagttgtattcacgtagtgaaatttaatattgatttagatcctccagttaaaataagtacatttgacacagtctttaaatacagattcatctttgtaaagggtgttttattgcgtgtgtagattaatgtcgtaaagtttgaagggtttgtaatgctgatcattcccaactgtaacgtggcatgatgttgaccttttataacttctttagtggttccaacatgcacattcccactcttgttcggcctcaacttgaggtgatcagcatttcagaaaacttccctgtggtctttttactacacactgaaacaatccagtttctttttttttgttggtttggtttctttgtttgctttttaagtatagtttagccagcctttgattttgatagcag

SEQ ID NO: 71010 - DNA, 1188 bp, Homo sapiens
ttgccctgctgcttctaagtataggacagatcatgccactcctttgctcatcaccctctaatacagtgcttctcaactgggagcaaacctggagactttccagctgtcacagcatggggaaagagcactgttactggcatctagtgggtggaggccagggatgctgctgagccccctgcagtgggcagcactgccctccaccacaaagagttctctggcccaaaatgtcagtagtgctactgtagagaaaccttgctcgagaggtatcccatctcactctataaaatccagcatcctcatcatgttcctcggggctccgtatgagctaactcctggctagttctgacatcttcaggcactctttgttagttccagctgagatggcctcctcgatgttcctgcagacaagcacacctcagactggcattgcagttccctctgcctagaatgcttttctttcagatacccttttagctgactttttcacttcctttggtctccgttttttaggagcacccctgtatcaaatggtgcttctcttcacctccacaccgtctccccacaactccctgcatgtcaatctctttgtcaagcctttttcccctggttttctggagaaaaccagggttttctccagaacctggtttctccaaacctggtttcatggagcctttctccatgacgctcatcactgtcatagtacttatttattggctactttcccctactagaatataagttccaggaaaaggaactttgtcttttgttaactgctatatctacagtatctagaaaagtcacagtacatagtaggtactcaatgaatatttgttgcataaggatggtaccaagaggttaagcaacttgcctgaggttacactgcttatgagtaatggtgccagattcaaccctgggctgccctaccccagagctcgtgtgtcagactactcctctctactatcctcattagctcggtgcctggcacatgacaaacacttaataaatattatatatgtatatattatattaaatattaaatttaatatttaatattatttaataaaatataaattaaataataaatattatatatatatatatataagtggctgtcatttacaactatgtggattgaagaggcaacattggagtctagcatattctgctcccacctctgcctgcaaccag

SEQ ID NO: 71011 - DNA, 1420 bp, Homo sapiens
agatggggtttcaccgtgttagccaggatggtcttgatctcctgacctcgtgatccgccctcctcggcgtcccaaagtgctgggattacaggcgtgagccactgcgcccggcccagccctctatgttttatatcagggttttcattccatgacccttgaagatacatcacagacctctttgggagtaaggccaaaaggaggcattctcccttcagtcagagcagttcttctcttacctgttttataaattaggtatataaatatacttctgtttcatttggaaaaaagactgcttctagaatatatacaaacaccccatccctaaataataataaaactaccagtctggatggtgcctccctagcacatgggaatgttagtaataatgacccttattccaaaaggtgaccgggaaactttagacccttttactgaacttgcaaagcctcagtcattcacagcatgtttccttgcgttcttcggcatgtgtgcatttctgactgctgttgaagttttgtcttaatctggtgacagcaacatttgttagaagggagtttaatcattagtcaaatctgttcatttaaatgaatgaatacctggagtgaatttgaatactatgtttgctgtagcgattcttctattttaaatagtgagtgacattttggggagaagaggaaaattagtatacattgaattttggattggtgcctgcaactttttttcttatcgcacaggcttctttccaaacctcaggttgtccaacttgggatgtttgcatttcagtacttctgttctatactgtatttcattacccaatactaaactagtcttttgtaattgcaggtgccgcttcgttatttgttaggcatgctatatattaatttcagtgcactctgggatcctgttattgaactcataaggtaaacatgggttaaatgggatgaaactattatactttaactactgcagaatgatggggcccagattattctccttctgggtgtgatttaaatgaatgggtgtatatggtatttacagtactttaaatcctttgtgagacaaggtaaattaaaaataaacatgaattattctctctgatgccacatcttcagtagttccaatattatacgtgtgtctctttgtgtgttgaaataactttgaaggagtttctctttttgctttttatgatacttttgtgttattaaaatttgttacagcaaggaagtataataattgcataattttatttctatattttgagtcattgagccatactttaaaaataaagactttttcaaaaccttgctgtctagcatccaaaatccctttagccccaaaatgtcttcagtggtcacatagaaaatacatgttataggccgggcacggtgactcatgcctgtaatcccagcactttgggcgg

SEQ ID NO: 71012 - DNA, 2136 bp, Homo sapiens
gggcaacaagagtgaaactctgtctcccaaaaaaaaaaaaaaaaaaaaatacatgttatggctcatgtgtagaaatctgtcttcagacatttgtcttcagataatacacactcactttttttatcagattatcagattggaaatatgtcgtgtgaggcctttcaaaaccccaacgattagttattagttcttacttgacagaataagagagttaacatttatagacagatccctttacaatttgaaactaatttgtctacctttactacccttgtctaccttttactacaatttgtctaccttttactacctttcaaagccatcaaaaccagtgtgccaaaagcaagattctcccaacatcagcttcattattttgtttattacactttcagaagagagaatttgacatacatattaccagtagcacactatcaacagtgttggttctttaattactgaatgccatgaggcattctccctagtggctgggctgtcttcctgttgggtacctctttctgtttggaaggatagaaacaacaacatacctgttggtttgttttctgagtagagtcagttcccaacatatataatacatgtcatgtgtaaagtttatgcatattcttagaaaattagtgatagaatatttgagagtattgttgctaggatatcaaactacataagcactttatgtgatccatctaatgtctccttttaagttctgaaaagttgtttcatgtagttagtgaatgtttattttgtctttgtgttaataagtatatttaaatttggtggagggaaactaattatttttaagttagttttgaacaaactgacttttctctccagagggccccttcttctcttaatggatcttattcatgccccatgccccagtttcatcagtgtgcctttaaaaatgattttctcttaaggatctacttatatttttaaaaatactctttagtgctttatgactataaaaatgatttgtgctcagtgcaggcattttgaaaaatatagaaaagtgcaaaaggtgtttacgactccacattgagggataacctaattgacattttagttatatcctttcactcttttttttttttctatgagcaatcttaaaatggccataccacactttttattttgtgattttttttttcccttagttctcatgcacacgaaatggaaaataagcaattttggaaagtctactatgagcatctagaaaaagcagctacgcatgctggtatgtaaaggggttgtgaggaagctgcgaagaaaagtggttgtttaactgttttgtttttattgcttaattactcacgaaattggaaaacagagatgaaacatatattatcatgataacttttgggagtgacattctttccttacattatagagaaagaaatgccctctcttgagaaaacacttaagataaatgttgatatttgtctggtggttatgacaactttctttcttgcagagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaagtaagtttcctcttctaagaatatgtccctggtggggcatgaagaagagaatgtgagaagtattaacctcccaaagtggctgagttctttgttttttgccttctttctttctgcttccaatcatccattaggctgaggtattttttgtttgtttgtttttgtttttgttttgttttgttttgtttttagacagagttttgctcttgttgcccaggggtgcagtggtgcgatctcggctcactgcaaccttcacctcccagattcaagcgattctcctgcctcagtctcccagagtagctgggcacaggcatgcgccatcacgcctggctaattttgtatttttagtacagacggggtttctccatgttggtcaggctgttcttgaactcctgacctcaggtgatccacc

SEQ ID NO: 71013 - DNA, 1079 bp, Homo sapiens
tgtagtcccagctactcaggaggctgaggcagaagaatcgcttgaacccaggaggcagaggttgcaatgagctgagattgtgccactgcactccagcctgggtgacagagcgagattccgtctaaaaaaaaaaaaggctagaaccatgtcttcaaataggtaagaggagatggatacagtacataaattcaaaggtttgcatggataattcattctggcaaggcacaagcaaagatatagcaggtcagtagatatagtggcagaaaagcaatgattttctctttttcaaataattctttgggcataaatttatagaataagaatgatgtttagctttttttgctttgttttgagggttatataaaataacacttatcagttttttgaactgcaagggctgtacatatgccagctggcatttatggtgttagtagcatataaacttcataccatgttaattttccaagtttttccctaaagaattagtttaccccacggcttaaggataagatcttagtctaatggtacaagatgctgtggggtagaggtagaaacaggagcctgtaacagggagtgggtctctgagtttagaaagatttagagactaaagatacacaattctaaggaacgtttaatactggttggcatggattacctataaataatacatttatagatgatccgaactaatggaaaacccaaatgtcacctttaattctgactttgaagtatattacaggctttttattttttggctagcaatttatatttctaaatatgtttcaattaatttggtattagaactaatttgtgaatcccttgtaaacattctctgagacgaaccaaaccaggaacaagaacgaatgactaacaatggcaacagcatcccaataaaaggtgacatttagtgagtactcactgtgtgctggacactcttatggatgctttgtgtgaattgttttatttaataaatgaatgagtgaacatgctgttcacggagataaaggttacagtatgtaatgtgtggttaattgaatgttgtaagtataataggtatgatattaagtggatgatggtgc

SEQ ID NO: 71014 - DNA, 1423 bp, Homo sapiens
agtgccctgcattcaatagacaacaaaaggttaattgtttgggtgagtgaatgaaagtgacataaactaatgcattaaatgacagacttcaagataatattcattaattgcaacattggactaaaaataaaggatgaaatttaataagaacaaagtgaatactgtattaagcttagctgcacaagcttagtttagagagataaaacataaagactcactgattttcattacatggacattcagtttcaatctttgtcatgttgtggctgctcaaaaaagttctggagatggtagttccatctgtcttatcaatccatacctggaggactaaattttgtggtggtactatattttcaagagaactttggcaaagtagaatgtatctgatggaaagtgaccagcacagtcctaatgctatactttaatcatttaatatcatccatccctaacccctcatcccccagtggtggttccagagacagggaggctgatttccacttagtccaaaatagacatttcaaatattttcaacagtataacagtggaatgggctatcttctacagttagtgaatcgcttgtcaaatagcatactaaagaaggaccaagttaggaaagagtaatattgtggaagcttgcctaaggtaccactatgtctcttcagtgtgtgattctgtgaactgtggacatctctcatgaacagaatcagcacctttcagattggtgtgcgttcttcatcagtatcctgtgactttctttccacggtagcaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagtaagttcaccattgctgaaagatcacagatccacagttctgggaggaacaggaagaggtctcttacggctttatacaaaatcaactactcagataattatttacgtaagcgctacatcttcctgggattttctttaacagcctaaaactgtcaggcttccaagttttttggttgattacttattagttttttcttggttagctacataatgttagattgggggacttttgagagtcatctaattgtagctcctttttatagatgagaactttgggacctggagtgtttggatattcttttgacctttgtcgtgcactttcccagcgtgagggtattgtgtttgcatgctaggggaacatgtaatggaacatcctttttcttaaaaataagcatgttagcaatttttttttccttccacccaccttccccaccatcctgttagcacttttctctgccttttaacttgcctt

SEQ ID NO: 71015 - DNA, 1044 bp, Homo sapiens
gggacaggcctgcccaaaatatgggatttctggagaataatttcctaaatgtaaataactaagccttgtttatataatagtgaaactataggcggggtgtttgaagttctagtcagaataaaattgtagatgtcagtttaagaaaatgatctcaattctttaattctgtaacactctctgttttgtttttgtttaggcaattaattgctcatttgcaagttttctctaaattttcaaatccacgggccttatatctggaatccaaactatatgagttatatcttcaggtcagtaaaataaactcttggcattataattctttgtgaacttttctctatcattttctttgtcagagtagcttagattttcaataattgctgaatagggcccatgtctacattttaagtattaaagcctttttttttttaattaatagacatattttctgttatcttgagaaacagttttagcactaacttagctgattttgaaggcattttgggtgactaaacattgattggctgtgtcaacagtgagaatagcaaagcatgaattatatcatggaaattagcttttagaagggagtagggtttatacaaaaaaacaagtgactacttttcccttctagtttagtcagacttcatagaggactgggatttcaggatctattgtagtccattgcagtcataattacgtggccctgaatttcagataagcttgcagaaaaaaattaatatcagaaatgaagtaagcattggatgtaattctaagccatctggggaaacaaaattttcatttttcatttggatgtttcttctggcatcttattgactatcattaccttcataggataagagattttccttagtacatgaccagcctagttggcttaaatccagattcacatagagaatcggcctcaccaggctgcacacagtagctcacgcctgtaatcctagcactttgggaggccaaggcggacagatcacctgagctcaggagttcgagaccagcctgggtaacatggtgaaactgcgtctctac

SEQ ID NO: 71016 - DNA, 1065 bp, Homo sapiens
tagacttacctttgatttgcctactttttctcccataacaaaccaccttctggcctttgtccttcctgcttcccttagctttgttttttgttgtgttttgtttgaatttttgaatttttttatagagacgtggtctcactaagttgcccaggctggctttaaactcctgagctcaagtgatcctctggcctcagcccctcaggtagctgggactacaggcacgtagcactgcacccagctctcttagccttattttgttgttgacttttttcattgtctgtgttaaatatctaatttctattttcatgtttctgtgttttataatatatccatttaaatctattgagttgctcttctagccttttaggcaaataaaacaactcatattttagaattaatgtgcaaacaaataatgtgcttttgccttttcagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggtaactatcagctacctctcactctaatacctgttgtctgcggtggacttctcacatctcaggctacatttcccatgctcctgggcgtctttctaacagggttgttcctcccaatcttgatggcaatctttttgctgaagtgcaactcattttaaacttcaattaaattgcgtgaaactgactgttggccctgtggattatcggcacccttgtgttagagcccctgatgagaaatgtgtatttttattgcatatttaggccatttgaaaaatggttattacttacccatataatacaaagaataggtttcttctaagaaattcaaagcacactgcaaattaatcttaattgtttggcatttattcattccctgagtcattcatctattcggtaatgatttattgaatacctcctgtgccctggacactctgttaagttaaaaatagaaaagtacaatctctgccct

SEQ ID NO: 71017 - DNA, 1506 bp, Homo sapiens
ctacatttatgtgcttgagctcagttatatatttacttttttgtgtctttcctttagggcattgatcggtattgaaagatacttgaaaattgttggttttgaggtttttttgtacatttaagcaacagtgtaacttgtaaacatacacaaactcaatcatattgactgttcctctaggaattaaattctatgattgctcattttcaggatttttctctagtttattcaacaattattgagtaaattgggcagctggcactttagttacagaaatgaatagaacatgcagattgtacccaatgggaagggtggttggtgggaatgggagatggatggggagtgtctatttgatatcatgtttgcagttgtgagcttcatatttgctccatataatatgttttttcaaatatcagggataatttttatctttcactaaacttgatgcagctgatgaaaatattgctagtagaattgaagcagagcagaatgacttgtaactacatcaccttgtgcttgcttacctgtcatttcctttgtaacttgtataagataataagctgaaagtagaacatatgtgagataccatgattcctgaggcttgctcagcaaactaatgacatccttgttcatatttacttgaatttaaaatgtgctgtatcagattcaaatacctctgtctgtcagattatcagattttcatgataagtaattttcctattagttttcttcatgttatcttggccataagacttgatattcactatatgagagcatttgtgttgtctttataaattgcaaggtggcttttaggttttaatgtaggtaattaaggtgatatataaaaataaattatcacttgtatgtctagagcccacagtttactaatcaagtgggaaaacaattaggggttgaatcttctcccatttgtttttttttttttttaacattctgtgctagggaaaaatccctttgaggcccttgtctttcctctgcttggcctaaagctcttcattctttaatacccagtagaaatctgcctattccatgaagctctatcctgaaatttgtagtaattcctcctactgaaatatctttgggctgggtgtggtggctcacacctgcaatcccagcactttgggagtccgaggcgggcagatcacctgagatggggagttcgagaccagcctgaccaacatggagaaaccccgtctctactgaaaatacaaaatgaacggggcgtggtggtgcatgcctgtaatcccagctactcgggaggctgaggcaggagaatcacttgaacccaggaggtggaggttgcggtgagcccagattgtgccattgcactccaacctgggcaacaagagcgaagctccatctcaaaaagaaaaaaaagaaatgtctttcgcattttcagtctctcacatacattcaataaatttgcctttaataagattttcagttgaattgaggtcaggacctcaattcatactaatggcatgccactgg

SEQ ID NO: 71018 - DNA, 1031 bp, Homo sapiens
attaagtatggaaataaatagaaaaatggcttttatttgaaatgaagatttaatttttttccccctaatataaggcattatgttgggaaaaaaattttaaaaaaaagttttgctttgtttagaatgttctgttcatgggaagaaatcaggattttacttgaatgaaaaagtaaaacaatacagaatacaaaacaactattccagttgtaatattttttcttaaggataactagtgtgactactaggcagtgatattgttttaagactctgctttcttttcttgttcaatgagaaaagtaagacagtttgcttggttggtgttcccatgtaaatcaagtcaacagatttagtaacaggatttccagtttgattcttagccacctgagcaagagtgcctctctgaggaatcagggataaaaatgatacatatgtattttttgaacagaagatctttgttttacagatacagctgagatttattaatccattgaaaaatttaagacgtcttggaatcaaaatggtaactgatatctttttggactgggaatcatatcagtttagaacagaagaaattgatgctgtgtttcatggtgcagtttggccccaggtaaacctcaatttctacatctgcctatgtacgttctgctttttcctttattactaactcaccaacatagctaccacccagacatgaatgcttacctgggtctttccttttacatcgagcccttctttctggaagtttttagaacacttttctttgccttcactaccacctaaaactcaagagttagtttctgctgtaccatggcatttacacttaaggctcagttgaatatgaatgtgtctcttaagcaactgtaacataactgtttttttgagatagagtcttgcttactgcaacctctgcctcctggattcaagaaagagattctcctgcctcagcctcccaagtagctgggattacagccatgcaccacaatgtccagctaatttttgtatttttagtagagatggagtttcgccatgtt

SEQ ID NO: 71019 - DNA, 1064 bp, Homo sapiens
actcgagagcatatgctcagaagtttcttttccctgggaactaatactaatttatataaactgaattttctttgtagttataagaatagattatttactctccaagaagtctcaactctgctgcaggaaattatgaaaatgatttctactgtcatgtctctacattcttcttaccatattatcccaaataattcccttactattaccaaaaaatggtttaaataaagcctcaggggtctcttaaataagttcttgatttagctagtaatatagctattttgaataagaagaaagttgtttatttagaatttagaatttatttagaattgaaatttaacttaaatgttcatagtggttgagtgcttttcttatcatcatgaagattttgtacaattatgccttaagagagtttattaaaatcaaatcaaatcactatctatttcagagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagtaagtgatatgttgatacttaaaagataacattaccatccttggttttaactttttaaaaaattattatcttggccaggcgtggtggctcacacctgtaatcccagcactttgggaggctgaggtgggtggatcacctgaggtcaggggttcaagaccagcctgaccaacatggcaaaaccccgtctctactaaaaatacaaaagttagctgggcgtggtggtggacacctgtaatctcagctactcaggagactgaggcaggagaatggcttgaacccaggaggcggaggttgcagtgagccgagatcgcgccactgcactccagcctgggcgacagagtgagactccatctcaaaaataaaataaaataaaataaatttaaaaaaaattattatcttgtttttcaggtgttggaatctggcaataagaagctaaaaagttttttagtatttttgaatgccctttactttta

SEQ ID NO: 71020 - DNA, 1072 bp, Homo sapiens
atacagaggttgatattctggtgacagtacaaaacttgttaaagcattgtgtggaccctacaagcttcctcaagcctatagcaaaacttttctcagttattaagaacaaattgtcaagaaaattgctttgtacggtttttgaggtctgtactattcatttttactccaaatcacccttttaaaaaaatgtaattatgacttgtaaaccatattaggggctttcttcatgccagggtgatgtttttatatgaatttgaatggggacaggtagctgaggggaggagggcagaaaagttaaagttttattcactgataaatacactgttttctttcctttcagactctttctgattttgagagtgggttaaaatatattactgatgttgtcaaggtaagaaagaagggtttctctttggcttcaaaagtattatcatttttgtttactgaagatttatatgccttcttttatataacttcaatggcatttcttatagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagaggtaggttattatagcaaaatttttaaattattttttattgttttggtaatacggctgcctaatacagtgacctgatctttaaatttgttttttgaggggggacaaaggtttttaggattaaatttcttttagatgaagaatcttatgtctggcaaaacagttattctcatgatttaaaaggcaaatattgtgaataaaataatacatatgaaagcattttgaaaaaaatcaagaagttatgtattagaatagggaaatccatagagatgaagtacattaggtcactaaaggctgcagaaagggaggaatggggcgtgatttctaatgggtatagggtttcttttgggagtgatgaaaatgttctggaattagtggtgatgatcacacaacctcgtgaatatacttaaaaccactgaattgtaaat

SEQ ID NO: 71021 - DNA, 1117 bp, Homo sapiens
ggtagatcatttcagcctataccagctatttcagatgattggaaaagaggaattcccactaacttgtaaaattgtaatcgcataccagaaactgacaaagactctgggcagttggctgtcattaggattttcatgctcatgaagggaggtgctttatttggttaagatgttcctgccccccaagcctcccagtgtgttccccaattaccctgtacctgcagttctgtgttcttttataatcggcagtttatttgtctctctttaaactctaaactgtgagaaagcaaaacccatggccctctcatttactgctctttcctcagcacttaccttgcctgcccacagttgctgattagatattttttatcggaagttggacgttggtgggaaaaactgcttaccacaactgtgtggtttcattatttgctttaaggtgacttttgttgtttattaaacatagacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacggtaataaatttattcggggtccagcaggtctgtgtgaattctggtgttggtggagccctgtcacactgaggctcttggtgattattgattgatttcagcttttagatttccttttatctcaacacttcacaattcacccctctactcttatctcttcaacttcaggcttatcctgctgcaactaagcagtaacgctccttctttatgattttgatagggtagataaatgcttttccatctccaaagtagttattaagagactcccatgtcccaaaaaggttattaaaaattagaatgtttccattttctactttctggtcagttctgcactattcaaaattcatctttcctagttaacagggataacatt

SEQ ID NO: 71022 - DNA, 1018 bp, Homo sapiens
aaggcaacaagaattgagtgcaggtgaatattatagctgggtcaagtcagcagctaagaacatgaagaaatccagaggcacacaagccgcatagtgcttatctttgaggttgaggttgtgagtaacatttccttatatgttatgtccatgtttgaaattttattaagaatttgttttaggccaagcatggtggctcacacctgtaattccagcaatttggaaagccaaggcgggaggaattgcttgagcccaggagtttgagaccagcctgggtaacatagcaagaccctgtctctatttaaaaatgtatatttacatttacaaagaaattcattttagttaggagtaaatatatattagaaagcctttggacaaattgccacttccaggttgccaagaggaagaaaactggcatttattgacatattatattctaagcactgctacattatctctcctaatctgcacaccctgtgagattgatggtacttccattttacaaataagaaaattcaggcttggaaaggtagaaaggaacatggttaaagagaaaagtcagggtatagggtttagttccagatctttctgatccaagttcacattcctaccatggtttcattctgcctcctgaagatcagggaatgtaatttacccaccttcctattgatttctgtgcctgttgcagaggtgaacatccagtaaatgttattaatttattagttttgtgtattaaaactagagcaaagagcactatctattgacatgaattacattaggtctaaatgttctggtgctagatgaactccataattactcctagaatgcatttagttttatgtgagccttatctaagaatgttagatgcattttcaggatgaaaaagagtcaacagagcacatatatccgtgatgtatattaaaaagtccctccaaggtattgagagttaataccatgtctcatgcaagataatagctctgaagcaccaagtatttcctgaggttgctgatcctggttccca

SEQ ID NO: 71023 - DNA, 1050 bp, Homo sapiens
acaggaggctgaggcaggagaatcacttgaacccgggaggcggaggttggagtgagccgagatcgcgccactgtactccaggctgggcaacagagcaagactgtctcaaaaaacaaaatcttatatattagtaaacttcattttggtcttgcttctatggtctaagagagactcgttggcatttattttcagaaatcaaacaagggagtatcctgctgttgatcctaatataaatatgttgtcctagtaaccttaatcaacagcctaataatctcttctgtatctcatggtttgggggtttggggaggggcaaaacccaagcaaatggcacattatttagtgctgggctctcgtcactttagaagggccactctaacttcttggaatgcagctgacagtgttctttaccctcttctcatgccacgtgattgacagaaatccagtagccccagcaccagatccacgtctaccaccccagagctgccttctgcttcccccaactccagttcgaggtggacagaaagctgttgtgagcaggaaaaccaacatgcacatatttattgagtccgggcttcgggtaagaattaaccttaaaatgagacttgctactttcagggagtctgcaccttttagtcttctgttgaatttctagtactgctcacttccattggaaatgccttactgtaaatacattttagattttttttttttacaggtgcattggtccatttactatttatctcttgcagcacttacattgaagatgtaactgtcccagaattaatgattctgctctaatatgtattaaggtcttactgatgctttgcccatgagtccctctgaactactttgaatttttttaagagatggtgagtggccagacatggtggctcacacccataatcccagcactttgggaggctaaggcaggaggatcacttgaggagaggagtctgaaaccagcctgggcaacatagcaagactctatctctacaaaaaaaaattttttttaattagccaggcatgatggcacgtacctgtagtcttagt

SEQ ID NO: 71024 - DNA, 1096 bp, Homo sapiens
ggggaattctgtacaaatacaggtattctgtttttatttatatgtttttcttcttagtaaaatgtacataacataaaactcaccattttaaaaaattcaccatttttacccatttgaagtgttatgtttaagggttgtgtgttctttgtgcttaagtgtctatcctttttcttttgaagatactttcttgtgtttgaaaatgtcctgtggttgctttagcgtcaaatctgcttccacgcatctgcagcaaaacacatgaaatgagtatgtcttttccttttgtatcttaggcaattttatcaagaaagctgttggtcccagaaatcgatgaggtcatgcggaaagtatccaagttggcagtctctgcacaaagcgaacctgccagggtccagtgtagacaggtttgtagagagcacttatccccatagcaagggctgggccctgccgcatctttgtggcagaggtgtcaacactggctgaattctgaagaccaccttgtgtcgtattgttgctttatgctgagacttgggcgtcctggtgcaggtggtcaggggaggctttttctggggactgacaggcaggccaaaatttgaaggaagaaaaaggcttagctttcaaggtgagggggcagtagaggcttgaggtgagtgagagcttagcttggttgaggagctcaacacaggtaagtgaattgaggggtggggagccaggttgggcaggaccttgtggtcttgttaaagatttggggctttgttcttttttttttttttttttttttttttgagacggagtctcactctgtcaccaggctggagtggtgcagtggcgcgatctcggctcactgccacctccacctcccaggttcaagtgattctcctgcctcagcctcctgagtagctgggactacaggcatgcaccaccacacccagctaatttttgtatttttagtagagatgaggtttcaccatgttggccaggatggtcttgatctcttgaccttgtgatccacccaccttggcctcccaaagtgctgggattacaggcgtgagccatggtgcctggtggggctttgttctaagaatagcaaggagctatt

SEQ ID NO: 71025 - DNA, 1029 bp, Homo sapiens
ttggaactttttaaaatgagcattatagccaggcatggtagcgcatgcctgtatttccaccttttcaggaggctgaggcaggaggaccgtgccactgtactccagcctggctaacagagcaagaccctgactcaaaaaaaaaatggggggttgggggattcaagttaaagtatcttcatggtatatgaagatcaaaggttctcaactcaggcgattttacccccccaggtgacatttggcaatgtctggaaacatttttgattgtcacaactggagggtggaggtgctactgggatctagagcatagaggagcagggatgctggtaacatcctacagtgcacatggcagcccccacaggaaaggatcatctggcccacaatgtcaggagtgccgagggaggttcagaaacgggtggattgatgtgctggagtaaaattgtccatcagatactttcagattgttgttttcattgatttacatccgtcttgtttttagatcatggaagaaactgaagaaaaagctgcagatcgccttctgtttagttttcttacactgataactaaacttatcaaggaatgtaatattattcagtttaccaaacccgctgagactttgagtaaaatctggagtaagtatttccttttttatttaaatcaaacacatttgttgtcatagaattactgaaagtagatttgagaaattcgaatatgaatacttcagaaagtatacaatgtcaggaaaagagtccatgagaaaaaacctaaaaggttctatcagattgaacacagtgaaaatgttcccttctgaaaaaaaaacgtatctatgatttcataagtaatacctttcaaagtcctgtttggtacttaataatttcagatatgtatctctttttttcctatttatttattttccctcaggtacaactgacaagtgaaaactgtatatatttatggtgtacaatgtattgttttgatgtatgtacttgtggtctatatttccatccagtctttctttttgttcagtaggca

SEQ ID NO: 71026 - DNA, 1053 bp, Homo sapiens
gtctgtgctgcctcctaagaactttgttgatggttaaatgagatcatgttcatgaaaatgttagggtctcagctgggcatggaggctcatgcctgtcatcccagcactttgggaggctgaggcttgcagattgcttaagctcaggagttcgagaccagcgtgggcaacatggtgaaaccccatctctataaaaaataacttcctgagtgtggtgtatggagaatggccacgtagccaaatgctgaagaattaagagtttgaaggtcagatcaagctagggcccaggactggctctgcctgttatagcttagcatgtcacacagcctttctggaacacttgtttcttcatctgtaagatggaaattataattccaacgtcacagaattgttatgaggtctaaatgagataatacatgtaacacaattagccctgtccctggcatatagaaaaccttcagtaagtaaatgatagctttacaggcagctacttggagccaccaattctactgattagaaacaagcctgtacctatatacatacttacattactcactttagaaaatgtaactgttggccaggcacagtggctcacacctgtaatcccagcactttggaaggctgaggcaagtggatcacttaaggagtttgagaccagcctgaccaacatgatgaaaccctgtctctactaaaaatacaaaaattagctgggtgtggtggtgagtacctgtagtaacagttactcaggaggctgaggcagggggattgcttgaacccaggaggcagaggttgtagtgagctgagagtacaccactgcactccagcctgggcaatgggaatgaaaccctgtcgcaaaaaaaaaagaaaaaaaagaaaatgtaactgttaatgtcaccttatctcccttgaatctgaaactagttcttatggaactggtctgtttgagggctgtttataccccattagagtcatttaaccactctaggagttggttttctagtcgtttccagtgcctctcccacctcacttctctctagctcctgtgagcttctaaga

SEQ ID NO: 71027 - DNA, 1049 bp, Homo sapiens
gttactgtgggcagagctaagcctctgtgacccatcatggattagagagggaatctcttacttttccccccatctgcaagagctcaacaggtaaacagaggtaattcaaaacgtttctgtcaaggtcccaagttactttaatgtcttcagggccaggtttccgctgggaagtgggcctcatgttctctgatttcttattgcatcctgggtgaggtggtggctggagtgctatgtctagcattgctggtttccccatcccaggaacatagaggctagttttatatcagtgtttaatgttgaagtaacagtgataatgctgcaagagttgaaattttgttttgttttatttggggtttcttgccagatcagtagctggatataaatgttgtacatattgttgattttgttgatgttcaaatgtgtcctttcctacctgtctctgatcattactctttgtgtgtgattagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggaggtaagtttgctctttgaaaatatggcatgttcactggacttgataactactaagtgtgcatgtttgtgtcacacttacacttagggaggatcaagggtttgagcggttggggactttatagctgggacttcagattttctttaatgagcatgtgttttttacatttatttctgtatttgattcttattggtttaacatttactttaaaagtaatataaaatttctattctcttttccagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatat

SEQ ID NO: 71028 - DNA, 5571 bp, Homo sapiens
cactcttgttgcccaggctggagtgcaatggcaccatctcagctcactggaacctctgccttcctggttgaagtgattttcctgcctcagcctcccgagtagctgggattacaggcacctgccaccatgtccagctaattttgtatttttagtagagatggggtttctccatgttggtcaggctggtctcgaactcccgacctcagttgatctgccctcctcagcctcctaaaatgctgggattacagatgtgagccaccgtgcccagccaatgtttatcaacattcttttgactccatcacatctgagggatatggtacatatatccaccagaaacagtgaatcattaaggcattgattctaacatgtgtgggacagaattggcaattgatatgtcagtttcttccttaaaacaataacaatatgttctccccttttaaattttctctaggccatactggagatgttactattcaaacacagatgcagtcatttatgtagtagacagttgtgaccgagaccgaattggcatttccaaatcagagttagttgccatgttggaggtaagaaaacgtaaccactttaaaatgtggggcagtcatttacatattattacattgaagaataattaaaaagaatgcaggggttgttccctccatccttttaaaattattttcttttatggaaatgattttctattccaaaaatacagttgaggagggttggagacaaaacaacaacaaaaattaacctcgtaacttcctcttcaagccagattgcttgattttccaggaggttcagaagagctcacttaaacaaaagcatctattctaagtcacttctttgatgtgacttttaaaatatgtctttttatttttagctgttttagaaggattcaagttcagagaaatatgtatttctgggttactggcacaatgctggcctcacgtttatcgttttttatccttcccagtgtttacagtgcttttgaccttctttctgttctttggacacgagcttgcacacctggctcagggccttttgcacttgctgatccgtctgcttggaatactattctccagcatctttgcatggctgccttcctgacgtgtttcttcccacatctcttccccagaaagaagtcttatttattctctaatcctttacccttctttattctttataccgatattgtttcttttttttctttttctttttcttttttttttctttttttttgtagagacggggtctacctatggtgcccaggctggtcccaaactcctgtcctcaagtgatcctcctgcctcggcctcctagtgttgggattacaggtgtgagccattgcaccccacttactgtttttttacattatttttaaatgtatttgttggctgggcgtggtggctcacgcctgtaatcccagcactttgggaggccgaggcgggcaggtcaccagagatcatcaggagtttgagaccagcctgtccaacatggtgaaacctcatctctactgaaaatacaagaaaattaaccgggcatggtggtgtgtgcctgtagtcccagctacttgggaggctaaggcaggagagtcacttgaacccaggaggcagaggttgcagtgagccgagatcgtgcccctgcactacagcctgggtgacaagagtgagactctgtctcaaaaaataaaaattaaaaaaaaatatatttgtttacttatgtatctctccctctaaaatgtaagttctttgagtttaccctgataggaggaacaatgtatagtacttaattaagaattcaatacatcttattcactgaagttaataagatcatatattggctaactgatcaaattcagaggatgcattaaataatccatttttaaaaaatgaaaaaataatcaaatgtactatgataataataaaattgcccttgctctggaaaattagatggataagtttctttctcttgtcaaaaactggattctgaattgtttaatcaagggatgtttaaatataagttctaggccagttgatacctaggtaaaagcatcctcagacgaggggactatgtacttttgaattcttttttttttttttttttttttttttttttagacagagtcttgctctgtcgcccaggctggagtgagtggcgtgatctccactcactacaattttcgcctcctgggttcaagcgattcttctgtttcagccttctgagtagctgggactataggcttctgccaccacacccggcttatttttgtatttgtagcagagatggggtttcaccatgttggccaggctggtctcgaactcctgacctcagcagtttgcccgcctcctgatctgccagccttggcctcccaaagtactgggattacaggcatgagccaccgcgctcagcccaggacttttgatttcttgaactactgacttaatggcttccaagttataaattgcagacttaatagttttaaacatttggttaatttttttttttttacatcatagcattatatttattataagagcttcttagaccaaatttaaatgtaaggataaggtttaattgccttgggtataataggttttttaaagaacagttttatttaggtataattcacatgatatagtgtatttttatcatataaagtattgcttaaaaggaatggattattgacttcagtttacaatttttgagttgtgcaggattgttgttacttgcagtgttaggatttgacttataaagtcttacagagaaagaagtaaaagttggattctttctttaggaagtcacttttaattcatcaataaatatcatgttatgttaagtatgggccaagtacgagtcaggactgttaatgttaaaacatatagacacaggccaggtgtggtggctcacgcctgtaatcccagcactttgggaggccgaggcaggtggatcacttcaggtcaggagtttgagaccagcctggccacccatatctactaaaaatacaaaaatgagccgggtgtagtagcgcacgcctgtaatcccagctacacgggaggctgaggcaggagagtcacttgaacccaggaggcggaggttgcagtgagctgagatagtgccactgcactccaacctgagtgatggagtgagactccatctcaaaacaaacaaacaaaaaatatatagtatagacacaaaagcagtttaggtttcaactttttttttttttttgagacggagtttcactattgttgcccaggctggagtgcagtggtgcaatctcggctcactgcagcctccacctgccaggttcaagcaattctcctgcctcagcctcctgagtagctgggattgcaagcgcacaccaccacacccggctaatttttgtaattttagtagagacggggtttcaccatgttggtcaggctggtcttgaactcctgacctggtgatccacccacctcagcctcccaaagtgctgggattacagatgtgagccaccgtgcctggcctttcaactttcctatacacaaaaatgaattctaaatgggtaaataattaaatgtaaaaaatgaaaattataagaacatataaggaattcaaaagatgagatttaattatattaatgtaaacaaaactcccccaaagctcagatatggcaaatataaacaagattaagataagaaaccaggcctaaccagaagccaatgactaaggattagtgatctgaatcatagcaagatcttttgcaaaatgagcaaaaggcaattcgtaggggaaaaacattgctaataacatttgcatttgtttttaaagagacagggtcagcagggcgcggtggcttatgcctgtaatcccagcactttgggaggccgaggcgggtggatcatgaggtcaggagttcgagaccagtctgagtgaccaacatggtgaaacctcatctctactaaaaatacaaaaattagctgggcgtggcagcgggcacctgtagtcccagctactcaggaggctgaggcaggagaatcacttgaacccaggatgcagaggctgcagtgagccaagattgcacgactgcaacttcagcctgagcaacagagcgagacactgtcttaaaaaaagaaaaaaaaaaaagagacagggtctccctctgtcccctaggctggagtgcagtggcacaaccaaagcttgttataaccttgagctcctctctctgcttccttttttgtttgttttttaaaaaaatttttgtagagacccctgtgttgctcaggctggtctccaactcctggacttaagcgatcctcctgcctcagcccatgtgcatttcgaataccctagtaatatataatgagatgctatgtttggaaaagtaaataattcccaactctacaaaggctgcattgaagatggagacttttatacactgttggtagggtaacctttctggaaagctgttcatgcatgtattcagtttatcaaagcctgaaaaaaactgttcatactttgactccatttttagaatattgtgttaaggaaacagatttaaacagaaatttttgtataaagaccctgtcacttgggtttatctaatagtctagtggaaagactctaataagagtcagatactagaaaatagttaacacagtttatggtgcatgcatccatagtgtagagcatatttagccatttttttattttgaaaaagttgttgtagtttggagaaacatgattttaatttttaggcagggtatggaactatatataaatgtgatcttaaatgtgtaaatgtatttactaaataaactctgaagtatctgcaaaacaaagtactagtagaaaacacctaaaatgttaacagtgatcatatttgggaggtaggattatgagtgaagcttcttttctttatacttctctatataatttctatataatttcataatgtgtaatatattaattataaaatacacgtttaaaatgtatttttggacattttctaaactcgagagagcacattagttaaaagaaattaaatattttcaatttcatttaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggcaagtatcatgcttccagaagccatctgtgcatttgtgtgtgcttgcagctatgcacgtccacgtgtaatttttctcccgtgttgaggatgaaactttgatttacttagcagcttatttcataagttcctcaagcgttttctctcactggtcttcaggtgcatctgtcttctcaaccacacctacctgattacagttacttagataagcaaattctttgccaatttttagccttttccctgcctcacctcaccctccaattccttatccttcaggaattagcttaagactctcttctgaagagcttttcctaatgtatctctattcctactgcctaatcactca

SEQ ID NO: 71029 - DNA, 3979 bp, Homo sapiens
tgtgcgaggattacattgtcccactatcctccttactggccccttggtttttaggggtagtgaggggatcatgctaaaatattcctattctgctgattagaaaatgagattcccaaaggccgcggccatatttctcttattatttggtttatcttctgtgcctgcatgacacaatagtaacataactaaggacatagtaacataactaattacttgtttgatattgaataatatatttcattgggaggaaaaatatgcacctacgcatccaggaaattataatatttaatttggtatttagctctcaaaggacaaggttagatgttttgtatacctagttcacaaaatgacattgtgtatgttttttcttttattattttttaggtggctttttctcaagtatattttccagtctgtttggaactcgggaaatgagaattttaattttgggattagatggagcaggaaaaaccacaattttgtacagattacaagtgggagaagttgttactactatacctagtaagtgttggtatgatgagctaattgtagggactttctggtctccatccaacataactatttctttctttcttttttgtttgttttagtagagatcaggtatcatcactatgttgtccaagctggtcttagactcttggcctcaagtgatcctcctgccttggcctcccaaagtgctgggattacaggcatgagccactatgccaggcctatttctgaataaattaattcatataataaagtatttgataaagtttgtaaactgctagtatgaacataacattgataacactttttccatcaactaagaggcagcttagtgtaatttaaggacccttgttctggtttacggccgggttgggctgtttataggtttaagttactaaatcttactgagagccagtatctttactaataaaatacataagataacaaatacccactggttttcagggggaaataaacaaagtaggtaaaagtaccttttaaatctgtgtaaagaattatataaatgttaagtgatgttacatgtgaagtgcctttttttcctgtatttgttactattttaattaagattagtttatcttaggtaattatattgattacttttaaagatctgagttgcagagactgagtgttgaagtaatttggtaccttaaaaatatcaagagaaggccgggcacaggagctcacgcctgtaatggcagcactttgggaggccaaggcgggtggatcacctgaggtcgggagttggagaccagcccaaccaacatggagaaaccccatctctactaaaaatacaaaattagccaggcgtggtggtgcatgcctgtaatcccaactactcggaaggctgaggcaggagaatcgcttgaacctgggaggcagaggttgtggcaggccaagattgcaccattgcactccagcctgggcaacaagagcaaaactaggtctcaaaatatatatgtgtatatgtatatatttattaagagaagaaatacctcaattttaatcaattattactgtcttacaaaaatattctccaacagtcttactgactatatgagaatactgttgttatttatacttttttcatttgttgccttgaatttacttagagaagagtagtacatttaaattaaagagttcatacagtttgctcaagattttttaaattatgcctctaatgttagtctgtcactcagggtatttctatattgttactgtttaaatttatggactaaaacgaaagaggctagcctctaagaaagaagagcgttttgaaccctgtaatgtctgttattcctttttgctaccttcagtaaattttagtgcccttagtttttgcttctcaaaatcacccatctctgtctgggcatctcctgcagtgcacagagcagcacagtggatagtttggagtttcagtgagtgctgctttacaccacactctttgttgagacagtgtcttgcttttttgcccaggctggagtgcagtggcacattcatagctcactgcagcgtctacctctacctctacctcctgggctcaagcgatcttcccacctcagcctcccaaagtgttgggattacaggcatgagccactgcacccagtctacaccattctcttgtcttgcacatataaacgatgttttttactgttggtgaacattgtgattacactcctacctaattctaagggagacatcatgaacttgcattttagttttttgctcaaatttgtcatagtattgttattttttaattgtaatagacatacttgccaaatactcaaaggtatcacttaccactgcagacttaaatataaaacaaaagctaattgtccagttatacctggaagttattttttatttatttatttttttgagacagagtctcactctattgcccaggctgaagtgcagtggcaagatctcggctcactgcaacctgtgcctcccaggttcaagcgattctcatgcatcagcctccagagtggctgggattacaggcatgtgccaccacacccggctaatttttgtatttttagaagagatggggtttcacagtgttggctaggctggtctcgaactcctgacctcaggtgatccacccgccttggcctcccaaagtgctgggattacaggtgtgagccaccgcacccagccatggaagttattttttacctatttttcacctaagaaggatggcagagaaaagggatgggacacctgccctttgaccacccagccatgaccttattacaagtgagttctggaggatgtctgcagatgggctgtgagattgaaagctgcagccatggctgtgtccatgctgtagtttagaactgaagtttagctttttttcttttggtctgtttatttgctgccagccaaaattctgctttttatagtacatccacaactgtactttctaaatacagctttcgaacacttttaactactctattatgaggggagtttaatataataggatttccattgagctaaaaattatgttttcctttttatttcttttttaaattctttttttaatttatttgagctaaaattatatactttatttgcagaactgctggcttttaaaaaatatcctgaagatggtattgatcttgctaattgatgttttgtgcacacacctgcacatgtgtgggggagcagagcatactatttcgtcttaaatggtataaaatctcaaccaataatgtgattcaacaattaccatttctttttaactcgaatcctaagacaaattatatatatatatattttaaactctaataacagttaccattaattgctgtaactcaattagataggatattttgaaggtggaatgtattagtctacacataccactgatttgatttctcttccagccattggatttaatgtagagacggtgacgtacaaaaaccttaaattccaagtctgggatttaggaggacagacaagtatcaggtatggtacaaagaccaggttatttggtagtatttgacatttattgattcttttaagggttaaaatcagtaaacccgaatatgtgttctattgtaatttaaatggagccacctagtttaaaatgaggtaaaattgggaactatttccttagagcatccattgagttaaaacttaaggaagcccagttttccagatacctgtttaatgaaaatcttttcacgaaaatctcaagaccttattacttcagctattctcaattagaaaggaccctccatttagttcttgtcagtctctcctctctgaaacacattgttttggaattcattaaagtaccttgcaggcataccatttagggctaatataaaaataaatgccattggccgggcatggtagctcacgcctgtaatcccagcactttgggaggccgaggtgggcggatcatcaggtcaggagttggagaccagcctgaccaacatgg

SEQ ID NO: 71030 - DNA, 1031 bp, Homo sapiens
tcctgcaggccacagcgaagacaaaaacctctggttactggcctcaggtgcaaggctgctccgcattggcagcgcggtaccattcctattattattacgtagtcttgtttctttctgggagaaagcacctagggagagttgggctggccccgcagggcgctccgggacacgcgtcctctgcaacgccgcagcctgcgccagcgttcgaccgggacgactcatcgaggcccgactcgcattttcagttgtcagattcgccactttttggtgtcagaatttaaaacaaaaattccaatttctctatttcagaagctctttctgtccagaaaaacacaagcaggagagacttcaggtttttgaattattcgtctcttctggcctccacggtatctacatccagtgagcggggaccgtgagtcgaaagcgacgacgcggatgctcaggccaccgttcccggcgcgcagtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtgaggggttcgagaagggcacctgggcgcgctcgagggagccgcggccgagggctggggtgcagaggaggagaggggccggccaggataccctagagtagccagctcctcagggggcgggtcgcggaggacttgactcactttggatcttcatctgtaggggtggatccggcctctcgcgttctcctccgtcctctctcggttccccttgattcctgcggggtccagggacccggacagcttggggacgtccgcagagcctgggttcgagttctttacccttatcatgaagttttccctcatccccagctccacttgctgggcagagttgttcttgcggaggctggcaacgcgtcagtcgcaggttcgccgaggtttcttggtgaaagatgagctgcggccccagagtggaagctta

SEQ ID NO: 71031 - DNA, 1028 bp, Homo sapiens
gtgcagccggcccctggggagtcaaggaccttgatcgccgataacaagttgccgttggcgggcgccgagggtgacccgcgagcgcggcacccgcctccccgcccctagcaggaccccctccgccccgcccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggtagggctggccgatcgcccgagccgggccccagatgcgctgcgggcgggtcgctggaggcgccgggggaagggcggacccacgcgcggctgagcctctcccgggccccggaggggcggactggccactgccccgggcggtgtccgccctgggccgcctggagactgtcacgccactatcccaatcccgtgaccatcccaagcctcccctgggcagcggaggggctgttaaggtcactgccccaggtcctatgtccgcgcagatcctccccacggccgcggacgggccggagggcgcctgcccagccgctatcccatgcggcgccaacctgtgagacggacccgcggtcgggtgctttgcacactggggactgaaca

SEQ ID NO: 71032 - DNA, 1026 bp, Homo sapiens
atattttcctgttcaaattatttccatgttatcctccatggtggtgttggcaagaatggatccactatagcagtaaggcaataatttcatcattcagtgtcaattttatgatacattttcttatcaccagttataaaaagattaaaatatgccaaagttcaagaatggggaaggaaactaagtatcttaaagaattcattttaggcacatagtacaaaagcattttaaaaacagtttaaactgatattttcctctttctacaagcttgctctgcatagacttttctgacatctagtttcattactgcacataattaagagttgccatttgttttcctgcattttgtgccttgaactaatagcagagaggagaaagggtagggaatgtatgagttcctgattgaaagcaggaaagtggccagaggtcaatggtttcacatatggggggatttattactcatcaagtaaattttattgaaatttcactgaaatatatttaaaagaactattctaatatttcaaaaggtaaaattttaactttaattcttaagtgggtatactttgtgcttgtgttctttacaccttgctcatgcaagtattaaatataatgcttttgtattttttcacatttgttttttaaaacttcagtacttttaagtgggcaagagttgggattcctgcaaactttttaaacaaatataacacctatgtttttaaaaagcctattgtcattttcaaggtagttgaacagaagaagacaagtacttattccagtgataccatcttataccaaaccattgttataatgcctttttcagggccgggcacagtggctcatgcttgtaatcctagcaattttggaggccgaggcaggtggatcacttgaggtcaagagttcgagaccagcctggccaacatggtgaaaccctgtcgctaccaaaaatacaaaaaaattagctgggcatggtggccatgcttttgtaaatccagctagctacttgggaggctgaggcaggacaattgcttg

SEQ ID NO: 71033 - DNA, 1026 bp, Homo sapiens
tagtggtaagaaatttttattattcatgatataaataatatacttagtcgtcaaacacaaagctggaaattatttcataaaatgtataggttttcttttgtagtgtaaaatcataataattagctatttgtgctccaagcaaaactgtgataagagttatattcagttaaattgtttagctgtagttatcatttacaactttctgatatcaagaaatttaaacactggaaactttaataagctacccagttgtgaatttgagaaggtgtagaaaagtattcttaaatgtgagattaaatggtctgttttaatactgaattaaagttataattaattctgtcgtaaaagctaacacatttaaaacttaatagtaaaattattttgtttaatttttttataggtagctcacatgaccaaaagtgaactatatcttcaagacactgtctttttggggccaggtcttttgtttttagaccagtactttaataactttatagacgaatatgttgttctatggatggcaatggtaagtatttttctccattttatttattttttaacaatgcttaagagctatttcagtgagctatcagtagcctcaagatctagtctaggccaggcgtggtgactcacgcctgtaatcccagcactttgggaggccaaggtggacggatcatttgaggtcaagagtttgagaccaacctggccaacatggtaaaactctgtctgtaccaaaaaatacaaaaaattagccaggcgtggtggtgcatccctgtaatcccagctactcaggaggctgaggcaggcaaatcacttgaacctgggaggcagaggttgcggtgagccgagatcatgccactgcactccagcctgggtgacacagcgagactgtgtctcaaaaaaaaaaaaaaaagatctagtctatacaatatatacaataaatgtttctgagtatttaaaattacttcttctaagctgtgaataatattatattgtgtgtagaaatggccacatatctataggcca

SEQ ID NO: 71034 - DNA, 1130 bp, Homo sapiens
taatgtacttagtggttgaataacttttacttattttatcccttatcacctcaaatgagtcagtgtgtacttaaagtaaacttttgtattctaaaaggaagattttttttaccaagtaagtttttctaagttactaattttcttacatgtcaactgactcttagctactgttttcatttttcatgaaagggaatatttaacatccacttttcagtgacagtgaaattttaactcaaaatatcaaggaacaagttaccttcagtataaagattcgtatgtttttctgaactggtacaacaaattccttttattaaatacaaattttatttaaaaaattcctgtagcccttttaaattctagtatactaaaagcaagtattttataacatactaatatgcctcttgaaaaatgattagtataaaaaatttcttagaacataacttgattcaataattacattataagccatgcacttaagcagtattgaatcacttttcagtttttagcagtcaaagtaagcaccctcaagatggctaaaatcctttatgttctgaatatttatgtaatcctttggcagtgaaaaccctgtgtctgataagtctcagagacaaactgctacttagaattacaggggttcactgttgtcctcaggattgacatttctttagtcttgtttctaattaatatgtagacaattctgagaacatctgtgataaaaaatgatgatacaatgggggcttcataactgaaataagacacaatgaaatctacagggtttatgttttatattcaaatataaccttattgatggtatactagcctcctgcacagggggatttccttcactcatagattcccctaacttcatctcctcttttccttgggctattagtcagtcaatatgcttgtgaacctgttcaggtgcttgatgacatgcagtcttgaatatatttagatgaaggtgtcttgaaatttgcaggcacaaagcactaaagtatatcaccatatcaaatgaagaaatcacctttagaagcaaaaaagaaaatataaaatcgattatgatctatcttttctcaagtagcactattctgtttctcccccaaatatcaaaccttaacctaaaattcttc

SEQ ID NO: 71035 - DNA, 1041 bp, Homo sapiens
tacttgagaaaagatagatcataatcgattttatattttcttttttgcttctaaaggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccattgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaaaaacatacgaatctttatactgaaggtaacttgttccttgatattttgagttaaaatttcactgtcactgaaaagtggatgttaaatattccctttcatgaaaaatgaaaacagtagctaagagtcagttgacatgtaagaaaattagtaacttagaaaaacttacttggtaaaaaaaatcttccttttagaatacaaaagtttactttaagtacacactgactcatttgaggtgataaggg

SEQ ID NO: 71036 - DNA, 1001 bp, Homo sapiens
acagcacttaatacacaccttttacatagtaggcaccagattaactgtttgttgaatgaataataaagacgtaagacataatttttatttttcataatgtgaaagaggttgtactatagattattttattccctctagtgaattcatggcacactattagtcataagtagattattgcttgatatttggaaagcttaatagaaatggtttttactgatgtgggacttccagtcttttttatcttgaccttaacagttcaggaaacccattgtgggcaaagtatactacattgtacttcctataacattttattcatgtcttatattttttcttttttagtaggtattttggtattcatgtattacttagaatatttttatttcaaatagatgagcatttgaatattcaaaaattactacttttgaaaattaattgtacaagtttagaacctgagatgaaaagtggtcctttgtaacttaacttgtcttttgtgtttttagagtatggaagagttggagaagaatcatgataatctacttactggtgcacaaaatgaatttaaaaaagaaatggctatgttgcaaaaaaaaattatgatggaaactgtaagtgatcatattgaaattgaaaaaataaggattaatataagcaatgaaatattttatttgctgaaataggtataacacttaaataaaaattaaacaaatgtttaatatctccttccatgaaacagcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagct

SEQ ID NO: 71037 - DNA, 1065 bp, Homo sapiens
gtttactcatctatgaaaggggaatgctgagtatctatctcttagaaagtttaccattactaatactgtgtagtggttagaattattagtaatgacaaaatctagggtgggagtatgtaagtcaatggctaaagtagggtagaggccaaaatcattgagaaacaggtcacgaaacggaaaaccattattattggaaggatcatctgtgtggacattgaaatcaccaagaattaagacatgacttgattattgttaaaatttcccattcagcaactggtagaattaatatattgttacatattagtggtgaacataaattatctaaatgtggtcataatagttgttaaaattttaaaagcattgatttttaacactttcttttaagtttaatgtagaattattttttctaaatttaaaattttacccaaattgttattacacagttttttttcttttatatttgtagaatatgtttcgacagcaacaaaagattcttcaacaatctagaattgttcagagccagagattgaaaacaattaaacagttatatgagcagttcataaaggtttgttgtatgtggtaacacaatacatcgttataaaacataatatatttatggaagtagaagataattctttctaagtttatgggaaaaaacattttagactttaactacttttccattttgaattcattgtttctgatttaagtgataaatatatttttacttgaggattcaaatggttttgttgggattattcaagacaggaaatggtaaattgggaattttacttagaaatatacttatcatgcataaaatccatactttaataacacttcagtcatagttctctgtttaagtgaaaatagactctataataatcatttttaggttgtattttacttgtttttttatccccagtgtttgttaaatagaaagtacccaaattattgaattctcttgttttcaaatgtattatagaagtattttatggcacatttgcttttagaattattacagtgaccaaaaatgaatttatatccaacataaaataacagatataa

SEQ ID NO: 71038 - DNA, 1031 bp, Homo sapiens
tatctgttattttatgttggatataaattcatttttggtcactgtaataattctaaaagcaaatgtgccataaaatacttctataatacatttgaaaacaagagaattcaataatttgggtactttctatttaacaaacactggggataaaaaaacaagtaaaatacaacctaaaaatgattattatagagtctattttcacttaaacagagaactatgactgaagtgttattaaagtatggattttatgcatgataagtatatttctaagtaaaattcccaatttaccatttcctgtcttgaataatcccaacaaaaccatttgaatcctcaagtaaaaatatatttatcacttaaatcagaaacaatgaattcaaaatggaaaagtagttaaagtctaaaatgttttttcccataaacttagaaagaattatcttctacttccataaatatattatgttttataacgatgtattgtgttaccacatacaacaaacctttatgaactgctcatataactgtttaattgttttcaatctctggctctgaacaattctagattgttgaagaatcttttgttgctgtcgaaacatattctacaaatataaaagaaaaaaaactgtgtaataacaatttgggtaaaattttaaatttagaaaaaataattctacattaaacttaaaagaaagtgttaaaaatcaatgcttttaaaattttaacaactattatgaccacatttagataatttatgttcaccactaatatgtaacaatatattaattctaccagttgctgaatgggaaattttaacaataatcaagtcatgtcttaattcttggtgatttcaatgtccacacagatgatccttccaataataatggttttccgtttcgtgacctgtttctcaatgattttggcctctaccctactttagccattgacttacatactcccaccctagattttgtcattactaataattctaaccactacacagtattagtaatggtaaactttctaagagatagata

SEQ ID NO: 71039 - DNA, 1005 bp, Homo sapiens
gcctcccgggttcaagcgattctcctgcctcagtctgccaagtagttgtgactacaggtgtgcgccaccacgcccagctaatttttgtatttttagtagagacaggctttcaccacgttggtcaggatggtctcgatcttttgaccttgtgatctgcctgcctcagactcccaaagtgctgggattacaggtgtgagccaccgcgtctggcctacatttagcctttattaacagtgttttctcatggggaaatttaaagtctgtccttgacacattgttttgtttattagctcttttttattgttcctaagttaaaaaattatctccagttaggaaaatcagaatttgggtgctagtagctgagagttttctcagaaaaaaaaagtaagcaaacaattctgcattttgaaattatgcctatttctaaatttaagtttaaatgtctttccaatattgttgaaccaaccttacccatatttacttgaatatgtgggaacaaaatacttttttcaacattaaattttaatgaatttttattttcaatctagttgacattaacaaggctcttcttgccaagagaaagagactagaaatgtataccaaggcttctctcaaaactagtaaccagaaaattgaacatgtttggaaaacacaacaagatcaaaggtaaggtggttgctttttttttagagccacatttcttagtatttactggtataaattacttatgaaaaatactattctaggatcggcacggtggctcatgccagtaatcccagcactttgggaggccaaggcaggcagatcacttgaggtcaggagttagagaccagcctggccaacatggtgaaactccatctctactaaaaatacaaaaattaaccaggcgtgctcgcttgaacctaggaggcagaggttacagtgagccaaggtcgtgacactgcactctagcctgggcaacagagtgagactctgtcaaaaaaaacaagaaaagaaaaatactat

SEQ ID NO: 71040 - DNA, 3331 bp, Homo sapiens
caaaccgtggtgtcttatgtttgggcaaagccctgcctcctcctacagatgaaggaataagccatcatatcaacccagagacagtgtcttatggctaaatagagccagtttccttcaatagaaagacttgacaaatggacatcttgaaaataaatatgctttggtaatagctgtgtaaaaatctgtagttgtaggtcttagaaaaatgaagcatgggccgaaataattttaatcctcttgggtctctttgtgggcacatatctaggcatactgtccctacaaagctaaacaaaactaatatttgtttttgttttggaagaggaatgatggagatttgtttgttgtctttttaatgtataagattgtggaaatgattaaggtcatatggctcttagaaagtttgatgcacttatattctttcatcaacgtgagaattaaaatgtattttctgtctttcatcatttagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgacactttgatttttaaatctttgaggattgagtttactgttactcagattcagcagtcacttgagtgcctttactgtgtatcaggttctgtgctgaacattactaaaattaagtggaaagtaaggaaagattagtattatacagaagaatgttgctttatggggggaaaatagtttctaaatggaatttatcatatggtaaaatttaggatatctgggtatcattataaaagctgagatttattctagaaaagttagagaaatgaacatttgtctgtaatgacgatttctgtggttagatgaatatagtccatacctaattaggagcttgataatgggatggataatacaatcataggctattcatagactcattctaatgattctgtgattcagtagaatcattagaacagaggaacctcagaagttgatgagcagtcagatggtcagaaccatttgttcaaatcctatagaaaaggtcactctgtgttttagtttttttgtgctgctgtaacaaaatacctcagactgggtaatttacaaagaacagaaattcattttcttacagttctggaggccgagagtccaagatcaaggggctagcaggtttagttgtctggtgagggctgctttctgcttttaagatggcttcttgaatgccgtgtcctcacagagcagaagggcaagaaggcacaaactgcctctgtcaagccctttaataaagacatctaattgaattgatgagggctctgttcccatgacttatcaccctctgaaagccccacctcataatacttttaaattgccagttaagtttcaacatgaattttggacagataaaaattctgtgatacaaaagaaggaaggctgcttctcctgcctgattctcaaggtgttccctccagctcccaggcccttcgggcagagtttcaaaacaactgtctggacgaacccttgctttttatcggcaaggacaccaaggccacggggatgacatgacttgctcaaggtcttacaaccagttagaggaagaggtagggtgggaacccgggttgtccctctttcctgtccccaccagcccatgctgcctccccaggactgtggcacatgtgggtgaagagcac

SEQ ID NO: 71041 - DNA, 1050 bp, Homo sapiens
ttgcttttgataatgcatatttctgtgtcttatgtgatggcaagtcatcagtcagcatgtcagcaacgcctcagttttctaaacacttaaaagcagggacttcatcttgttcatctctccatatacgcaggaagtatttatcaagaaactgagtgaataaataagtatgagtgaataaaaatgaatgaaagagtggttttgtttaagtgccagaagtaattttcttttgaagtcctctctcctgcctggataacttcactaattcaagtataatatttactatgacataataaaaaatctgaactcgtgttggaaatgtatattgtgtgagcattttagaattgcaagacaatgtttttgtgtttcccaacattgtttttatagaactagtatataaataatgcttaactaatggtagtgaaaccatatacagaagtacatagttgctttcttctctctgcacaggagggcttatcgagacaaattgaagttttggacccattgtgtactagcaacattgattatgtttactatattctcattttttgctgagcaggtaagttttatatattttatgtgggtattaaatggtatttcttggtatactagcatctgaatgttttagaaaatgatacacatttacaatcaaaattttaacttctcttattgtcttatagctcatatgtgaatatgttaaatatgtttcacaatattcaggcagcaaatataacagtcttttattcatttctcttctaaatccattaccagtattctttttatctggaactcaacagattaacttgtagatatcaggctaaaaccaagtagctctaagtatttataaccaaaaaaccatctagaatccttatctaatgttaattttctatgggtctccaattttcttcctctctttcacgcttccttgagtgagcacagtgtcttcagacatcccacggttccgttgtgttgtcccactcacaccagtagctcccatttatctttctttcaatcgctaggagttctccctcctctctcctccttcctcctctc

SEQ ID NO: 71042 - DNA, 1545 bp, Homo sapiens
agtccttgcgcttaaaactcaaggacttgcacatttgatatcacctgcagaaatagcttgatattgaaagtactatcaaatgtatatgtacataaattttctaaatgttgcattgaattagctttgacatctcacagtcagtgaccagtccttgaagaataccctccatatgtgactgttgttatgtagatctccatcgtacagctgttgttctcaaaccaacattggtgatacttgcactgaaatccagttgagtcctgctaagtccagtttagatccttaaagtgacccgttaacatgtatttcatttgctcctaatgaagagttcgtgactagttattaccacattatataaaatgtcttgtaacaaagtacacttgtgcactaaacataatgctgagttacatgtagaattctcttttcaggaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgtaagtcttgctcgtgtttgagttgtttgcttgtgttcagaactaaggctacttgaaatgtgcatatttaccatgctaaatttatagctctaatatttgatgactaatatgttaaaggtattatctaagtgagaaagaaaaaagtccatctctgcaaatgttagatacggtacatactttgaatatccagagtttgtaatatgttatatttggacaggttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggtgttgtattgtcttattctaaactttttgatgttttaaatgagaatttaattctggtcaggcgcagtggctcacacctgtaatcccagcactttgggatgctgaggcagctgagctcaggagttcgagaccaacctgggcaacacggtgaaaccccgtctctactaaaaatacaaaaaattagccggatgtggtggcatgcgcctgtcattccagctacttgggaggctgagacaggagaaacgcttcaccctgggaggtggaggttgcagtgagccaagattgcgccactgcactccagcctgggcaacagagtgagactctgtctcaaaaaaaaaaaaaaaagaaaagaaaattttaattctgaccatgtctctttttcccctacgtattttaatttattgcaagtaaaaataattcttaatatttactgtgggtattcatagctagtctgttttagtgctagaattataaccaaatttg

SEQ ID NO: 71043 - DNA, 1004 bp, Homo sapiens
aaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattaca

SEQ ID NO: 71044 - DNA, 1022 bp, Homo sapiens
tgtcaagtgactcccttttacgtttattttcttcttaaggtatatgagatcttctactaaagaatgaggtgaaccttttctgactaaaacttacacatcaaccttgaaaacatcaatatgaaataaggaactgtctttttcgttttttgttttttgagacggagtttcactcttgttgcccaggctggagtgcagtggtgtaatcttggctcagtgcaacctccgcctcccgggttcaagcaattctcctgcctcagcctcccaagtagttgggattacaggcgcccaccaccacgcccagctaatttttgtgtttttagcagagatggggttttaccatgttggccaggctggtctcaaactcctgacctcaggtgatccagcctcctctgcctcccaaagtgttgagattacaggcgtcagccaccacacccagtccagaactgtctttcaaaattgtaattacagcaagaatccctcttcttcctccgatctacaggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaaggtatgtttactgccaaacaaataagaatgggagcataaaacatccttgacaggtagagagagttttgaatggcttttgttatttaaaataatgattctctgtgtatccctttaccagccttgcattcaaactagttatgaaagtaagagaacaacataaatcactgaagaggatcttttcctgttattgttgcagtctggtgttttgttttgttttgttttgtttggaccaagcagatttaccttagctgaaaatatgtggtgaagttttaatttggaaacaaaaaaggatatcaataattcattaaataaagatggtt

SEQ ID NO: 71045 - DNA, 1058 bp, Homo sapiens
ttgagacaagattatgcacaaatacactaatgagctactgatagttacagaaaagcagtgactgtgcatacttcccaccagctttgacatgctttggtacttgcagtcaagtctggcatggtgctactttatttcatagtagattatcaaagcatgttatgagagactaatccatgagttgaatccttgtctgctttccttgagtaatggaaaaaaagtaaatacgctcagtaagaacggtcaacgcagcaggatctaaacaatgactgtaggtacaggcaaacttaaagcacttgtgagtgtgaacgctgagccctttgaaaattttaatctttctagagacttaatttctttttataaagggaatcttaactcaagaataaaatgtatcagaagccagaagtcattttattttctctttggttttatcgtaggtttatttgacatggcctgtgccaaactgtgccgagggctgcccaggttcctggattaaggatggctattgtgacaaggcttgtaataattcagcctgcgattgggatggtggggattgctctggtaaggatgtgttaaactgtaattcgttcatttttatggaatattttcttcttaatcattattgaacatgtgctatagacttaaccaaacattctttatgtattaataaagaatcagtaatgctgggcatggtggctcatgcttataatccagtgctttgcaaagctgagctgggaggagtgcttgaggccaggagttcaagaccagcttgggcaacatagtaagaccccatctctatcaaaaaaaattagccaagtgtggtggtgcaaacctgtagtcctagctacttgggaggctaaggcaagaggatcatttgagcctaggagttagaggctgctgtgagctgtgattgcaccattgtactctaacctgggcggcagagtgacagcctctctcaaaacaaacaaatcagtaatcaatggactctttggaggtggtaattagtgccctcatgtggcccagtttattcattgttgagggcattgaacaagagaaaatac

SEQ ID NO: 71046 - DNA, 1956 bp, Homo sapiens
atttgggaaatgcatctggtctgtgtaggtctttttgttgtgttttgatattgtcttaccatttcaagattaaagatcaggccagttgcagtggctcacgcctgtaatcccagcactttgggaggccaaggcaggtggatcacctgaggtcaggagttggagaccagcgtggccaacatggtgaaaccctgtctctactaaaagtacaaaagtttgccgggcgtgatgatgcagtcctgtagtcccagctactcaggaggctgaggcaggagaatcgcttgaacccgggaggcggaggttgaggtgagcagagatcgtgccactgcgctccagcctggcgacagagcgagactgtgtctcaaaaaaaaaaaaaaaaggaaagattaaagagcagagtgggaatttaaaggtgcttcatccttgagattcagtcttttcatgtgtaatcctcttgttatttgatagttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccaggtaagggatgcacagaagcttttacagcccaaatcaaaggttaagatgttaaaaatgtgtaagttactatattagaagagggaaggggacttacagagaggtgagttgattggaatttttctaatttttcagtcactgccattggtttggtattaactgaagtcacctagaatcagatccaagaaccttcttcataaagtgtgttatagaaatgctgtctctttgaattttgggtttaaaaatatatatactgaatcttttgcattttttgtaatgtttaaaattaggactccatctttaaaagtctgccagagcaccttgagagcagacgggcagaaggaaaggacaaagaggaggaggtatgacttaaggggtatttcacatcttcatatgccaagtgtttttctcagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggtacaggactttctaaaaattacaagactgtgatttctaattctgctcttttagtgtggtacagggatttccataatttcattccctttacccttctacctccatttcttcctttctctagctcttcattgccttcccttccttcctttcaaaaactaaaccaaacccaaacagctctcattcactctctttttttgtttgttgttgttaaaaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtgagtgcctaagaggaggggggttgtctagcgtggaagtcacttagcaaatcagaaaatgagtgcacatactactgtagtcaaatatcaggccagacatggtggctcacacctgtaatcccagtactttgggaggcggaggtgggtggatcacttgaccacctaggggtttgagaccagcttgggaagcatagtgagacccctgtctttacaaaaagtaaaataattatctgggcccggtggaatactcatgtagtcccagctgcttgggtgttggggggccgtggggggagtagggggtcactggccaagatgggaagattgctttagcctgaatgttgaggctgcagtgag

SEQ ID NO: 71047 - DNA, 1007 bp, Homo sapiens
cagtcccgagtcatggttgacaattcagcaaactatttttgggtggcatgtgtggtataagcaggtcgaggtggagtggggtagcaatttgaattgaacaaggaaaaccagcaggctccaggtgtggtgagactcctttccacagttcagtctcccagtcagagatttatttggattttcagagttgtctttgtggaggccaacacctctcagagcatcaagctaatcacacataatgttctttgaaggttgttttcataattccaacacctgtgatcaacttcagggactaggacttaagatttttagagactagagagaaaatgagaaagaggaagaacagacgcagtgtcagcatttgagtccaggcctcgagtgacttgctttccttaggctttgcttcctgattacattatgagtactctgagaatgaagtttcctatcactgcgttcccaaccaaacaaaacaccttttgtgtgtatgatgagctccaaataagagtttatacagagtgccatgagaacatctgggctttaggtgtacttggggtcaaggcaggctttgcataatagaagcattttagctgggccctaaacagagcagccattctcccagcagagaagggagcagaagagaccattctatgtagagggaacagcctgagcaagagggctggaggcctgaacataaatggtgttttcagggaaccaaggcaatggtttctagcacaggcagggattttggtgaggatgagattgtaaagacaggttgaggccaggttgagaaacgtctctgttaagaatactagattttttcctgtaggccgtggaaggacacagtctgatctgcttctaaggaacatactagggaaaggtgtggtaggaaaaccagttcagctgctgctgccatagcccagtaagacgttcccatgcaaaagttgcttggcagtgggatgccaacgatggaaatggttccagaagcatctgagagaaacactcaacatcac

SEQ ID NO: 71048 - DNA, 1063 bp, Homo sapiens
gcttgtttcctggatagagaaggactcatttgtttaacagatgagctcctacaatgtctcccatccaagtagtaaccaggcccaaccctgcttagcttccgagatcagacaagatcgggtgcgttcagggtggtatggccgtagacgagctcctacaatgtcttaggtgacattacagctgctggggatgcagcagtggacaaaacagacaaaggcccggatggaacttagggtgtgaacaatggaagcatgggaggaggagatgaggggaagtcataaatgtcatcaatgcacacagcctgttgtttacccaaagctttcactcataaaggtagtgtgcttcagatacatggaacatctgctaatgagaaccattcattagtaactaattgagggacaaatgtatttaaaatttatacttattagctcttcaggcttgaccattgatgccacttgttaaggtggactctggaggctggcctgggacgtgccttttccttaacatgtattgttttcagatcctttatctgattgacttaggacatagtccatgtgggtgttctctctatttgaccttacgtcaagatgcctgctattctgtcagaggtgtttcaggttgtaaatcgtgaatgtcccatctcttagagtagagagcataaagtccttgtctcagaatttgtgaggctctagttttcctgattttataaagaaatgttctttgagttctgccactgggtttagcttacctgattcttacttcctcctgttgtatgtcatttaacaattttgagggtgaaaggatgaagatggagtagtggtgggggagctgtgattagaggtgactagagagcagtttttacttagttcctgtcttaaccatgtttttatatgcaccccccaaccaaattccttttaacttgtttctccctaccccagaccaagtgttttactgttttatgatacattgtattatccttgtaatacaatggtaatgtgaataaccacttatgaattttttacttttttcatatttttcttcatagctttttttttttggagagag

SEQ ID NO: 71049 - DNA, 1519 bp, Homo sapiens
cttcctaatctgtccaataatgggctttattggaattatgaataatctttaaaaaatgatagtaatgaagtgcttaatttcatgtgcattttggaattagtaaatattggtggggatcttattaatgggagtttgaaagctctatctttggagttgggtttaacaattttatatcatacttgctaacttaatttttgtatccatgagataaaagtcttcatttgttaaaatattatcattttttatgggctataaaaaaatctgaaaaatttagtagtatgacaagcttctcattgctgattaaatttcaagaatgtaattgtaagcatgttggtgtttctttccagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatggtaagatctttttatggatattttaaaatcatgttatcattggatgtttgaataacaaaattctgagtggaatagaaatgattcattcttaaatgtctgataaacttttctaaaaatgcacaaagagaagcaaaacagctgctattgtattttggccttaacctcaaaaagggattgctgcatatattttactctgtgtaatacacatacctttctgtgctgtgatgaggactttcaatctgatatcacaattaccttgttctcttggctctgaattattctagaggcaatttttctactatataactcctctactaggtagcgttctgcagtttgggcagaacatacctggagtattgattctttacattctgaaatatatgaactgaatgtgtttcctccaaaatttgtatgttgaaatcataacacccagcatgatggtattgggaggtggagcctttgatgggattagtacccttataaaagagatcccaggctgggcatagtggctcatgcctgtaatcctagcaattttgggagactaagaaggattgcttgagcctaaggagttcaagaccagcctgggcaacatagtgggaacctgtctctaccaaaaaacaacaacagcaaccaaaaaaacacacagctggacatggtggtatgtgcctgtagtcctagctacttgggaggctaaggcaggaggatcacttgagcccaggaattcaaggctgagcagtactccagcctggacagtagaacgaggccttgcctcaaaataataaataatagcaaaagagactccagagagctccctctgctctccaccatgtgacgttatgagaagatgccatctgcaacctagaagagtaccctcaccaaaacccaagcgtgctggcactctgatctcagactttggccaccagaactgtgaaaaacagatttctgttatttataagacaacagatg

SEQ ID NO: 71050 - DNA, 1097 bp, Homo sapiens
attgggttgatcttaactgacatcctttcaaatttatttcaagtaaaggtaaattttttgctctgatgtagcgtttatagttcccttttatttctcaaatgtgattgatctgatataacttgaacattttcatgctctgagagtcattcctgctctggtaactttctctaaaaatctgagacctgttgttagactgtacagtggaagatgctgtcgtcagaatatacagtggaaaatgctgtcagagatacaaataattatagctcatgcctttggctattgtttagttgagatgaggccaagatgtatgtatgaggactgaataacaacacaggggaataagcaattgaatgcctgagttagtacacaacaattgcttagaaagtcagaagacagaagaatgttgtgggttgaaacatcctcgaggcagttctgacaccttttcaaggaggcatgagctttagggaggcttcatggacaagtaggagtttaaacagaagagagacaaggaaagattattttaggaagtggtgggagtaattttagcataaagttggtaatgtcagagaagtttgtgatcgctttttctttttgaattactagtggtttaacattgcagctagaattagttaacagcactaggttgcaagtgacagactcccaactcagacctagcttattaactagtttattattaaccagtttgttaactgggataattgaaaaatataggatgaggccaggtgtggtggctcatgtgtgtaatcccagcactttgggaggccaaggcgagttcgaaagcagcctggccaacatggtgaaaccctgtctctacaaaaaatacaaaaattaactgggcgtggtggtgcatgcctgtagtcccagctacttggtaggctgaggcaggagaatcgcttgaaccctggaggcagatgttgcagtgagccaagattgtgccactgcactccagcttgggcgacagagtgaggctctgtctcaaacaaaacaaaacaaaaaggttaaccaaaaaaaaaaaaaaaaaaaagaaaatatatatatatatatatatatatatatggtgaaatttctggcaggag

SEQ ID NO: 71051 - DNA, 1385 bp, Homo sapiens
cctggctaattttttgtatttttagtagagatggggtttcactatgttggccagactggtctcgaactcctgacctcatgattcgcttgctttggtctcccatgggattacaggcgtgagccaccacgaccagcctaagctgtgctcttgagcacccctttttatggtttctcaaacagcccaggctgttccttgtctgatcttgggaaggatatttaacctctctgagcttccttatctttgaaatggaggccagattaccttccttgcagggttgatgaggattaaataagatgggtatgtaaagcacctcacacagttcctactacataacagaccctcattaaatggtcatggctactgctgctattatattatcaactcttttatgtccttaaaccttattttgaaatatatccttgaatcagaatactttgatcatatagttaatattaccaacttgttaataatctcactaattgtaatggattgtaagctcactaattgtaagtccttttggactaagaagatcattgttttttttgttttgttttgagatagagtctcactcttgcccacgctggagtgcagtggggtgatctcagctcactgcaacctccaccttccaggttcaagtaattttccctgccccaccctccggagtagctgggattataggcacccgccatcacgctagactaagtttttgtatttttagtagagacagggtttcaccatgttggccaggctggtctcaaactctggaccttaggtgatccgcctgccttggcctcccaaaatgctgggattataggtgcgagccactgtgcctggccctcagaagatcattgttaactgtaaatttgttatcgtctcctcctctcaatataacaggtatttgatgctgtattttgataagccttttctatattcatccaaacttcgagaagtagaattgagggaaggaagtatcaaacaaaacaagctgggtgaggtggctcatgcctgtaatcccaggactttgggagactaaggctggaggattgcttgaagtcaggagttggacaagcctgggaaacaaaggagaccctgtctctacaaaaaaaaataaaaataaaggctgggcgtggtggctcacacctgtaatcccagcactttggcaggccgaggcaggagaattgcttgagctcaggagtttgagaccagcctgggcaacatggcgaaaccctatctctgcaaaaaaagtagagtagtcccagttgcttgggagactggggtgggaggatcacttgagccctggtggttgaggctgcatgagccgtgattgcaccactgcacttaagcctgggtgacagagtgaaaccttgtctcaaaaataaatacat

SEQ ID NO: 71052 - DNA, 1033 bp, Homo sapiens
agtggatcccagctcagctccgcccctcccagcccagccctcagggcccgctgcgcaagcgcaggtggggagggcgcgcaccttccctatgcccctccgtcctccaggtggcgctggagaccccgccgccgccgcagccgcctctcgcccggccagacccgggcggcgccggccgcctcgccggccgcaggtccgcctccgccgcgccgagggcgtgggctcccggctcccggaagcggcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtgagtagcggcgccgcagcctggaccgggcgcctcgaccctgcactgccctcgccgtgccccgcgatgccccgatacagtatgtattttttcattattagagacggggttttgccatgttgcccaggctggtctcgaactcctgagctcaggcgatcgccctgtctcggcgtccccgagtgctgggattacaggcgtgagccaccgctcccggccaaatacagtattctttatcataaacgtgtgcagagactatgagcaagtcagaactggaaaaaggcatgtatgtgattttagatattgctccctcgcccaccgttttttaaaaatagagacggaggtctccctatgttgcccaggttggtctggaagtcctgggctcaagtgatcctcccttcttggctttctaaagtgctggggttacaggcatgagctaccgcacctggcccaagaaagccacttttagcaacggggaggaaagctgtatttttaagtggtt

SEQ ID NO: 71053 - DNA, 1078 bp, Homo sapiens
acttgagtttgattttgaaaataagctgatgttcattttttaaaaatcattcataagaagacataactgtggaactataaagttatttacatggaaaataatttaaaggacagaaccaaacaaaatgttagtacagtgtttagttggagttcctgtttaaggagagcccaaagataaagatatttaagtgttttggggcccacctgagcaattcaagtcttgaatagctgctagctcactaatcagataactcctaatctagacataactgacaaataatttgccaaatacaccaagatatgaagcagaagcactgcgtggttaaccagacagatcccagcaaaagagatgaccacatttctaataactgtggctgtcatttattatcagcactatatcaagtgctggacagtcatcattttatttaatacatacaaaacccctaatgagcagatgagaaacaaaggcttaaaaatagtggaaataaattacctcaaatcaacaaatctttaaacaagaaagcaggatttaagcccaagattgtttaatggcaaagcctttgctattgaccactccatattattttattgtttctcaaaggatggtagttgaattggcaacatcagcaacaactgagaatctatcccaaagtctcaaattctacccaggtctactgaatcagaatctctggctatgagacctacaagtttgttttaaccacctctccaggagattctaaagctcactaaagtgtgagaagtacacctctactctatttctccaagcttaagaaaatatatataatatttcactttgccagtgaagattcttacaaaacccagaaaatgcatatcacatccatttccttgtttaggctatgtgatcaattgtcactataattcctacaaacagaatatataaaatgagctccaaggaaaatgacacgatagcattattaaccacctaaaatatgaacaagggctacaatgattggaattctttcaagacctgactacacatattgatttgggattaaaacagtatcacttagctcactctctaagctttaacagataaa

SEQ ID NO: 71054 - DNA, 1037 bp, Homo sapiens
atttaggaactgcccgttcttccaaaatgttcactgtctaccaagtactatcagactgtccatatacatagttaaactgctcccaacttttttaaagcaccgcagaccttccatgtggtaggcacgcctcaggttgtaactcttccctttgaattggatagtcattatttaacttttgaattttttttttgcttgcttacacttcagaaacagtgaataatgctttgcttttttaaagagaccacttctatttaaaagcaaacttacttcctaaatgcaaagagccttgcaaaatgtagttaaatactttacaggatgtctcagacccttgcttaagtttattttcattggtggagactccttggggctatttcacattctgttcaatgctaacacgtaccaaatttgtagaatcatgggagattgttggtatgaagcaggaaggtttgcaaaattaagacaaattaagctgaatgtcagtgttatgaccaaacatgacaatttccactagtccacaggaaagtaataataattggaagccctgcagttgaatccaggaatgccctttctgaagttgcttgctgtttaccaatgtgaaagcaaaatgatccttcaagtactgtttcttgagaatttgctattgttatgtgatcttctaatagagatattggctccaagctctttgcaagagtattttgcaataacctcttctttaaaaaggttgactcgatgtgaacatgtcagactacaacttgcctgacatgaaagttattattatgagaccttttcccctccttgacttttttgctttttaatgtccccaaataataaaccatctcaaatttcttgtttaaataatttttataatatgcaaactgtactgaacaccatggctatcaaaacgagcctgcagttgcactgatctccatggaaacattaaaatgcagataaacaatcctagacaatagataagaatgcattaacctgtttattacagtttgaatttcttcctagtacacatattggcaagttcccta

SEQ ID NO: 71055 - DNA, 1176 bp, Homo sapiens
ccactacactgattaaatgacttactggcacaaaactattgaggcttaactagttgactgttttaataacatcattaaaatttcattttggtttattagagcacatccatgcaaagttggaatctaaccattctcatgtctccttataatgcctaggggatctttgaaacagtatttttgccaactcatactttctattttcattctgtaaagataaaacatgtaagtgaaaacgtttaacaaacattaagaaccttcttcgaccaggcactctccttcgctacaaaatttccacattacctatttttttattagccatttttgaactctcttccatttctaagtttctccctgcagctttcctgaacatgaagcatttccttttcttttcatttctagctttcctttctctgtacctcatgtacacttggaagcttcagggacttagcactggtcatgccagcctctacagatcacatctctgtctataattgggtctccatggtaatgagaagcagaaagtgctgaagtagcgcactatgtaaggactggcaagagaaaatactgtcgcggcctctacaggcatagcattgaatccccatggtgcccaagaagcccgagagaagcacgctgtggtgtagagcaggagactgaggacacggacttggcagatttattagcagcaatattctaagatgaaccaaatttaagagtttgtaagtgctcttttcaattggaaaagacctttgaaatttttttttcttttcttttaggaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgccagtatgtcttgttgctaaaataaagggcctcaaaatgaaaaataggataacctaaataaagtacaattagtgctacaaatactaagatagaatattttagagatgcaatgagcaattacagtcaggcacggtggctcacgcctgtaatcccag

SEQ ID NO: 71056 - DNA, 1049 bp, Homo sapiens
agtagctggcacagtaggccactactggctaatttctctatttttttgcaaaggatggtgttttgccctgttgcccaggctggtcttgaactgctgggctcaagcaaaacgccctcttcggcctcccaaagtgctgggattacaggcatgaatcgacatccctggcctacccttttctaaagtagcatttattttaggaagttatgtacattgttgtatttgtttgagttgtcataggtactaatacaattttgatgtggtattaaaataattcccactggtaatgttttcctacttaacaaagtatagacagtaagaaatcaaatatatagcaaagagaaatttactgggtaaaatgtgcctagtattcatacccactaattctagagttgttgcttctaatgaaaagggaggaagatgatggtcccatgttagtattttaggcagatggagcatcagtcaaatcctggaactgctgtacccagctttaaagtttcactgtattgactacataatgcttccttgtagatataatctaaaattgttcagcagagcaaatgggtttatatttgacaactagggagcaatgccagcattattttctcttttgtagtatgccaaatatatttaaaaatataagccataattttaatacctaaagtaactgttagactgtgcattttcttattttagtaatagtaatttctgtttgtggtgaatatgagttttatttttaagtgtcctaaatgtttaataagagtcaagcctgagggagaaatcagtctggtagtttgtaattattaagatacagcagttataggccaggcacgggctcgcatctataatcccagcactttgggaggccagagcgggtggatcacagggtcaggagatcaagaccatcctggccaacatggtgaaatcccgtctctactgaaaatacaaaaattagctgggcgtggtggcacacacctctactcgggaggctgaggcaagaggatggcttgaacctgggagacagaggttgcagtgagccgagatcacaccat

SEQ ID NO: 71057 - DNA, 1047 bp, Homo sapiens
ccctataagcatcagcatatgctggatatccaagccttttacctgctactggcttcatttcatcccctgtccagcctaaacctacttcataatcctttacttcagccagctacctgcactagcaacttgataatcatccttgattctgtcttcttccttacccactacagtgtcaatcactatgatgttctcatttttaatatctctcacatctcaccatatgcctccatatccattgccgtttagttcacgccctcatcgtttgtaatctgaattactatagtagctactgattggttttcctgttctctttcaagccatccactaaagcctgagtggatctcttcatacttcattcttgcttcacatcttcctgtgactctccactgccttcaacgtgtagtctaacatcttagtattgcatagaaatggttttatcatcaagattcagattctctcactagcttcctctcttgtgattctttcacatatgcctatttcatatagccatagcaaactacttgcagttccctgaatgtaacattttcctattcccttttggtgtcgttaaatgttttcctttctctctgtggaactcccttccctcatcttactggcctggctaacctattattctttaagactccatcaggtatcaccacctgatagagtccataggtaactaccacggaggaagatcccaggcccttcaacatttccttgtgtctcacttggccagtttgagggtatttcgttgtctatgaatgttgagaaacattcagttgtgaggtagtgccaagtttaagggtagaattccagtaacaattaacattgtcttacagaaaagctgctcctcaaccacagcctagagcctgaattctgccccattacctcatatgcacatgccattggtcaccaggggcactggttggagtgggggtgactcaatgtaacctatcaccactactagcaacccagtttcaactgcatttagctagatgtgataagtgcagtcaactaccgtgttaacagaggaattatgatgct

SEQ ID NO: 71058 - DNA, 2389 bp, Homo sapiens
tgtttacctaaaagccttatgtgaatgaattctagaagtcaagggtaaacttagctttgataccatgaaaactagatcctaatactttatttgtagattatgtctttgtcgatatcaagatgctaaactaaaaataagtgatctgtaaagaagcactatctgctttgtggccactttcagttttttgccccctctaattgtgggcaaagtgaccatttcacaggatggtaaagttctacttaatagtcaggatcttaataatatcccagaatacaatcaggatgctgtgtatctgccagcttgtaaactgggcaactgctcttggattatgtgactgaatataatgtttaagattaggaggtttcaagtaaatgttctttacttgaatggtcatattttatgatgctacctttctttgtataggtgtatatttacacagaggtacattgacaatttaattatacagagtaacaagcatgataagctcttctatctggtttatcttgcattttgatagtagattttaatactctagttttttctcttctctttccaaaatgaattactcatcttccaattccattcccctttatttttcaaactacagatgtttaaatctgggacgaattgtatatgctgatgcatttaagtaatttataaaggcagaccttgttgcagcgtgtctttgaataatttttattcttttattttctatgaaaaaatttcttcattcatcaacaaataattattaagctcctattaagtgtcagggtactattctgggcactaaaggtacagtagtaaacaaaaggctctgtcctggtttgtttatattctggtctcaacaattgtttactgctctgataatgagtttgcagaaaatgtcaactttgttataagtgaatataattttataaaataactgagaagcgactgggtgcggtggctcacgcctgtaatcacagcactttgggaggccaagcaggcagatcacgaggtcaagagatcaagaccatcctgaccaacatggtgaaacactatctctactaaaaatgcaaaaattagctgggcgtggtggcacgtgcctgtagtcccagcactcgggaggctgaggcaggagaatcacttgaacccagggggcaggggttgcagggagccgagatcgcaccactgcgctccagcctggcgacagagcaagactccgtcccaaaaaaaaaagaaactgagaagcattataatacacgtaatagaagagttctcattcctactcatgtaaataagacagtactgtattagaatatgacaaatatttaatggtttttaatattttcatatctgcccttagttattgttaacagtttattttaattaaagtctttatgtctctaatttttcttttacagaaactggcagacctttcacttcgtatccaacaaattgaaacaactctcaatattttagatgcaaaggttggtatttctcaataatttgtagtataaactttgctgtgcatataccagctttcttaatcatacttaattttcattgcatttgggagtgattccatttaacttctgtatctgtgaagtgatactggttgtgtttttaattttactgcagttgcaaagaaaatggtgttcattatgaaccattaattcaaatgtacacatggtttgcgatttctttcattgtgctaggcaaacgcataatgcgagtaacatgttaacaagctgagctgttatctagttcacttcatttgatagaaaattccagatttattttactagttattatttgataatacaatactaatataaatctttagatgtctcagagcaaattttagagacaatatcagctgtttctatttgcagataccttaaatgctaatgaggaataccagttttgatgtcagaaattgcaaataataactaagaaaaatagaagactgttttagattgcaagcttaaagattttgataacagtgatgtctttggtttcatttttaatatttttttacatgtgttttttctgtttataaagttatggagacactagtgtattttcatgactaactttcctgaagttaatattttctttgtccatttaccaaaataaaactaagaaatattctgtaaatatttatgaggaagaaaaaaatgatatccctttttaatatgaccagaatgtctagtttgtactttctacgtctctttatggacttcagcaactgtgtttctcttagaacatttctctagtttggaaacccggtcttgaacatgttcaagatagtcctctagcagccatacccacttgaaactatttgggccatagccactgtgctaactatggttatcagtcaacagttctcaatgagtattgctgcttg

SEQ ID NO: 71059 - DNA, 1027 bp, Homo sapiens
ttttagcaatttggatattcatgtcagctggagactgctcaatgagataacaactaatatttattgtgtacttcctctgtgctgggcatcatactaagtgctttatgtgtatttaattatcgcagtcagtcctttgagagaggtttagttatcccactcatacagatacagaaactaagatgtagagaagtttaaatcatttgcttagtcattcattcattcaacatatctttgcatgcccccagtagttgtagctgcattagctgcacatacacagatagaaagtagcagaactggattcccactgattttttaactggaaaagtcaatatctcattgctttcttacattgcactgctttatctgattaagaagcatgcttatgtcaacttcaagtgagagagtgcagtacaagtaccttcttatagctatattaaaatctatttttagactcattcacttctttgctatgctatgtctgtttgatgtaatatatttttatgtcaattccaaagatacatgtattcaaatgtaaggtgccattttctcccaaggtaaagtcactttggtgttttgaaatgtttttgttaatagtgcctaataggcctctagtccttatttatttaaagcctcaaacaagaaccaactgactgtttctctcaacaaaagaggaacctcaactgttagtttttgaactgagagtgaactgggaggaaaaagaaaacttttcccaccccccgacaggatctggtttgaaccaaacccaaccttaaacaacttcagtcacagataaaccctcaagccagaattaagtttgaaacaaattgctagggttctttcttcatcagtggcactgtttctagagttcttcattaaagagaagagtataaaactgcattctgtgaagaactcaactttgcaaaaactttctgcatattaggctacttttgtaactcttccagtgattggcaccagagtagaagagagattagatgacagagaaagtagtagaatcagacccacatta

SEQ ID NO: 71060 - DNA, 1070 bp, Homo sapiens
agtccactgagtttccctaaaacaataattttggattcgttgtgaagaagggtcagttactggtgatttgtttctttagtagtgacgtgtttctctgattattcttggtctttgtggccatgtgttggtatgtgtgtgtttgaagaagtaaggacttactccagtctttgcagactggctttgtctgggaaagcccttcaccagtaagctcatccagaggttctagacaggccatctgttgtggtgcatggcaggcttgctgctggagtccttgggtaggctggcctggtgcctaggttcgtagggttgttcctggagcctgatccactggggtggacctgctgattagctctataggggtgggcctggatccttagggttccaacttgaagcctaagtctgcaggggttggtctggcactggggtgagccttgagcctgagtctgcagtgtctggccaggttccaaggtgggcctggtgcttggaacccctggggtggacctggagccagagtatgtgggggtgggcctgggtcctggttgtactgtgactagcctggagcctgagtctgcaggagtggtcctgcagcctccgtccatgggggccaatctggcaatgcaatctactggggtggtcccagactctgggtctgctggaacatacctagaccctgactcaccacagggatttgtctggggccagcttggtgctggggcaagtgtgcagcctggggtcacaggggccagactggagcctgagattataggtgctggcctggtaacttgggctacatggggctggcctgggtcctacggcaatagtggctagcctggaacttgagtccacagggatggtcctggagcctgtgtttatgggtgtcagcccaacagaagggcctactgggatgggcctaaaccctacttccactagggtatgggctgcaggagccagactggggccacaggagctgacttggcactggtcaggcctggaacctatatctgcaggagctgacctggtgctggggtgggcctgaaccttgggcccatggaggctagccctgtgctggg

SEQ ID NO: 71061 - DNA, 1070 bp, Homo sapiens
ccccaaatttgtaatttgttgactgaagacatttacgtttgttatctgcttaaattgcaagaaaaggtggttcatttgtttttgttttttgtgtggtttttttttgatgtttacattaccagtgacaacaggtttttttggccagtattcatataagaagctttttattctgttgcttttatattttcttctttatttaaatacattaattttgcttgtttggttggtgtagactgcaaaaatggagtctggactgtaccagttattcatagatggattgtatcccatgtttcagctgcgtatcaataatgtgtatttcacctgtaagggagcatatttttaaattttgtttatgctacaaagataaatcatcaatgcatttcatatttttgaaagtcatttttatttattaattttggggacttactgtgcttctttaattcttcacatattttatagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaattatttttctactctgttctctgtgtgtgtatatatatatatttttaatcttacaaaatcatattgactcagcagctcacctccagagaagagatgactaaggaaaaataatgcttttgagtttatcaaaaaaggagtatttgaagtgtatcctgttttctatactttgagtatatgctgtttttctaattctcagggacacatttatcaaaagagaaaaaaaggccaggtacaatggctcacacttgtaatcccaacactttgggaggctgaagggagtggatcacttgaggtgaggagttcaagaccaacctggccaacatggtgaaacccta

SEQ ID NO: 71062 - DNA, 1050 bp, Homo sapiens
tctaaggttttttatattctctagagatttttacatagcctcttcctttacatttgatcttccatttgtaatataggttgaggatccttatctgacattcttggaactagaagggtttcagattttggaattttttgcattttgtaatatttgcatatacatgagataccttgggaatgggacccaagtctaaacatgaaattcatttatgtttcatgtataccttatacacatgacctgatgataattttatataactttttttaataattttgtgcatgaaacaaagtttgtgttaagtgcttatatgtggaatttttcacttgtggtatcatgttagcactcaaaaagttttagtttttggagcattgcagattttcagatgaggaatgctgaacctgtatattgcaaatgtttacattttaccgtacaacagtgaatctctgcttacacttcaggtatagttagtgagataagtgattgagtttctttttatttttctgtcttacagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccaggtactttcttgatatgtttgtctattacacaccaaaaaaaggcagtaactgttgctaaatgatccactcatccatcctgttatacctgagactatgctgtcaagcgaaagcaagtctttcctatagaaggccagagctatggatttttatataacataaacttgctatgcagatttactctgggagtaacccagaaaggacagtgcaaaagaggaaatcttggatctgtgcaatgttgacttatattggaaaataagaaaaacactgaccctgttgcatgatggttccctgcagtggttctaagtcatgtctttattgtatttcatctgttttaactgattgcttgtttaggattta

SEQ ID NO: 71063 - DNA, 1032 bp, Homo sapiens
taaagcatggggttgctagtcattcagccttatattctacaccattttctttatgatccctcatcatgtctaccatatgcagatgcactcacatgcatatacatgtatatataaaaatatatgcacacatatatacacaggttgataaaaatactgatgctttatgtgtgtgtttgtatatgcatatgcacagaaaaatataaatacgttcatagttatgacctagtgtcattgaaagaaggctaaaattattacagtatttgagaggtaaagaagtgcatattcatttagaaaaaattattatctcctcctccaaaagaaggtaaaagtgtcatttaagtatttagtgggttaagcttattattttttaaaactcactaatacagaacatctcattcccagtcattgccaaataacagatgttcttgtatattagaaacagtaccattctgtaagaacaagtcagatcaacaagtatttattaaacacatttagtatacccaatattcagtactttgggggatacaaaagaaatacaagacctagtacgcactgtaactacaaaggatatcagtagtaaatcccatccctcctcctcatccctcaataatcttttaaaatattagataaaagtttatggtgaaagaaaactgacttctagaaaccagggaatttttagtttaataaaatataggtgtgcatataatgtgccattcactttctctataaaacatgaaatatttgtagttgtcatgttctaactgggatcattttttaaaagaatgagagaagggtggcatataaaaaataaagaataagatattagaatgtaaccaaatcactgtataaaggaatactaaattacctaagctattcactaagccagtaatatagttgtttaaaaaatgttgcaagaggaaaaatgatttttatcaaatttgttctgtgtaccacatgcaagctatgtgtttttcatattacctttgtttatgtacatttgaaagtctttaagatccataattaagatggagt

SEQ ID NO: 71064 - DNA, 1380 bp, Homo sapiens
gtattttccatgtagtgagaatgtacagtgtatttttttaatattgtcagtagataatccggttctggtaattcatttacctagaatatcttgattctttagagcattccattttctttgttttctttttttataacgtagacacaggtctcactgtgttgcccagtctggtctcagactccagagctcaagcaatccttccacctcagccccgcaaagtgttgggattatagacgtgagccaacacgcctgaccaagcagtccattttcattgaacttattatgaaatgcctcctaagataaagtagaacatgtttaccatttgtttctagttgccttagagagttattttgtgaggcttagacaactttggatttttttttaattcaatgaactagttaaatcttaatatgtaatttgcttttgaacttttcaaaagcataagcataacctcctgataaattcattataatgaaatacagaatattatattgtttgttctcattacttattaaaacatttactgtgtatgcttaggaagaagaagcagacgttgaaggcattcagtataaaacacttcgaacatttcaccatggagtcagggttgatggcatagcttggagcccagagactagacttgattcattgcctccagtaatcaagtaagtttaacagtaccaaatgcattccttactaatgtactttgattgtgttacatgattggaagtctgatcatagatacttttttctcaatttccattttccacaatccaagatattagatattttgatatttgctactacttaataatttaggcttatcatctgaatttgtgatttaaatatacagccatgactatgatgccttgaccatgtgtttgagccaaactacaaaaccttttacgtgagattcatctgaatcaaggtctttacagattgttcactgaatttacaactttattgaaagtataacttaaaataactaaatttggttgagacattaatgagctttccttccccacccataggccaagatcacatttttttgtccaacagtatataaatctgtaagttctggtcctggacttcagtttttgtgaaagtgtttaaaaggaatgatggttttctgagaaaaaaatcctagcaatgcctgctgaagccctctttacaggggcaagaatatgttaggttatttaagatctgttacaaaacactagccttgccttctacaaatgtcaaatctaaaagatgtgtcttcttttagtagacagtacttaggaactaaaagttatcaactattaagctaacttcgttttttttaaattaagggataatttagatactctgaaattctcagctcttaagggtatagtttgatca

SEQ ID NO: 71065 - DNA, 1588 bp, Homo sapiens
tatttacatataaagcagtgcaataagaaaactgctataaaaacctttgttaaagggcagaggagcatgaacatatatgcttgcctaaatcaatgttctcatccaagttctactagaggcctcaattcactaatgaagaccccttgaatagacttagaaatctggtatgtattttacactttttaaagtgtacacatatcaaatagaactagccacatttcacgtgcttcataaggtcctgtgtggctagtggccaccatatcagacagcacagttctctctgcatcttcctctgtaaatcgacagtaatctttaatataataataatactctgtagttctcagcagtatattatgattcagagaagataatgtattttaatacaaatttcagggtagtatctaaatgtttaaaactgtgaaagaggtattagactcaatggtaaatggattttatgttatttgtcatctctatttgaatggacagagttgttgcttataatgctttcaggctgaggctgaatctgctgcttagtgtgtcttcacctagaggagatcagctatggccagatatttgtcatcattaagttagactgatttggtgtggttccagagatggaacgtggaataatgagtagaatttacatggaaacagattttggcttaacgttaagaactcttctaataattagagctatcccccaattgaataaacttcccaaagaaatagctagttccctgtcactggaagtgttcagagaggggttgtgtaaactctttttttcagatgctctcctagggattcaagcattggggggaaagaattgaactagagaaacttcacagtcttgactaactgaaatttgtatttggccttaaatgggtgtggtgggagggcctgccagtttcaaacccttataatagcccttccatcaacctggctttgccccaacctcaaatatgccgaaaccttgtataatcatttgtattatagcaagttttccaaagtatcttaatttcctgcctatacaattctgcttataccccaaactaaatccaaaatagcatttgtctctgcctataccacacacacacacgggccttttagttggctcagtggcaaacagtgctgccaggaaaacaggtttcactggtaaaacaaaaagcccaggctgtacagtccctgagatttctttatccccatgaccacccagtaattccatatgtgatttgggtaacaaattaaaggacttgattgtcaacaatattgttacagtagcaagatgatgtgtatttacatgcaaaaacttcatttttaggagactgatttgtcaagtttggaaaaatagatgtaatccaaactgtgaagtcagctatgattaggctcctaaacttattttaaaattgtttagtggctgctgtcttggcatatctggctgttagctatacaactattatacacacaaattacgaagtagtaaaatttgacagtgtttttctttccttgataagtgtatttctttcatttgtggaaaaactttttgctgttaactcttaagttcacctgaaatttgaagttattttcaaag

SEQ ID NO: 71066 - DNA, 1009 bp, Homo sapiens
tgtgctctaatccacagtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggttagtctacaaaactgcaccgaatgacagtgaacatatttcactactaagagaacttacacaaaccaaatctaaactttgaaagtatattgagtttgaatgttaaaaaaaaaaaagataagatccatagagaaagatgttcccagttatatgtgcctgagatttatgtaaacattatatagatagtgaaaaagaatggtatgaggcttcacttttgcctcatgatcattaatggaatattctgataagtgaaggctatgattaactgaacattggtatgtacaggaaaaaaacaatataaatgagatccaattaattacggtttttctacatcctgctttgacatacaaaaccagctaatgttgagagcccaaaaaacaatcttccaggagattttatagcttttataatattcagctttcctattagtatgctgtcatactttttgtgcatctaatgtatgcagaatatggagtcatattaattgagcaggcagttaagcatagccattaagagcatgaattctagaactggaatgcctacatgtttactcctgctttacttacttcttactagctatgagaccttgaataagatatttagcatctcctgtaaacatgaggaaactaatgcttgaattttagtatatgtaaatatactaaataaaaattccaagagggcatctgacaacattgtaatccatatgtatgttttagttgtcattgatacgagcagtggtaacactctcaggtttaatcaccaaagtaagat

SEQ ID NO: 71067 - DNA, 1119 bp, Homo sapiens
cgcgtctgccctacctgccctgtcgcatttttaagtggtgattcaggctgtggcttttgagggtgttttgcactgtaatacctcggtcgtagcaaagtgccgtgggaccgaagtattatggtgcagtgacttgacgctcgagcctggttgggcctgggggctgtaggcggagttcacagtatctagcgatggagctggtaggtcctgagggttcgtctgcagcttggaagacaggcccgtagaggcctgcttaacttccattagttaggcaggaaacctgggttctagtcccactatgtacacggactccaattcctcaactttctcctactcctgattagttacagcctcccaaggaacctttgggacttgcactcgaacactgataatgatgttgagtgcaatttttaaattgagcacctactaaatgcctggcactaggtgggttatgtacttgtttcactaacgtctcattctgtgaggtaggaattcccttcctggttttgcaggtgaagaaacttatgctcattagagattttaaataccgaaggactacaggtcataaagggggagcctggaagtgatatctgactcggaagtgtagttctttcaaccatttcacactgcctgcccagtgacaattttctgtctcacagtttttgctctagagcaacttggaatccaattttttaaaaacaagtgttatcgctgctgcctttggctactgtttttttgtatagtgcagcctgccattcagagtgcttgcatatttattgtctcattgacttctcacaagggactggaaggcaagtatttctgtgtgatgatgcctccacctaggaaccacgtgtaaggcttatggcataggctcccacagccagctagctacaggaagagctgggactagaccaggggttggcaaactggctgtgctgcctgtttttgtgcagccagctcctgagctaagaaggagtgttacgtgtttatatggttgggggaaaaaatgaaaagaataatgttttgtgatgtgtaaaaattacatgaaattcaaatttcagtgtccataaaaaaagttttattggagcacagctatactcatttgtttgtttatgtatgtcc

SEQ ID NO: 71068 - DNA, 1021 bp, Homo sapiens
tctccaccaagttagctcctaaatattagttattttattggttatgtagtacggtgtaacaaaccatttcaaaagttaaggttttaaaataaccatttccttctgattctgtggatcagcagtttgggtgggacactgcttggtgatactctagtggtcatacaggacacaattcctcctgttgtaataggtggtgacaacacatgtgaaatgtctaccagggaagcttattagagacttaatgcccagggtttttattgggggctaaatgcaaaggcatccactgtctgacatgtaccaaaattccagactcgcaagtgtttagcataaactatattgtttgtatgaacagtttagcacagtgaaccactcttactggaaacactcctgaaatctaagctcccaaactggactccagcttcaaaggagagcattcaggcctattgtattagtacttctgcacacaccacttaaggcctaagctcagaactcccacagcgtcattcttgccacattctattggttaaatcaagtcacaagcctggtccagattcaaaagggtagaaaaataggccacctcttttgggacaacgtaggatgggaggaaattggctttttaggtttttttttttttttcccaatttatcagacttattacctatctcaaaacaaatatatatatttaaatacagctttaattaggtatatttgtaattataagtttgcagtaaatttgcatgtctgtttttgtgtgaattttcagaattgaaggctacattttgttctttcagaaggtttggcttaagaaaccaaaggggagggaaatatgattgcgcagaaattgtattattttgttttcctaaatttaattaaaagcaatcttggtaaatatgaaatgacctctcattcactatatgtttttctctatctgtgcttgcctatacatgttaaatgttaatttcaggttaacataagatactttaactttgtattctgtcctactttaagataatggctgtgt

SEQ ID NO: 71069 - DNA, 1025 bp, Homo sapiens
aggagtagttagaatttaatttttgctgaattagggctggcagcttttggaaggcatcattattaatttctagaatattaatggagcagaatggaatcaataaaaaaaaccttcaacttgttcactgagagaatttattatgcagatgttgaagaagactttaaagaaagcattatagttagataaaatattagcatgcaaacatgttggtaacattagtggatctctaagcaactatatgtcactgtagccaggttataatctgttttatttctcgtgggatagatagaaattctgtcaaaaaagagaaagaaaaagaataattttgcctgattactaacatctgacaacttatagaaagaaacctgtgtctttttagcacttgtttgttacagtttcatgtgtccatgagctgagaagaatcaaaattaatctctggctcaaggttttacacttgatcttagccaaaaggccgagaagcaatggctcaaggttttagcactgatgttttgctttcctagtaatagtaatgaaacataattttattgcttcaaagagaataaaatacctaggaacccaacttacaaaggatgtgaaggacctcttcaaggagaactacaaaccactgctcaatgaaataaaagaggatacaaagaaatggaagaacattccatgctcatgggtaggaagaatcaatatggtgaaaatggccatactgcccaaggtaatttatagattcaatgccatccccatcaagccaccaatggctttcttcacagaattggaaaaaaattactttaaagttcatatggaaccaaaaaagaacccgcatcaccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcggaaataatgccacatatctacaactatctgatctttgacaaacct

SEQ ID NO: 71070 - DNA, 1049 bp, Homo sapiens
ggaattcactatggcaatgagaattttaaatacgagattaaaaatagattcgccaaaagaacgaaaaggaactaaaaagaatcaaaattttcccccatcaatagtacttaagtatagtttactgcccacccatccatccattttgggtagaagaaatttgacgaatttcaagaaatgtaacagcggctatgtatttaccagttttatcatgtgcaaacttgccttagttgttcatattttataaaatcatgaaaacctttttcttttatatctggtttccaaaattgtctcatagttcaacttgggtgttctcttcaaacccacaaaaattgaatgtagactttaccaaaatttaatttgtatttcttatctcagttataagttattgaatattctggtacccaactttattttttttttttttggcattatctttttcagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgtaagtattttttaaacaattctattttaatcaaattaaaatttagctctatttattttgaattatagtatcaccagttatagtaacttggtaatgtttttgctttgtgaatcatgttaaaaatgggaaaatttagctacctgaaagctacttattacttgaaagaaagattttgtggtaaattttcttggacttgtgttattgttatttagttgctatacggatagcttcttattagatcaaaaatccctaacaaagaaattagtcccaaatgcctgatttctttttgaatcatgtcaaagattgcttttgtattcactttcttgatttaatgtgcatctgttcatttggcatatgttggataaatgattggt

SEQ ID NO: 71071 - DNA, 1053 bp, Homo sapiens
cttacagagatgatttttgtctatttttcacatagttgatttagagaggcttaatcatatatcagtactggattgtaggacaacaaagatcttaaaaaccagtgacagtataatctacctgaggtctttgggcgcattgttttccttctattcctcgcccttgtctaagtcctctaataagtttcctcatttgagtgggttaagttatagtatgatatatatcagggtacaagtttgaggttgtctctgtgggatactctctccaaatgtcatcgtgtcatcaggagtaaaattgaagctgctaagatggtagtacatgaagtagaaaatgttctgcattttaaccgtggaagatcaacaacttaatctctgatactattgtttgttctagggaaatttccagtgcggggaaaaagtagacaggaaaatatatccctagattgatttctcaaaaatgcactaagtataatcccaatttttgctgaaagtctctttcaaggtacatattagaatattccaaacagttttgaatgtcatgatcctgaattttcataatcctgataaagtttctttgtttcatatttgttgtagctgaaataaggtagggattatgaggaattaagataaagctaagtcagggcaattttgggaatgtggtcacttaaacagtgccccttccctcttcactccctacttacgattcctctcctaaggaaaatggattcagggcccatgggcatctcggagcatacaaggccttagattgtaactggagactaagtagagagatttgatacagggcttgctttctcatgaactgagcaagtatctggaagacaggatcagagacctggggtgaggagcagaaatggttaatcctgagaagagcttagcctcagagatctgtggacgtctttgggggaaggtcagcaaatgacctctgtaggtacgctcatattccctgaccctcaagccaagaagtagctgaatagatgggctcacttcttgttggtgaggcttgggagaacacaagactcttccttagcctcagca

SEQ ID NO: 71072 - DNA, 1030 bp, Homo sapiens
accagctccatgctaagagggactctcccttctgccgctccagagtcaatgaggctgacactggtggatcttccccaggagccaagagatctggcctagacagcagcaagcttcctctttctgaaggtggctgtatagttgacccctgccaggtagatcagaaggtcctaaaaagtgtgcaggcatcagggacccacccaaaggaccccattcactgatgttgatgcatctcccagcagccgcaggctccaactaaggaccatttctgcagaggtgctacattttatgagctttctcaagggtggccttctcatcacaaagaagttaaagccaaaaacctatgccttcagctgcattcttccgtgggtagttgcagcaccctctgccatccccccatcccagagagcccagcatcatgaagcacccgcggcacccccacccagacccaggcccacgcaggtgcactgccttcttttttgccagatccatagttttatgttgaggtgctattcttgaattttcccaagtacctaacatttatacgtattcaagttgctgtcattccccccagtagctctgttctgttacgcacgtgtgttgcagctaactcatccttctctggctgctggaaacccttaaatggtgtgttgttttcttcattagctttttgggactcagatctgactgctgaagtagcttaagtgatgacagttctacaagtaatagaagttgaaattgtatctatacttacagagcagcagtggacaaacaaacaggctaccagtcatctgctgaggctaaggaagagtcttgtgttctcccaagcctcaccaacaagaagtgagcccatctattcagctacttcttggcttgagggtcagggaatatgagcgtacctacagaggtcatttgctgaccttcccccaaagacgtccacagatctctgaggctaagctcttctcaggattaaccatttctgctcctcaccccaggtctctgatcctgtcttccagatacttgctcagttcat

SEQ ID NO: 71073 - DNA, 1070 bp, Homo sapiens
tgctctgtaagtatagatacaatttcaacttctattacttgtagaactgtcatcacttaagctacttcagcagtcagatctgagtcccaaaaagctaatgaagaaaacaacacaccatttaagggtttccagcagccagagaaggatgagttagctgcaacacacgtgcgtaacagaacagagctactggggggaatgacagcaacttgaatacgtataaatgttaggtacttgggaaaattcaagaatagcacctcaacataaaactatggatctggcaaaaaagaaggcagtgcacctgcgtgggcctgggtctgggtgggggtgccgcgggtgcttcatgatgctgggctctctgggatggggggatggcagagggtgctgcaactacccacggaagaatgcagctgaaggcataggtttttggctttaacttctttgtgatgagaaggccacccttgagaaagctcataaaatgtagcacctctgcagaaatggtccttagttggagcctgcggctgctgggagatgcatcaacatcagtgaatggggtcctttgggtgggtccctgatgcctgcacactttttaggaccttctgatctacctggcaggggtcaactatacagccaccttcagaaagaggaagcttgctgctgtctaggccagatctcttggctcctggggaagatccaccagtgtcagcctcattgactctggagcggcagaagggagagtccctcttagcatggagctggtccctaaacttcagattgcctgggattcccatcacggtccagaagaagagacgagacctgaagaagctggcagctgtcatgcggcaagtgagacaatgggaaagccacccgcttcagaacattgaagaagccacctggcaccaactcactgtccaagctgagaagaaggaaccagggacccaaggagcttcagtttaatataaaaccaggagcaaacctccgaagtccaggcatctcagagaaatgctttttttgtgtaccatggttaccaaatacagagctagattttatttttgtaaatatttgcatctcct

SEQ ID NO: 71074 - DNA, 1874 bp, Homo sapiens
gtagagaccaggttttactatgatggtcaggctggcttcgaactcctgacctcaagtgatctgcctgccttggtctcccaaagtgctgggattacaggcatgagacactgtgcccagccaacatattttagaaatatgatatgtaaatggtctagaatgcatttacttccaaaatcacctgttccagtaagttaacacatttggtgaatcaccttcatttttgacaaacattgctgaggtagattcttctatatgtcccatgttaaatagattgcacttaaaatatatattttatcagtgccctcaaatacttgtatgtctcttgtaatactcttgtatgtctcttgtaatactcttgtaatactctagatttaataaagtgttttatatgtgcatctgatattttttctgtcctatttgaaagtaagttgctgacatgtgggtccctggaattctttagcgtacatttcctaaaagtaatggcataaccgcaatataagaaataagaaaatttaaataagtattttaaaatatcatttactaacttccatatttaaatttctccatttgtccccaaaatggttttatatctccttagactcttttactccagaagaattcccctaatcttttttttttttaattttctgattaattccttgtggtattatttaacttgtttctctatttgctgtatttccaataaactggaagtgatatctgaaatcttgcttagattttggtttaatatttcctaagaaatacttcttaactgatgcagagtatttcattttatatcttattgggaaacaaactcaggttatcctgaattgccaggtctctccagtacaaagatgtagtttttcctttgctgtcagcaaagatctgtgaggtgacactttggcactgtataaataatcctgtttctcaataaccttttatctaatggttttaagcattgatgatcctgacttgaatcagttatttctgtagtatctatagaatagtgagcttctggccaggcacggtggctcacgcctgtaatcccagcactttgggaggctgaggcgagtggatcacaaggtcaggagatcgagaccatcctggctaacacggtgaaccctcgtctctactaaaaatacaaaaaagtagccaggtgtaatggtgggcgcctgtagtcccagctactctggaggctgaggcaggagaatggcgtgaacctgggaggcgggagcttgcagtgagccgagatggtgccactgcactccagcctgggagggagtgcgagactccatctcaaaaaaaaaaaaaaaaaaaaaaagaatagtgagcttctaattctgttatgtctttacattaattacttgccatttctcaataaagctttatcttatcaaatgagatgaagtacccttctctaaaaatctcagggtaactcctcaattctctaccaatttaggggttagtgtaatagttatatataatataagcaaattagatatttattcttttattgctctcctttttgtgtgtctattgtttggattcatgaatttatatttattcactgttttaaaatgagttacactcattaatctttgatgctaaaatagaggaagctgcttcaagcaggtttttgtgtcttttttacatgctctagtagacttttcaagcattttcctcttttctggtacaagaaaatatcccaagcccaccttgaatgtttcctgcccagacctggttccttttagagatttgtaactattttctcttgcttgaaattaatttttcacttacatttcctttcttttcccttgatgctccaaatcttgacaaagtgattgccaaattgcctgatcttttctcggtggcgc

SEQ ID NO: 71075 - DNA, 1183 bp, Homo sapiens
caacatagtgggaccttttctctacaaaaaataaaaacgttttgctgcttgtggtggcacatgcctgtaatcctagctaccggggaagctgaggcagaaggatcacttaagcctgggaggttgaggttacagtgtgccctgattgtgccactgcactccagcctaacagcaagaccctgtttctcaaaaaaagaaaaaaaaaaaaggaatttgattttgatgaaatgaaatttatctttttatttttccttttctcattgtgcttctggtgtcttatgtaagaactctttgccttattccaggtcatgaagattttctattatgttttcttttaaaagtttaatagtttatgttgtacatttatagacttatgatccactttgagtttacttttataaaaggtgtgaagtttaagttgaagttcatgtgttttgcatatggatgaccaattgctccaacaccaattattgaaaagactgtcttttcttcattgttccttttgcacatttgtgaaaaatcagattgctatatttgtgttggtctatttctgcacgctattctgttccattgagctgagtgttcttttgtaaatactactctatcttaattattgtaatcgtatagtaatttagattgtttctcagcatttttaatatactgttccaatatcatctggcctacatacttctggatgatttgttaaccttattattgttcctctgtaggtaatgtgtcattttgttctggctgcactcaagattttctcttacttttggctgtcagagtttatattcattttgtttggttttcctacttaaatagcttattggatctataagttaatgttttctactaaatttgggatgctttgggacaaaatgtattcatgtattttttctactcttttcacttctcttcagggattccaattacgtgtatgtttgacctcttaaattgtctcattaatccctttgattctttcatcttttttgttgttgttgttctcctttgtttttcagatttgataatatctattggtttgtctataagttcaacaatactttcttctactctctccaagttgctgttgaacccatcaagcaaattttgttttacttattgtacttttcatttccagaatttattttgtccacttttctgttgacattccctctgttaattt

SEQ ID NO: 71076 - DNA, 1044 bp, Homo sapiens
ttaagcttgttatttaatctgttgtttcctaatttatttgaccatagaactttcccctaaattatcgacatttcacaggatttgtctttcttagaatgtaccttggaacatttcatgtttgattggaacacttacgtacagctatcacatatgtatttttatcattgtaaggacaagccttttgaactatacatgatcccaggatgggaaagctggatgtaacttagtgattatctagtctgtatttttattttacaaatagagaggctgaggtttggaagtgttaaattgcccaaccaattcacctgtttaacacaacagatcagctgacgctaaaaattcccttgttccatgtaacaatttcaatagctagtagtcaactatattataatatattcataaatgagttctttagagtcaataatacattctaattaatatactttagctcttaatttgtcccctaactcagctcctcagcctcaatctgcagctgggtgtcattgccaccacacttgctagcatgaattctgcatggcatttgtttctttggttatttacttctgactcaaagtgtgtcatgagccataaaatgtgcttcacttttaactgtatacccagaattatatagatttacttagctttatgaagtaaattacagtttaataaatcactggacataacttatccgtttgttttaattcataggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaaggtaatgacttttcatatattacaaatatgtttttaatctatctttaaaactttacagaattgggtagaaataagggatattgaaatgaccaagcatcagaccaaacggtgaggcgaagaaacaaaatctagatgaataaattataatcacatgaccttacctcctaaatttctgcctgtga

SEQ ID NO: 71077 - DNA, 1105 bp, Homo sapiens
cgggcggatcacgaggtcaggagatcgagaccatcctggctaacacggtgaaaccccgtctctactaaaaatacaaaaaattagccaggtgtggtggtggcgggcgcctgtagtcccagctactcgggaggctgaggcaggagaatggcgtgaacccgggaggcggagcttgcagtgagccgagatcgcgccactgctgtccagcctgggcaacagaacgagactccgcctcaaaaaaaaaaaaaaattcagaaatatttttcatatattttatgtggcacctttaattacatttaatttttaaaggtaaaatttacttcaacaaatagttatcaaattcttgagtatggtatggaaaagcagtcactttatttaggaaagtgaagaactcagtaattacattaaagtattaccaatcatttgtctgtattattgcttagtgttctcttccagttactttattttggtacaagcttggggattcagttgtgcttttcatcagcagcctcttgtttctctttctgccccagggcactggtgtgatgcagttaggagtcaggagctcagtttgcctctttctcatctaaattctcctattaatgtttatccagaatagccataatatatcttctgggaagcactcctgaatacctcctccttctctctacttccccactcaaacttgtctatactttcagtagttcattgtatcattatcacttgtgagctcttaaagagaaagattttattcatttttgtattgccggtgaacagcataaatatcctgatgtcattttagttaaaacttctggagtttctaggctttagaagcaagaatttgaattaaaccactgtgttgctgagcagatattagaagctaacctaatggtggctctagaagtgagtatatagtaatggagtaatcagagcactactgtttggggtattttgccatggcttcaaaatgttgaccttggcaagtctctgaaatacaagtcttattttttcctaaatacaattcagccagtgaattacatcatctttaaaatttaacatttttgtcatgtagaaggaatgagaaaaggaggtcaaaggtgactttcct

SEQ ID NO: 71078 - DNA, 1027 bp, Homo sapiens
tattaaccatttgaatcttttccaaaactcttttctattagagattaattcccaggaaaagcatataatgttaattacgttttcattttggctacatttcatccagttcacagctgaaaaagaaagtccacatatatgtgaaagaattcctagggtctactcagacttctgattacagaagtatggcagactaggcccccagattgattcttccattgaaaataattaataatgttggatagcatatttcaaaaattcttcttaaatgcgttggtaagtaggcaaatgtaatgaaaatataggtcaaaaataggtgaaggaggaaagccagcgaggcaagtgaagaagggaagccagcttttagcccaggaactggccagcatggggagataaataggaaacacatacccattctacagggctaagccctcagtgtaaaaataaactaagaataagggctttactttgacaaaagggtttctctaaaaacctagttaatggtaaaacgttttagtgttctgcttaagaataagacaagagttcctgctgtcatcagttcttttcaacatagcatgagatgtccaattcagtgtagtaagacaaaaagaaataggagatataacagttgaaaaaataaaattctatttgatgataatatgactaattatatagaaaactccaagaatgtaaaggcaaattattacaattggcagtacagtttaagagtgttgctggacacaaggccaataaacaaaatgcaattggatttctgtatcattactaaatagaaggatttttttttaaaaaaaacttcaaaaatataaaatacatagaataaatctagtaaaaaccatgctagcttattttcccttgaaaggttcaaactgaatgtgaaagtccctgcttgtcctcttccaccttgctgctatccctgagctttgtatcctgatcacagtgttactagagatgtttgtcctcaggatgatatcctgcttgcttactatgcacagctttcggcttaccatgc

SEQ ID NO: 71079 - DNA, 3266 bp, Homo sapiens
taaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattgccacttacctttgaaactttattttcctcttcgttcatgaaactgctctcatcatttttatattgttccagggaaggagcaataactgatttttctgcagtgtcttccttctgaaagcctttccccaacctgaatgtattaaataccatgtcatcatctaaatttcttatggacttggatgctgaaagtaaaataccttgagaaaacaaagaaaaagttagtattaatatataggaagagagattcatttttgccattcttagtttgatgtttgcatacagtcaaacaagaaagaaaatgaaaaatttctctgtcagcctgcttggtaaacgattctgtatctttatatattttctagcttgaatagaaagcacttcaaagaattatacttttcatcattttagaaatgactcattagattgaggctaacctttatgcagctgctaatacctacattgttttggttttagtgacacattgtttattttgagtgtgaattttctcagaatctgactaagatccttggtagaatgctttctgttgagtagattatagtctcttgaaaatgggttgttattaaggaagaccacaggacatcaggctctctctatattattgtttccttttgtgtattttctgattaagtaaagatattaaaactcaagttatttcactcaaggatgataaggataaagttttatttccttttaatcctgattaaactgaaataatcctcaaaagagactttcttttataaatacttgatatagtttttggtgattaaagtacatatgcctgtcagtgtgaacaaaaagccattcatgctatatcaaaaattgacctgtcaggtgtattttatctctgcatttacaaaaggataatatgtacaaatatttattaatgaatttagaaattaatgaattagtccatgaaaagaatatttatgtgcccataaacattacttttggatgatgagtttatgttgtatgacttttaattaaacatttcagagttaatttctaattttgaccccaatgaataagataatacattcttttatatgtcttctggtacatatatgtaagaatttttctagagtatatttctcagtatggaattactggatcatggagtatgtatatgttcagctttactaatgccaaaatgttttccaacatagttgtaagcgatttgtgccctcgataagcagggtatgagaatttccattgttccatgtcctagctgactcttgtgtctcattgtccttttaatttgtattttcctaattaccaaagaggttaagtgtcttcccatatgtttctgagccatttatgtttcctcttatgttaaatgctttttttttttttcttttttggctttgtccatttttctattgggttgtctttttctaatttatttatgggagttctttatatattctggatattaattgttagttatatatgtttcaattattttcgctcagtttgtgacatattttcaacccctctggtgtcttttggtgaaccaaactgattaattttaatgtttaaatatttttcttttttctttatggcaactacttttaatgtgttgtttttttttagaaatccttctcaatccttagattattaacgtgttttcatatattttcttctaaaagtttaaatattttgactttcatgtttaggtttgtaattcatctgtaattttgtgtatgatataagatagagatgtaattttactttttccaatgtccttatatatttcttgaagaagtcatcctgtccccactaatctgcagtgccatctctacagtatatcagatttctatatatgtgtgggctcctttcagaacgttctattccacagccaaatctacagtattaatataactttaaaataatttttaatatctggtcaaatttcccagccctctacttacccacatgtttttcttttacagcagttccttagctattcttagtcatttcttttccatataaatcttaaaatcagcttttcaagttccgtaagaacacttgacaggatattaaggttctagttaggtatcccttatctgaaatgcttaggaccagaagtatttttggatttgggatatttttttcagaatttggaacatttgcattatatcagttaagta

SEQ ID NO: 71080 - DNA, 1387 bp, Homo sapiens
gttcatacacactggccaaagcctccagtaaatactgaaaatggagagaagagatatctttacagtgttactgattttacagataatgattttaatgcttcaccactgagcgtaatgtttgctgtaggtttcttatagatacttgctataaagtacaggatgttctcttttgtttctggcttactaatagtttttatcatgaattgttgttgaatattattgaatgctttttttgcatatattgagatgaccagatcattttctccttcagtctttggaaatattaacagatttttctaatgttaaactaaccatgtgttcatgaagaaacctttaaattatcggattcaatttggcaatatttgatttagtacattttacatttattatgagtaagattgatttgtaattttccttttttatattgactttggtttgatattaagtttgtaccaatttcttacattgagggcaagatttatccttctttcttttctctcttgttagactttgggtttggtgttttcttggtaggatttttgttgttaagaattgatgtactttcttcagtagctgtagtaacatttagcttctctgtttcttttttagtttgttttaggaatttacattattgtataatttgtccatttcacttaagtactttttatctgaggtagacttaactgctgattttctcggggactattaagatctttctcagtaaatgttttgtgattataattataaacaaaggactctgacatcccttgacttctttgatcttagagcttccttatctttttaatgttgttagttgtgccctactttgtttcccttggtttgaacctggtttggatgtgcctgtttaatctataaaagtccttgttaggctgggcacggtggctcacgcctgtaaccccagcaccatgggaggccgaggtgggtggatcacctgaggtcaggagtttgtgaccagcctggccaacatggtgaaaccccatctctactaaaaatataaaaattagctgggcatggtggtgggtgcctgtaattccagctactggagaggctgaggcaggagaattgcttgaacccaggagacggaggttgcagtgaaccaaacatggtgccattgcactccagcccaggcgacagagcgagactctgtctggaaaaaaaaaaaaaaaaaaaaaaaaaagtccttgttaatggaaatcttttttcttagatgctgttgtgggagggtaataaatattaataattatgtactttgttttaaatttccactggatgaattggcttggctgatcttcactcaaaattgggaccaaatccaaatgattttgacggtttagagaagttaatgttttattttgtttaaactgtc

SEQ ID NO: 71081 - DNA, 1977 bp, Homo sapiens
gagctgagaatgcaccactgcactctagcctgggcgacagagcaagattccatctcaattaaaaaaaaaaaaagttatgtgaacatgcttgaaatgatgttcatggctaaatttttcagttaccttgtaaagatgattcttggatattgttttgattctgagtacttttggagtcatctgatagtatgcttcgagaataacaatctgatgatagctttcaacattgggttaccaacaaagcttgttattttgtatacattgattcataatttcaggtttcttcaccattatggtaagtagtgtattgagtcttcattctaacacatgttaggaatttatgtttgtactcatggatgtctttaaccctcagacatttctacttatattgagaactctagactgaaaacattttgaaatgtagtggttttactatgtaggaggaacatgtgattcatttgttctgcttcattttcttctgtttgtgatagagattggatcagatgaaagtgtcttgataatgatatacatgccattcttttcattctatgtatttgtagtccttttttgccatcataactttgtttatgatattccctgctcttaaaataccctcatcttgtccctccacctatctatatctaaaatatccttcaagaccttccttttgcagctttctctgagtactacagccaaatcctcttgtctgaactccaacatgtgtaatacattatcatcctgtttaaatataattatttcttatatttattaatttatcaaggccctaaatatctgcataagcttgccttcatggtttcactttttcattgttctctatattcatgccatgtaactttggcatgccttcccactgtgggtggggtaacctgcccactgtttgactctggtttcaggcatgtgatttgctttaactaatgagatattatcagatatcatgcaagcagaggcttgaaatggtcttgcacattgggaattccctcttgagcctctgccaccaccatgaaaacattcccatgctagcctgctggagagagccacatggaggagagccatgctaccctaactgccatagctgaggctatcctcgatcagcacacatccattcaagcaccagacactggagaaagtccacttgaggtcagtagagctgcctagcagatgcccaactgacccaaaaagcataagacataaacatttattgttgtataccctctgaagttttgcatgtgttacaccatattactatagtaatagataattgatacaaatgtcctacatggcctggaccatgcattccttgctaaatttatttcttgctactctgtccctctttcgtcactctctagtgatattggccttctgtttttatgatatgccaagatcatttctgacgcaagactttttccctgctattctctttgtcaggagcatctttctcctgttatttatctgagcatttatcactcattattgtgatgctcagctcaaatatcatggtttctgagagtgcttccttgaccctatgagctaaaggagcccccttcccactcattctttccctattcctttcactcctttattttcttcactgtgcttctgtctaaaattatcttacttgtttacatgcttattgtccatttcctctaatgccagtgagggagatggtatcaagaacagagtatcaagaacagagtctggcacatagtagcctttcaataaacatgtaataaatgtatgaattattttttcattaagagaacagatggtagaaactatgataggttctagaatatgatagagtatttacttattacctaggtctgctgtgacaaattaccacaaacttgatggcttaaggcaacaaaagcccaaaatcaatgcgtggacaggactgtgtttcctccagagactctaggggagagcccttccttgcctcttccagcttctggtgactgttgg

SEQ ID NO: 71082 - DNA, 1220 bp, Homo sapiens
ctacttgaaactctagacatttttaactgaatttttaataaaaaattactgaggctttgtagaaaaagatgagaatggggtagcatagagtagttgcgctagccacatttcaagtgctccagtgctgcatgtggctagtagctaccatattgaacagtgtagatatagaacattttcatcattacagaaagttctattatacagcactgctccaaacagtaggaactctgaacattgagctagataataagatataatcattttatgttttgtatccacagtggggaaatgtaaggaattgtgtcttgtaattctcttatactgtacctttatttgctcaacagatgtttgttttgcctctaataatatataccaggcactctactaggcactgggaattcaggggtagacacaatagcctcaggcctttctgtatggagcttgtattctcatggaagagcagtcattaagtagataatcatacaaataactatagtctctatagtgctggttgtatagtagatgtttaaatgactgttgattaattgactaatgtgtacagtcccatcatcttcttagatactgacaaatcataggaacaaaaagctagctagtaatttatagttaaggtctgcaagtaacattaaaatttcagtgcagtcaataaatttagttctgttcagactgtttttgttatttttcttatttttgacatagagcaaagattatgtcagttgccctgtggtttaaagccacagttattctagaagcacagttgccatcattgagtagtagctgatccaaaagaattccagccaaggtcttgccaatgatggaaagaaatgatgtgtcctggaagttgccaaaaattatgtttttcttgttgaagacaatctttgtatctttaagcccttcatatgttgtgacatgagcacatatgaatgttccctaaaaggcaacaattatgctgtcaaattcattcaagcagtagttatccctgtataatttgaagttatacagatgcctaataagtgttttgatgctgttgctactgatgttgctgatgacattacatagaaagttgcagaagataaaccatgaagattgacactttaccattattattttgattttgtttctctcttcacatcatcaagtcttgcttatgctgttaagccctagcagttctttaatatggaagggggtatgacatataattt

SEQ ID NO: 71083 - DNA, 1140 bp, Homo sapiens
aggggtcgtaggaaggttctgggggagctgaggttgtgctctcatacaaggggttcgagatattctcaggctgctgcttgccaagagctgcaacattaatgtcctcttccgactgtttggaaagacaagcatgaaagccaggagcatccccaaagcaggagcgtctcagccaagttggcaggtaaagcaagccaccctttgcctctgggagcttttccttttttaacagtactttgttgagagatgattcacatataataaaatttaccaacctttagattcagctcagtgacatcttaccgatgtctgcccatttgtgatcaccaccaaatcggcacatagggcatttccataccccaggatgtgttcacatgctcttagcctgctggtgcctgccacccagggtaactgctgttctgactcccatcaccctgaagtggtgttgcctatcctttaacttaatataaatgcagtcatacagcctatacacttttgctaaaaatggggattttgagattttccctggagcttataaatatacaagctgtctgccagaaggcagcaaactgctgcttgggggctctgcaccacagcctttaccaggagtgttttgaggagagggtgggccagagaggaggacaaagtccataaggaaagatgctcaaccgctgtgctgctgccccggccatattcttacacagccagtcaagagctggctgctgattgggatgtggactcaactgttcaaatagaaatgagtgtcactggctgcagcataaagcctctggctgtgtagggtccctagccctgtcccccagttctcagagccggtcttgaagcccaagctaggtcatggggtgtgcttgtgcagtgaatcctccaaggtaaacaagactcctaggtcctagtgaatgtgcctccaggccaaacccctggcacagaggctcagggtgggttctctccttgccaagccctgtctcagccagaaggaggggcttggaaccaccactgctgttcctcttaagagcagggaccccatccaagcagcagtaagcgtggggtgggtggccgcccctgctactgtgtgacacactgcttctgggtgaggactctggcgcagccaccgactgaagcagccca

SEQ ID NO: 71084 - DNA, 1112 bp, Homo sapiens
attagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgtatcatctggtttattgtcagtcacctattttgtgtgcttaagtctgccacgttaaattctgatgaatccacagtatcgttttctaaaaaggcatttttttccaggacttgaggttatttctacaaaaatagataaaggagatcttggattaaaaaaaattctaagggacttcaaaaagtttatccctgagagaagggataaccttttttggggaaagctcaaaggtttcttctcactacccccatctccccccacccacagcaagcacacccacttgttttcagagcttgaagactgtcattcctcccatggatatcttttttttcctcccttcgatcacctgcctttgtgtacctgtgatggtgggtgttggtggactcactagcaaatctgtcccatattgattttttgggggcgattttctggaaacttggcatgtcatctaagaggaa

SEQ ID NO: 71085 - DNA, 1090 bp, Homo sapiens
cttgtatatattcttaaatctaaaggatggcaggaacatgaggggagcttgtggagagtgcttgcttattcaacatttttattgtgataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttgcgcccagaactgctcggtgtcggggttctaaaagaatgcgctggtgttcttggcttcaagtttctgctttggagaagcagattcaggaagtaggtgttgcttaaaaataattcttggtttttatctaatcagatattcattgattacctaccaggtgccagttatagggtgttttgtttactcaagaatgaagtagaactatttttaaaacctgtttccatgagtgttcacgttaggtgacctaagctttgaaggagaaaaacatttttgggtatgaataatgagttttgtaatcaattcccagttagaagaatttcagtctctgggccattgagcttggcagtgttgagatctcccatgtgacagaagcctgacatctgggccaccaaggctcactgactgtgtaccttgcagactgtagacccatgtcgtggcggtaacggggccgaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattt

SEQ ID NO: 71086 - DNA, 1050 bp, Homo sapiens
ctctgcttactgcaccctctgcctccctggttcaaatgattcttgtgcctcagcctcctgtgtagctgggattacaggtgtgcgccaccacgcctggccaatttttgtatttttaatagagacggggtttcaccatgttggccaggctggtctcgaactcctggcctcaagtgatctgcctgccttggcctccccaagtgctgggattacagatgtgagccaccacacctggctctaggctgttttcttaattaatatttggggctgctctaggctaacatgtttctcaaatgagtcctattttttttttttaaaaaaagaagtgattttgatttcagtagtttaaaaacaaggatttttgaatcattctctgttgctttgcttttttattgcctcttcagagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatggttaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaacggttcttgactcctccatggaacatttcctgaacatttacgggctatgcattgggaactgc

SEQ ID NO: 71087 - DNA, 1065 bp, Homo sapiens
tggagttccctggcagttacttccttaagttaagttaggcagccagttttggctggtaagtgaggaatggcagttttatcagtcgtttcctggcccatggaagctgcctctcttttgtagctgtatccccttaattctccatgtgcccctttcctttccagttccatgaggcaccttgctttctccctggctccagcttgcctgggctacagccgtctcagcatgggtgctgacatttttaggatctgggcacaggtgcttgctctcttggctaacacacctgcaacctgtggccacagcctattgcccatgcctgccctctggctttggaaatgggcagggaattgccttgcctgccccagctggcactctgcttgggagtggctgagcagtgagatcaggcagggccatgagtggcaggccagattctggctccaggtgcatgcattccagagcatggggccctgcacgtccccctgggccttgtttccaggatgcactgggctccattagttcttggctcttctctgatgagaatcctctgatgaggatttattctgtttccctcgctatgcttgtctgtgagatgatttactaaaaatatacagtgtcaattctgagttagtgtagtttagagtctgtgcatgtcatacactactaatagttactttttatgtgctggacactgtgctgagtgctggctctatacactttgctcatttaatagtcacagctgtcccttgcaggtaggtacaattttcccattttagaataaggaaacagtttttgagaggttaggtatcattcatgtctgaggtcataaaatggcagggcagggcttgaaccaagtccccaagtccatgcttcagagcactgctctaatgtgccttcctgtttagaggattcgggtataggcaaggcttgactcaccctcagtgaaatctctgtgaccctggcagctggtcataggtacaaacacaactgcacgtagatggtatcagtatattttagctttggaaagaggttttttttttttttggttttattttgttttcctttttctga

SEQ ID NO: 71088 - DNA, 1029 bp, Homo sapiens
tctgcctggtcaagtaaatccgggaaatctgggtgaaagaaagttgattacagcagggcttttcagagccatcaatagctttttaagagggacatgtttagtgcatggtgttttccaaatttatatgaccctggaattcttttttttgtttgtttttgtttttgtttttgagatggagtttctctcttgttgcccaggctgaagtgcagtggcacaatctccactcactgcaagctctgcctcctgggttcaagcgattctcctgcctcagcctgttgagtagctgggattacaggtgcccgccaccatgctcagctaatttttgtatttttagtagagatggggtttcatcatgttggccaggctgatctcgaactcctgacctcaggtgattcacctgccttggcttcccaaagtgctgggcttacaagagtgagctactgcgcccagccccctggaattcttttttttcgtggaacacctttggatactgggcttcacacaatttgggacgcattgaattaggccagggaatatgatggtggagttttggtttcgggttttttttaggtttttgcagggagctacttcctgtgatagtgaataactggtatttcatagagcagacagcctgtactactccatgtcataatgtttcccatttctgttgttaggcctttccgaaagatgaatgagaaaggtgtcttactctgggataaaatccataagttgcagaaaggccagatatacaagcaggtatctcatgaccagctgatcctttttgttgctttgctttgtggtcggtaataatgctaatagctgatgttcattgtggcttactgtatgcctggcacagttctgagtgattcccatgaactgattgattataacttggtggtaaacttaggtttaaatcaatatattttcaatatattgctagtatctaactcaaaattgaatgtttttttaaaaacaaaatttaaggcatgactttcatagtgtgtaacatataagatgccagtagtaaac

SEQ ID NO: 71089 - DNA, 1022 bp, Homo sapiens
tccaggctggtgtgcagtggcgccatctccgctcattgcaacctccacctcttgggttcaagcgattctcctgcctcagcctcctgagtagctgggattcaggcacccaccaccatgcccagcaaatttttgtattttttagtagagacggggtttcacgatgttgtccaggctgatcttgaactcctgacctcagctgatccacctgccttggcctcccaaagtgctgggattacaggcttgagccaccacgctcagcccattgtccttttttattattagaactttccttttttgtgttgatgatgggatctcgtttagtcacggaaaaggcttcctgctgttcctggtgcttcgtggctctgtcccttgcgtgggcccctgtttctaaagcattccttccaccctgtctgcagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggttgtatccacagtgagagattacagtgctgagtctgtttcagccttttcagtgggagtcacagagtcttgaacctcctttctaggttaggtgttttaaatagtctcttagctgggaactcttatatgtggtttaaccttgaacattacaagaaagatgttgttacatcaggagaattggaaatcagtcaaaagttttgttaaaacgagatggtgctgacactgttatctcaatttttgatcctttctgaccagaaggccaaggccagggccggtgcacttggccaaagggatgatggggatggaagtccagcctgtacctactcacccatgagtctgcccgagcaagggtgcctcttcttttttttttgaacagagtcttgctctgtcactcaggctggagtgcagtggcgtgatcttggctcactgcaacctctgcctcccgggcctcccgggttcaagtgattct

SEQ ID NO: 71090 - DNA, 1048 bp, Homo sapiens
aaactcctaataaaatcatcagatttcgtgagacttattcactgccatgagaatagcatgggggaaacagctccggtgattcagtgttctcccaccaggtccctcccacaatctgggaattataggagctacaattcaagatgagatttaggtggggacgcagccaaaccaagtcagcccctatctcaggctagagtattggagggcaggaggatgtctgatggagacaaaaacaatctttctctgccctaatgtattaaatacattaaaacaaaagccagcccaccccaaagcaagtcattaggaagccttgtgctttagtggtgtgagagcctggaccatagagccagaaagcctgggttctaatcttgacctaccacttcctactttggtgtgcttgaacaggtacatgacctttctttgcttcagttacctcagctggaaatgggaagaataatggtgcctccctcctaggattgttgagaattacaggaatgactaggtgtaattcatatctggcctatagtacatgccatgtaatattaactattattattcctgctcttgttaccaatagaacagtagtagtagtaaacatagtagcatcttacctgatatttgtggcatttacttgtggcacattttgcctcgtcatgatgacagtgccttgcacctcaattgaaaaatcccagcactgcacaggggtgtgaaaatcattggtttctctagttgagctctttaactgcaccatctggtttttccagaggcctcagtgttgtccctgatgaagaagtcattgaaatgtacgaggggtcccacgtgcccttggagcagatgagtgacttttacggaaaggtaatgagaagcactttattcatttaaagcagcctttttccttcttgaaacatggccttgtcgaacttacctactgcttatatggaattgacagggaaatttgagattgtgtgttgagagagactagcgtttgaaggggacacccccagattctttcatgattctcctttctgaagcacttcctccccacctg

SEQ ID NO: 71091 - DNA, 1117 bp, Homo sapiens
cagtagagacatttgcaattccacctgttgagacatctactgttaactgtgtttacttgttttaattcgctttttttggtaattcgagtggttgaacatttagtttaccagctatttaatttccttttgtatggatttttaaaatattaagaatactagaccattgctgtttgtcttttcaattttttggtctaatatactcacctctttccccaaattgttgttttcatatttttagatgcataggtgttaaaaaatcttatgttgcaaatctgtcaatagttttcttcgtgatttattctgttgcttttttttttttaacatttggaaagttatgttttattcagagatgaaataaatggtatatattcttgtttttaatgttcaaaaattttaaactctgactcgcatgtttctttttctacctttttaatgtttaaaatttttaaactctgactcacatggtgttttgttttatagcataatttgaaggaaagtcttacttgacattcttttcacatagctgattggtgtttatgcatagacattagacagagacagaatattccaggcagatgtaactctggtcagtattcagctacagcatatgttggagaacacagagcagtggatgacccatcttgttgaaagtagggcatgggaaggagaatttaagattggagaaatggattaaagtatacatagggaatgcctttgataccaggttaaaaagttaaaaatttatcgtcagaagtttgagtggctgaattttcttaaaataaacttttttagaattcctttggatgtaagcaatagaaaacttaactctttcccgttgacatcttttccaggttcctagcagtggcccctcacatctccagatttatgttctcttaaatctacctttggaagaaaagagtgcctcttccctgaaattcccttacaaatccagaaattgacctgattggacttattggttcactttggctgtagagaaagtatgatgattggctggaggggatcccatgtctgcctcaaactagtcagcattcttaagggaattcaggtgctctgttaggccaggcctgggttacatgccctccttctggagtcagga

SEQ ID NO: 71092 - DNA, 1050 bp, Homo sapiens
ggccatctggcatctgtttgagcttgttgtgtgatcacaaggctgcccattttattttggatggctgagtcacagagagtacttttgattccccttccatatgatagtcgcttaaatatgaaggtggtgatcatgcatcatcactgcaactcacctttgatttgatcattttggaagctcaactttgctttcactctagtttgtcagtatccctttgaaagtgaaccatttgttcctgaccatgtgtggtctgactggttcatggtggagggaagcaactggctcttccttggtgaacaaacactgtacttctgtaactttaaaagttaattcgtgttcagtttgtggtcagccaaatcctgactttgtccttcttgtattgacatgatgtaattttagagaaggaaaacaaaagctttaaaaaaatcttctttgcaaataagtacttagaagacaatgatagaattctattattttttaaaagtcaaatactacatgttatatctaggagaatgcagagagaaagagaggctagctgattgatcaagctgggttttataggaaatttttatactttaaaggattggtccttaatttgagtaactctttttcacttcactagggttttgaggaactgtttcatgataagttaattgataagataatgatgtataaacctgaatataattttaatttgtatgtagagatgcaactctctgcatagactgtaatattttgttctcattcgagcagaaaaatctacttgagaaacactactagtgaatattaatccttagctaaggtagcagacctttcaaatgttttgccctcagtactcttttatacactttaaattattgaagatcctagagtttcggtttatagattagtctcaagtagacttttaaataatgtattctgcccttatgttgatagtgattgtattagaaattaaaacccagagaattttaagatatgtatttattgattcatttaattaatttattttttaaataaattcccgggctgaatttatttaaaattctgact

SEQ ID NO: 71093 - DNA, 1058 bp, Homo sapiens
cacctcggcttcccaaagctctgggattacaggcctgagccaccacgcctggcctcggcttcctcttcattattagtccttgagatttctccagtttctcagagttcagttatgacttcaagagaaagtcctctatattttttttcagcgtgtgggtattctatacaaaaaggtttttagacgatctagtctgccagactgctgaaagccaaagtccaaaagaactcttgacggttagaggacatctgtttccacatgtctttaagagttcaataaaagattggtttccaaacccggcctgtaaaaatatagattcccgggtcttacctccacattttaggaatcagaatctccagggttagggcctcagaatttccatttttaaacaagcttcccaggtgattccgatgtgcctatcagtttgaggaccactgaattcttttttttaatttgtcttaccttcaaaagctggcaaaaaaattatttaatctcctttttgtattttttctcctttcacttcctctttaccctacccagaatttacaccctaatgaaaggggaaaatgaactctagctttcaactggtagatcagcgagccacctccacggcaattacagaaaatcataacactcagcagcaaaagtcaggccaaaaaatatcattattccaggcaggcttcttgacccagcagcaaatttaaatctaaaaaacagtccccatgctgagttctgcctccataaggatcattgagcataacagctcaatccttcaaactttcctaaagcgtaacagaagcactaaatgagcactgggtcaccagaagacactaagattcccctggaatcccctgaagttatatacaaaatcatttgtgtgtgctcaagtattatgtgtaatactgcaaatgtgtctttttataaagaaaaaacacacagctttctccagattctcagtgggtcctatgactccattactctatatccctgctgcgtagaaaaagcacatttctggttgtaagcatctttcagtattatcaacatatgttcttattaggcat

SEQ ID NO: 71094 - DNA, 1683 bp, Homo sapiens
acctcatcattccatcccatgtggcctgcgcgccaccacaccacacggccacccccgcgccaccctgaaattgaccgcagcaggctgggcgtggggcccccggcccggccccgccccgccccgtctccgcccccgtcccagacccgcccactccccatcgaccccgcccccgttagaccccgcctccggctccgcccactccccgccccgcagcggcgggagggcaggcctgcgccgccacgtgttccgacgcaggagctgccctcctgcagggcagagcgcgggtagatcttgggccgggcagcagcagtcgcagagcggcgcggcggcggtggcggcagcaggcagcaggcatgaccatggcagcggcggcggtggtggcacgcggggccggggcgagggcagcgacagcggcggctttgcggggtggctgcgggaccgcggctcgggggcggccgtgtgcgggccccgcccggcccttgtgcactgcacccgggaccgccccggacatgaagcgctacctgtgggagcgctaccgggaggcgaagagaagcacagaaggtgagtgaggcggcgaccccgccccggcgcctggggcccctcctgcgcgctcagctgggaagcgggcgccctaggacccggaccagcccagctgcggacctccagggcctccagtcgcgaaccccggtgcccacacccccagccgcaggcagcatcgctcctgcggagcgactcggggaaacggggaaaaatgcgctctagaaacttcacaactcgcgcctttccccggtcgggaaagctgttgtatatattcttgggatttttagcccgaaatctgcatctgaggggctttgggccgcgcggggctggggttcctcaggcctcccttgggagccggccactcccacgcaccgttaggtgttgttactcatcaatagtaataatagtaacagccgagtcgggctggcgcagagatgcccaagagcggggctgctggggaggtggccgatcccgaggctggtctgttttccttttggtgggggtgggttgggatgggatgggatgggatgggatggaatgggatggaatgagatgagatgagatgagatgagatgagatgagatgagatgagctgtgcggtgtttgaaagaggagaggtccaggtggggaaggttctgggttatccattaacctcggtgaggaggggattctaaggctgtgaatgggaacttcatggccaggtgcacataaaatgagcttggctcggttgttactactaatgaactaataaataccagtgccgggcacgtagattatctctaaatcgttcctgtaatctacgaaggaggttccacatccccattctatagatgggaaaggcgagactcaggtttaaatgacctggccaaggtgacgcctgaatttagggactgtctcagctcctaacccactgtcctgtttcctgtgctccgttgaccatttgggaaccaataatccattgtcgctgttgcttccaaggaggattcagaaccgaaatttgtatattggttacttcttgttgtggaggtggcacatagatagggagagattatttggtgagcaagaacgttttataggatcacattttccattttttttggccagaagtcagtttaatgaaaaaagcaaattggagtgattttc

SEQ ID NO: 71095 - DNA, 1091 bp, Homo sapiens
attcgtgagggggggcggaagtccaccaatcggagctgtccaggtgcggtgaccgatgcccgaagcgtggctccttccgattggtcagggtttgcagcttttctccaatcaaatggctccgcgggcccctcacacgtgggaccgcccctttgcctgggcggccttggcctctaagggaaaacgtccaatgaatgtaagcagagaacacatccatccttttagagaggtcgcggcggaactacttccggatcctagagagcgtttattccgtgaccggggaaacggtagccatggcaacgtgttcttcaccctttcccatctatgcctggggtttcgttggaagtgattccagcacgactttcgcggccagctttctcgtgtggcggcgcttctcggaaagaagaaacacacgagagaggttgcaaatcccctagaaccctttcagatggcgggggggcgggggggtggcggtggtgagaaactacagctcccggcatgcaacgtcctaggggttcactgcattgaatgctgggggtcgtagtctttggtctctgaggaccagctgcgtagttttggccctttctttcacgttcccccagcgtgtctttgccagagccctgccctgcgtcttagatgttacatctcgttctgattacagtagagatatgtgcctattccaggagtctccattgtacacagcttttagaagcgggcctagaaagccttcatgcctcgggcaaggccgcccggttctggggggtcggtctgagtctgggggctccgcctccggctcaagagcacgagtttccgaatccgcctacaagtgcgtcacttgggcagccggagcgttcacctcctctgtgcctttccgcggccggaatccccaggccttccttatctggtttacagaagaacgtggttgggaccttcccgaccaccttagggaaatcgcgagcagcgctgaggccttcgactccccaataaagtacaaaggcggcggtgacctgacggtcgtagaaccctttctgtgaatcaggtggagagcgtggtcgtaaaagcgggtctagcacagaaaaggaaaacccttagtt

SEQ ID NO: 71096 - DNA, 2952 bp, Homo sapiens
gcgaaagtcgtgctggaatcacttccaacgaaaccccaggcatagatgggaaagggtgaagaacacgttgccatggctaccgtttccccggtcacggaataaacgctctctaggatccggaagtagttccgccgcgacctctctaaaaggatggatgtgttctctgcttacattcattggacgttttcccttagaggccaaggccgcccaggcaaaggggcggtcccacgtgtgaggggcccgcggagccatttgattggagaaaagctgcaaaccctgaccaatcggaaggagccacgcttcgggcatcggtcaccgcacctggacagctccgattggtggacttccgccccccctcacgaatcctcattgggtgccgtgggtgcgtggtgcggcgcgattggtgggttcatgtttcccgtcccccgcccgcgggaagtgggggtgaaaagcggcccgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcggtgagtgattctggaggagcagacgtcccccctccacacacgcggccgcttctcgaaggtcctgggggcgttgaacgtgggaggggggatcccggggcctgcggtgggccaagggacgtcaccattcctcgaaagagggcaagggaattacgtttattctcttcttcctctggaaataaaaaaagagagcaacatcatctaactgccctacagatctaatagtatctcgcccggaggtctcagcgacctcggggtggggcctctctgaggctctggctcccccgggagctgtgcgagtccctcccccctccccgcccggaggactttttcggccaccgcaaccttcggccatcccagctttcccgtcccctaattccccagactccgactcctcgcaagcccgtgtcccttcttagatgctggcctcgggagcgtgaggcctggggccagcggaatggcagtgtcagcgtgtttgattcagttttgctggagttcggttcttaacatttctcccccttctcatgcctctgggctcaatttcagttcccctcgccagaggttgcataaatcctatttgcattctgacctgtgctaacgaaggccgaagttttggcttgatcagttgggaggccttggctcggcctgcgcgcaacacgtgtgggtgtagaagaggcctggtatcagtctgcttaacgttatttataaatgatcggagacacactgtttagaagtggtgactgcctccgtatttcaggatctactggagacttcagcatctgaacttaaatagatgttctgtcttggctttacctttggtatttaaaccagggaatgcactctttcatccccacctcccttagttaccaactgaattttgcaacccctacccttccctatttgatcatcctccttggagaagtgtgatgttgaagagtttgcccgtgttaaatcttcagggtcggtcagagctgacgatgaagttgatgtggatggtacagtagaagaggatctgggtaaaagtagagaaggatcaaggacggatgatgaagtagtacagaggtttgtgttcatttgaacttacgtatacagataagccgtgtgaaccttgtgagttacggtcacttcttatgtatctcttctccaaaggtccagataaagtctaacaccctgtatttaaatacccggtgagttgtgtgcatacatacctcctaacttgtccctaggagtgatgaaaactgagtgaattcctttgaaaactatattgcagaatactagcaccataaactttgtaagactttatagaagatactttcagttggatttgtattcattaactgtgtacaccgagtaagtttaaaaatgggatttctgtcagttgaacaatattttaaaatttggcctcttgggacttattgacagttttgaagtcctcactgtggagcataaatgagtatgactttgctttttagtagaggaaagttgggatttttttttttctggcaattttaagaaccgagtatttccagtgtaatgttaaaggtagcctactgctgtgctaacataatgagacggtatatcagttatattttataaaggtttccattttaacccccaagacaatattcagaggcccctgtgctttcatcataattcctctagttttgaagggaactatgccatgcaatatttgcttacctaactgatttccttagagaggaagaagctattcagttggatggattaaatgcatcacaaataagagaacttagagagaagtcggaaaagtttgccttccaagccgaagttaacagaatgatgaaacttatcatcaattcattgtataaaaataaagaggtaagcaacatgtggttagaatattttatctctgtatggtggcatacttgtttacttaaatttgcttaatttactgcaaaagtaatgtagtatccaagtaagtaggtaacaacctttaaatacctaatatgtccaagaattgctaccagatatctgggaagaaagggagtgtcagacattttccttttcctttacctctaaataggttcacggcctgataatagttgtgagtctaagggcagtcacataaactaaacttcttgcattgcatacctgaagatcactgttaggtgaataagagtgcttttataaggtacagagaagaaataaatgggtttggcataaaatcgaatatcttaatgcatcttgaggatagtctaagtgtattccctctggcttccatttagattttcctgagagaactgatttcaaatgcttctgatgctttagataagataaggctaatatc

SEQ ID NO: 71097 - DNA, 1498 bp, Homo sapiens
atcacaggctgcctgtggtctttgctctgcctcatcctcaggctgggacagaggcgtgggcagccacctggagtgtgtagccggttgccatggtgcagagcaagcttagagggtctcatactattataattaaaggctcagcctgaaaacagagctctcctttacaactcattggccatttataactcattggccaaaactagtcacatggccttagccattcttaaatggaaagtagagtactcctaagtttctggaaggcagacagccaggaatattgagtgaagaatattaatgatccatcacagattccaaatagaggaatcattcaagttgttttgtattctagtaaagaaataggcaagacataaaattttatttttcttgaattgttttccttcaaaggtaacttgttttatttaggtcagcctctaacctttgacatttaggccagtctgcccatttgatattaatactttctcaaatacataaattactttaagatgtacactttcagaaaaggccataaaaaactatgtggaggaaaatatctcagtttagttttctgtattggaattgatgggacccaaagctggttagttcctcaatatttgtttggcataatgtaaatattaaatacaactatctggttcttgtcttgcatttagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacgtgagtatgaccaattccttataagaattaatagtcatggtgaggatcttgactctccagttctattctctgagcaaatgacttattctgggccttaattttcctgccttataaaatgaggaaacagaactgttgtcacttgaagaaatgtttgaggacctgcaaagggccaggcacaaaggtttgtgattgctgttgtacatggagggtataaagtaggaaatagcagcagcttccccaagggagaaggcttcttgggtacccacagaggaggcactgcttggtcagtttcccaggttagaagagtaatttgtctgtggagcatcctgaataaaggcatggaggcatagcatgctcactagatgaacagagttcttttcggtggcagttatggatagaatgtgatgaacttttatttatttatttattttgagacggagtctcactcttgttgcccaggctggagtgcaatggcacaatcttggctcaccacaacct

SEQ ID NO: 71098 - DNA, 1056 bp, Homo sapiens
ctgcattttagtacttttttaacttgtgttcccaatttaccttcccctgccttcgtcactaacattgatgtctccaggtttcatttggaggcatcactaagagttatgccccagtgccctctctttttaagcactgggctagatgttggagaaggatagggcaatcattcccaaggaaagatagaaagtgatgtcccaagagatgttaatgtcaggttgctaagaagcaggtgaaattatctggatataagctccatgaaggcaaacattttgttggaagctccattcccaaagcttaacacttaattggcagccatttgtatgaataagtgaggttaaacaggacagttccatgcagggaacgatggctgctaacacctatccaggacctagtttccatgaccatgcatatctttttaaaaatttcctttgcccacttcttaaatgttaacatacattttctccaagttaagtttcagcccttttctcattgtccatgtgatctttatgtagtcttatccactgccacggcctcaggttccatctctagttctcaaatttatattcttagcctagatcaggagttagcaaactttttcttaaaagagccagctagtagaaaaaaagataaaagaaaacaacaagaaagaaagagccagctagtaaatatttttagcttgtgagctatatggtctgtcacatgtcccaactctgtttagcttgaaagcaggcatagacaatacataaggatgtgtcccagccaagtgtggtggctcatccctataatcccagcacctcgggaggctgaggtgggaggatcacttgaacccaggagtttgaggtcagcctggacaacataatgggatcccatctccacaaaaataaaaaataaaaaattagcttggcacagtggtgcatgcctgtagtcccagctactcaggaggctgaggtaggaggattgcttgagcctggcaggtcaaggctgcagtgagccatcatcacgcctgggtgacagaggtccaaaaaaaaaaaaaaaaaaaaaagtgtcccaataaa

SEQ ID NO: 71099 - DNA, 1058 bp, Homo sapiens
ttgccttcattctttttttttttttttgagacagagtcttgctttgtcacctaggctggagtgcagtggggcgatcttggctcactgcaacctccgtctcccgggttcaagcaattctcctgcttcagcctcccgagtagctgggattacaggcgtgtgctaccacacacccagctaacatttttgtatttttagtagagacagggtttcgccatgttggccaggctggtctcgaactcctgacctcaggtgatccacctgtctcggcctcccaaagtgcggggattacaagcatgagccaccgcgccggcctgccttcattcttttagtgttgaatatttaaatacgtgccaaggtaatacatataagtttttaatcaatatagatttaccttgctgctccatacataaataggaaagtttatgaactgtgaatattttttgacgagatttttaattgtatccaattcaaggtaatcagatgcttcttcttttaagacaaggctgcaagaaaaattcgatgtttagagacacctaacatttagaagatctgattataaattcatttaaataccatggtaatagccagcagttcagtataatccaagatgtcctaattattcatgttaactctccatcaccaacaagggtttgtgagctaaaatgtaacacatgtagatacagtaaagagaagaatctcctctacattacctcaagtggagaataaccttagttttaagtagaaaattaaaatattcccaaccgtctgaatagattgttttcatttttcaaggtgagaaagcactgaaatattctggagagaaatggaatcatgcactctcatagctcttactgttattccagaaacctaatgattattgtagataactattcctaattaatgaaaacattttccttaaaaaagctagaaaattaatctggtttatatttatatctgcactatccaaaatggcagccactgggcacatgtgacttatttaaataaaatgtacagttcagttccagttatgctgccacattccaagtactcaacagtca

SEQ ID NO: 71100 - DNA, 1764 bp, Homo sapiens
atttaaataagtcacatgtgcccagtggctgccattttggatagtgcagatataaatataaaccagattaattttctagcttttttaaggaaaatgttttcattaattaggaatagttatctacaataatcattaggtttctggaataacagtaagagctatgagagtgcatgattccatttctctccagaatatttcagtgctttctcaccttgaaaaatgaaaacaatctattcagacggttgggaatattttaattttctacttaaaactaaggttattctccacttgaggtaatgtagaggagattcttctctttactgtatctacatgtgttacattttagctcacaaacccttgttggtgatggagagttaacatgaataattaggacatcttggattatactgaactgctggctattaccatggtatttaaatgaatttataatcagatcttctaaatgttaggtgtctctaaacatcgaatttttcttgcagccttgtcttaaaagaagaagcatctgattaccttgaattggatacaattaaaaatctcgtcaaaaaatattcacagttcataaactttcctatttatgtatggagcagcaaggtaaatctatattgattaaaaacttatatgtattaccttggcacgtatttaaatattcaacactaaaagaatgaaggcaggccggcgcggtggctcatgcttgtaatccccgcactttgggaggccgagacaggtggatcacctgaggtcaggagttcgagaccagcctggccaacatggcgaaaccctgtctctactaaaaatacaaaaatgttagctgggtgtgtggtagcacacgcctgtaatcccagctactcgggaggctgaagcaggagaattgcttgaacccgggagacggaggttgcagtgagccaagatcgccccactgcactccagcctaggtgacaaagcaagactctgtctcaaaaaaaaaaaaaaagaatgaaggcaaaatgtggtctattagttaaggatactctcagggttttcttacaaaaacctattttttgacctgtaatgttatatcatattctgtagacaaaatcagaattgttaaacaaatgagtttaaccataattctcttatttcaacagactgaaactgttgaggagcccatggaggaagaagaagcagccaaagaagagaaagaagaatctgatgatgaagctgcagtagaggaagaagaagaagaaaagaaaccaaagactaaaaaagtaagtctggtttatctccctgcataagatattgtttaacatgtataggcaaaaccaggaaaacctaagtatgcactggctgatttgaagtcagcttcagttcaggtgctaagtccatggagccagcttttaaaataaggcctttgtttgtatgttgaatacattgtcctgtagaaagttttaagtatcaaacccaggtcatttttatgaagagttttctaacttttatatattgcctaggactggtggcttatatgtttggaattttaaaatcttaaaaagccttctgagtcctcttttgtctttttatcatgcagagattaaccataaaaatggttctctggcttgcttaggtagcagactaagaagtattgatcatggtggttgagaaatatttttgtaaaatgttggatttctttaagtcatgaaatgggaatatataatatgtatttccttctaacctcaaaacaaatattttcaagaaacatttttgctagtt

SEQ ID NO: 71101 - DNA, 1089 bp, Homo sapiens
ttttgaattaaatattgagaaaaatactttgcttttgatacagttggcagaaaccttactagataacaggtatcctttggtgccctttttttttttttctttaatttggagacagagtctctgccacccaggctggagtgtggtagcacgatcatagctcccttcatccttgaactcctaggcttaagcagtcctttcacctcagcctcccaagtagctaggaccacagacacacgccaccatgactggctaagttttaaaaattttttgtatagttggaggtcttgctatgttgcctggactggtcttgaactcctaggctcaaacagttctcctaccctaacctcccaaagtgctaggattacaggcgtgagccaccacaccagtcctctgggtctttacatagtcttttgaaatctactgaagccatggttactgctaggataaccttggtgagtgctgagagagactaatcaaatactataataacttcaggttgaaaaaactgtctgggactgggaacttatgaatgatatcaaaccaatatggcagagaccatcaaaagaagtagaagaagatgaatacaaagctttctacaaatcattttcaaaggtaaatatttataattccctagtttctggttattaatgaatagacaaaatatcaccctcttagtttaattgtatatggtatgtgaccatgaatatgagatggtccattcccattttttcccagtgagaaaattcaaaaaaagacctttaggccaactataatatgtctacttctggtttattgacctagtcacaattaaaatcacatttatgaacctttgagattgacacctcagtagagatggtctttgagagtaattggtttccagaacacaccatttttacttaagttgaattattatactcatcactacttcaaaattgcagcagttattaaaattagtcctagctcttagtgaatagtgaaactacaaaatcaagaatgtttgaaacagttttatggctgtttaaacacaattggtttcctttttattcctgtgtattttgtaatatgtgatttttttaaaaaaattatttt

SEQ ID NO: 71102 - DNA, 3429 bp, Homo sapiens
ttttacaggtatttacatacatctttgtagccactcttagagctaagttccatggaagaaacatgttcttgagtacttactgtagttcaagggcacactgaagtgttgtatgtaattttgtcatttaggcagggtggtggttttcctattcacttctctcatacgtaagaagtataaactcatccttccttctgagagtttaggaaataatgttattgacaatcatcatcaaaacaaccatgtctagtgaattagaattgcaattctagatatttcttcactccacccttttctttctcttccccccacccttttctttctcttccccacctcccgccagtaaaggaaaattttttgttagttaattgctaaactgaatatgtaccacatagtacattgcttagttcttgcactgcttttctcctgtgtcgtttgaatgactaagataccaactttccacaggaaagtgatgaccccatggcttatattcactttactgctgaaggggaagttaccttcaaatcaattttatttgtacccacatctgctccacgtggtctgtttgacgaatatggatctaaaaagagcgattacattaaggtgagtttttaagtagtacatgctgcgtttaaaatttgaaagtttaatttccagaaagtgacttttttttggtctctttagctctatgtgcgccgtgtattcatcacagacgacttccatgatatgatgcctaaatacctcaattttgtcaagggtgtggtaagtatctgaagtttgggagaaggggtgattgttgtgggggtctggcagtgtagagtgtttgtttggctttgctttcttccagtggttttattgctcactgaactttcttttgccatctgaaggtggactcagatgatctccccttgaatgtttcccgcgagactcttcagcaacataaactgcttaaggtaagtgtctctgggaagaaactctccactttgctgtttgattggggttcagaggacaggctccatttgtggagtaaaaccagattttgggtctggtccatgattcttcagatgaatttcctttctttctggagttatcagatcctaagaatctgattctttttctcccaacatttaataatgaagtttcaaacatctagaaaaaaattaaagaattgtacaggtccaggattaacattttgtcatctagacacatagccacctttttatcaagcctttcattaaacctttcccctccaatacttccataattagaagactctttagtttttgaatttaaaagtatttgaaagtagcatatttgttcacttcatttagatgctagagagagagtatcactgagtcctaaggttagaatataaacattaaggcaatcttgtggctatttgcacggacagctgaatttcagcccaatctgaatgaattggagtgcttcaccatttcctgcccctcaataaatggcaataacgatatcgtctttgtgtttttcacactcctgcctgggtaccttacattctcaaaagttggagattaacttctctaatcagttattctttcattgtgtttaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggtgagatgaactcataagtgttgtcagccattctggaaggtagctagggatttatagccaactcttgagggggagaaaaggaaaacttaattgtgtaactggagtagttataaggcctggtcagtcactgacaggaaggtcatttatattctctgaacctcttaattcttcacctgtaaaatggagtttttaataatgtataaacatagcagctgctaggataaacaaatacaccagggccagacttggaaaactttgtgacttcttaattttgtaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaaggtactgtggaaattacaaattgtggaaatattagtatcagcatttaagagaaagttattttgtgaacaaattaagctgcagctggttactttgtaaccattagaatggtaaaaatttaattaatgtaattaaattattgggagaaagcttaaaactttcgacaatactgctttgttaataacttgttacaaattaaattttatgtttttaaaaggtggtatttaaacttctgactagaaaattcagattatcaagtaagtgcccctacaaattctcctaaaccttaagaaaagctatttttatgacctgcttctgtgtttatgatcttaagtgataaagtcttagacagttgaaagacaattgctcaatgaccttacctgttgatattaatttatatgacttgatttctttccctaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaagtaagcatcctcgggaaagtccctgccagggcgttgccccttacccaatctttgttttggagataataccagcttcaatacaaagagtaaaattgccttaaatgtctaccactgtctactataaggtagacaacaagtttacgaagggatttctcctacatttgattgagaaagaaaaggtctttgactcatgattttctgattttattgtatttgatatgtaaatgggaattttcttaatgtgttatgcatagtctttacttttgcattggattatatgcttagcctaatatctgaatttattttacatttttaaatgtaatagctgcacgaggttaatgacaacattcctcaagtgagttaagtccatttcaaatcacgtcccccacacccccaagcattaaattatgggtatccagatagaatgtctcataaagtagacggtacaggacctgtgaattaacagtatttgaactcaagggcctatacctggaggtatagt

SEQ ID NO: 71103 - DNA, 2122 bp, Homo sapiens
ttatactgtattgggttttttatttttttcttgttttgccctttctaatattttcaatccgaggttgattgactctgcagataaagtagactggaaaagtacagtcgtccttaggtgtatgagggagattggttctaggacccctgccaaaatccacaaatattctagtcccccagtctgccctgtggaacccgtgtatatgaagagtgggagctctgtgtgtgtggattccacatcccaagaatacggtattttctatctgagtttggttgctgaacctgcacatacggagggcggactgtatttattggaaaaaaaatagcatataagttcaaacctgtggtgttcaagtgtcaatagtacattttgattttttttttttaccaagagttgttctgtgtaattatgaaagaataagggaaacgtatgaaccctaaaattggatatgttttgttaatgttcatttttatctcttaacagttactatgcgagtcagaagaaaacatttgaaattaatcccagacacccgctgatcagagacatgcttcgacgaattaaggtagtattaaagcagtcctcttgcttgtcttttaatttgagtactttgtatcttttaatattaatctagtgcatcttcttgcatttcaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtttgtatccccaaccttcccgcaaaggctggctggctttctttgtttctgttctttcagaataggcctctcatgattgagggatgtagctttgcgacatttgcctaatttctaccttttgaaagaattttattgaatgtttgaatccctgtagtgtcaggcactgcactagaaactaagtcctccttttacgtcctctttcctttttgcctgcctccttttgttagcttggctgttcattctagttaagaggatttagtctgtggttctgaataaacagaagtgacattaattatgattttatacatataaatgagcaaagtggaaataaatccaaggcattaatgggcccataaatgttgtgtttaggtggaagaagagcccgaagaagaacctgaagagacagcagaagacacaacagaagacacagagcaagacgaagatgaagaaatggatgtgggaacagatgaagaagaagaaacagcaaaggtatggcaaatcaagaatgtgacttgcattttcagttctggcaaagttaggacagagttttagttctggcaaagttaagactgtgtaacttacagaagtcagactgagcatttaaattgtttatttcatgcacaaacctgtgagctaggttttttttctgctaacttttaataccttctgggttttttttatttatttacaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaatactcagtgtcttgactgtcttgcagagaactacctaatacttggctgaattttttttttttttaatcatgtgtcttgggttctttttcttagaaaagtgactcaggcttatgaccttttttttttttgagaccaagtctcacttttgcccaggctggagtgtggtggcgcaatctctgctcactgcaacctccgccttccgggttcaagcaattctctgcctcagcctcctgagtagctgggattacaggtgcccgtcaccacacccggctaattttttgtatttttagtagagacagggtttcaccatcttggccaggctggtctttgaactc

SEQ ID NO: 71104 - DNA, 1049 bp, Homo sapiens
acaaaggccggggccgcgcgtgcgcactgtggcctggtcggcctttccttccctggctgcggcggtggtggtggaggtcggggctgctctgagggttacctggtgcacctggacccttctttggttccccgcgataaccagttgactataaaatatattagtaagcattcagcagtctttggttaatgtgtctttctggatgccattcttggctagaagggttttccgtcaccctccattaccacgcagagagctgtaaagatgagtgtcgaacatttccagctccaggagttttcattttaaagttggttgatttgttgcggcttccccccaccccaaaggcctactgaaagcaactttaagggtcacgggttagataattttgttgtgggcatatgtatacactctcgagtagtcaatctaaaaatgacctttgagttttccagtggccttggggacgatcttaagaatccgtttttaaaaagtcctttgggggagtcaagagaaaaatttgcaaaagcaggagatttagggacttgaactcctggcggaagactaaatttttaaaaaatggatatggtgacagttttttaaaagataaagagtgatgatttacattgaaattaaaaggaaaaaaacctatgcctaatgaagaattatcctgactctcagtggctaatgggagctgaatttaggcaatacaagggacttatatgggcctgttcatgtctgtaaagttggcatgtctggaatctgattctgacatgccgagaattggtgttacatgaaagggcacactaaccaaaataaattagagcttaggaaaagagatatatgtagacaaagtgtggactttatcttgactttgtggatcaagtcctggaataaattactccacttctttcccagaagaactttacaaataagagaattcaccagaatttgtggaaatctctctctcataacctcacttaagagcagaattgaaacttgggccaagaataaattacacattgtaagactttattcagggtcttacagcaaaatag

SEQ ID NO: 71105 - DNA, 1006 bp, Homo sapiens
acaggcagcatcagaaggatgctggcaggaggtacctacagtagtcattattatagcaaatttattatataccaggtactgttttggatgttttacataggccaactagcttaatgctcctaaccaattattaggtactattcccattttacagatgtggaagcatgggcataaagagattaaggaacttgcccacagagctagtaaatgggagagctgaaatttgaatccagatgacctagcttcaaagtctgcttctctagctagcaaatgtgctttactgcctctcttagtgagcaagatggagatggactgatggcaatccagttaggtgaaataaaaacctgacttactactgaaagaatcaggcagactgaagagaggtctgtacttatatgccatgtatctctatccctaactttgttcctttcagtaccttaacgtcagggtgctgatggcatggtgataaaatttgtgagtgacccaagcctgggaggaatttgtggaattaactgattgatttaatcagagtccagataaatcctgactgactggaatggtgaatcatcttttacaaagaagaggcacaatcctatactcagctgcagaaaaatcagtgataaagtgtggaatgagggagaagtgatacaaggacagtgttcgttgatgggaaactcagtgtgaatcaacagtataatgtgggtgccagtatagctagtgtcatgggttctgcagtttgtctccaaaatgagcaagttggtagccctgctcattttcgggctgatgaggctttatctggagttttgtttgattccgagcaccaaaaaatgaagaaatttgaaatcatactacatgaggaattatactatttgaggaatactgtatgaggactggcttattctaaatctttatatttacagtttctagtagactgtacatatggtgaatacacagacctccatctagcaataccaaatggaataatagttatggtgctatcgcatca

SEQ ID NO: 71106 - DNA, 1048 bp, Homo sapiens
acctcatctctaaaacaagcccacaagccattgtgtttttcttttttctttcttttttttttttggacagagtcttgctctgttgcccaggctggaatgcagaggcatgatctcagctcactgcaacctccacctcttgggttcaagcaattctcctgcctcagcttcccgagtagttggaattacaggtgcacgacaccatgcctggctaatttttgtatttttagtaaagacgggggtttcaccatgttggccaggctggtcttgaactcctgacgtcaggtgatctgcctgccttggcctcccaaagtgctgggattacagacatgagccaccatacctggcccatttgtggttttctactggggaagttgagttaaaatgtttcccttccttcctgtttctctatttttctgttcttatttaattatttatgtatttacatttagaatttatataaaatgatatgtagatactttgtatccttgaggaggttaagatgccaagtaatactgtgtcgaaaataatagtctatgattattcttcccacgaacagctagcaggggaaggagagtggcatggggggttgcacgaacccagttctagggagaaagaaagggaagatattgcagaggagactcatgttgggactgtaagagcttaattttggggagacaggtacaaaaggtgctagttgggtaacttttctgggaaagctgctaaagtttctaagttaagattttctgcatttctggaaattatttgtatttcagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattgtaagatctttgtcctcgttggattttataagt

SEQ ID NO: 71107 - DNA, 1271 bp, Homo sapiens
tatgctggtgccccaaatattctaggaacatcatatgtatctagttcaagctgagctcaacaaatgtacaatatgctctttcattgaaagctgtctgaatttagcatattataaatattgtcatatttatatttttgactactttttaattcaattttagtaaagaatttcgtgaaggaggacgtattctagtacagaaattacagaaatatcagccacgaatagcagtgtttaatggaaaatgtaagatttacttttaaattttttttttctttgctaacattatgggcaatgtaaatatgtttgtatttcattttaggtatttatgaaatttttagtaaagaagtttttggagtaaaggttaagaacttggaatttgggcttcagccccataagattccagacacagaaactgtaagtccctaaaattgaatttgtaaatcagctaaatgtgaatttttttctagataatttccttatttgtcctatccattgtgatttataccatgcaaaacaattacactgtattttgttgaataatacctatacatcagctttaactaatagttgtaaattaattcaaatactattagggtttattagaaagaaaaacatttgtcagctaaatgtcttgatgttgttattcagtgaaaatattgagaggaactggctcatatactacattcagaatacatttaatggcatgtagttgtcaaattcaaatggtttagccctcgtactgttgtgaaacaaacatggaaacacagacatgatcctgattaggaaaaccagttgccccatttatatatcttagctcaacttcattttagagccatataaataatacaacccagacaagcctccagccaacctaactggcattcaatactgttgtcttatacacaaagtcatcatgaaataacagtgtttttcaaattgtcctctctacagagcttctgcaggcatttggttccaattttgcttcttagttttaggttttatttacaacttttaaagaacaacacagtgcacagatttacatgttgtatatacaacatcttaactgatggagaagctaatttgctgccaggtttttgtggaaacctaaaaatgtttctgccacctaaatatatttaaatttctcctttaaaattgtttttgttcataatttcttataaatatgcaattgatgagttttattatagcattggtttttgcttaaataaaggcccacctttgtctgcttggttaaaatggtacaaattcactac

SEQ ID NO: 71108 - DNA, 1050 bp, Homo sapiens
atgcctataatcccagcactttgggaggccgaggcaggcggatcacctgaggttaggagttcgagaccagcctggccaacatggtgaaaccccatctccactaaaaaatacaaaaattagccaggcatggtggcatgcgctgtaatcccagctacgtaggaggctgaggcagaagaatcgcttgaacccaggaggcagctcattaggcggaggctcattatttttcacttcctgacttggtaataagtcagtattacaaattcaaccttaaaagcaactacttttattgatttttacatatatttatatgtagttaagtatcaagttattaacccaaataaagacaaatattctaatctcaatgagtgaattcaatagaattataagatttctgaaattataaaatgttgtgattctagctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaaggtatgttactgtcctcattccttttattcattttgtgtgtgtatatatacacatatatacttacatatatatacacatatacatatatacatatacacatatacatatgtgtgcacatatatgcacacgtgtatatatacatgtgtatatatacatatatacacataagtatgtatgtctatatacatatatgtgtgtatacacttgtgtgcgtatacatatgtgtgtgtctatatatagacacatacacacacacacacacacacacacacacacacacacacacacattacagaaagtatcttatggatttaaaagcaggaaaaaagaaaacaattatattcgcagccagagtgctctgataatgaatattagtcactgttaaaatctccttttaccaaggtcttccctctactctggcacttctgcagataattcacctgcagagtgccagagcag

SEQ ID NO: 71109 - DNA, 1065 bp, Homo sapiens
tgcgtttttctaaacagtttttctgaaatacttacccaggtgccttatgtgccacagggggttaattgtggaatatttcccatgaaacacaatcagcattggggaggtggccacccctcctcccagggagctgctatagaggttttccctaagaaatgaaatagaaaaacaacatttggcctggagcccccacaaactcagataaagtcgaatctgatattgtaaatgatgtaagacattatctcactatgtactaagacttatggcctttcattctcccccaaattttcattttgaaaattgtcaaacatacacaaaatagtaagaataccatgaactcctatatacatcacctagagtaacagtgttaatattttgccattttaactcccagggttttaaatagtagacacaggagatcaaattcgaatcctacattatttagaataactttacttgcaaattcaaggttatgatggtattaaaatatccagatacacaagactgctaggcaatacaatgatgggataatagtgcttgtattagacttatttttatcttctctattttaaaactccgataacgaaaaattataaattataaaaataaaccttaaaaagcaaaattgactttatataataatccttaataaaaaaatctatgttaggaggggaaactcaactaagataaatgaagattgtttggtggaaaagattcaagtcacatttttcaacagcttactaggaaaatgtataatcagggactcctcgctccacaggatcttgattcctctgatttatatcttttgaggaaaggttttaattgactgcccccttttctttcttaacattgcctctgtaagaaaatctgacctgagatgactgtgaaatatttctaacccttgaactatgtgtggaaaattaattgaatgattttgtttccaagcatggaaaaaatggtagagaagccttcacgtactccacattcttttgcatccatttctccaattgcttggtgatgcgctggtgcttccattctgtcatgttggcaacaatcacaccagga

SEQ ID NO: 71110 - DNA, 1058 bp, Homo sapiens
ataacttgatttaaaaataggcaaaggactccggaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcattgtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaggagacggtgcgcaaagccatggaagctgtggctgcccagggcaaggccaagaagtgaaggccggcggggaagatactgtccccaggagcaccctccctgcccatcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcac

SEQ ID NO: 71111 - DNA, 1014 bp, Homo sapiens
ctattcaaagtattcttagatttatttttctttttcctagataacatcctagaattattttccgcaaaacaattatgtagctaaactttgaagttttatatgtcctgaaatgttacaatttttgcccttacacttgaataataattttgtaggaaatagatttctacaaaagtcattttgctcaaaacttcaaaacatccatgaaacttagtgccactttctaaagttaaaaagctatgtaggacattgctatgacattatagtgaaaattttaaaagttacaaagcagcatttttagtatgcctcatttatccatatgtgtttatccatagacagaggtgtcttaagggatatttatcaaaatattttcaatagtgattgttctggttatctagtgccatacagtaaactgccccaaaatttaatgatgcagaataataaccatttgattatgttcatggattctgtgggtcaggaattcaaataggccacaggagggatggctgggcagtcagctgagaaggcttgaaggggttacttctatgtctgatgcctcaactgcaacgctgaaggacaaactcagctggttctgtcaccctacatagctgcatatggccacccagatggtagttttatgggagttgaacttcttacatggtggctcaggattccaagagtgagtgttctagttaagccatttaggccttctgtgacccagcctcagaagtcacgtagtgtgctttcaccataccctattaatcaaagcagtcacaaaccagtccagaatcaagggaagggaacatagacccaacttcctgatgggaagattgtcagaggatttgtagctatgttttaacaccaacagttggcaagttgtcattgataagagtgttggctaaatgatgacaggaattatttttaatctcttctgctcactactgagccccagaagagtgcctggtacatagtagtgtttgataagtatgtattgtatgaatgaggtttggggtttct

SEQ ID NO: 71112 - DNA, 1053 bp, Homo sapiens
ttttctattcttagcacttcaaatccaagaagtaaaatgaaataagctactttatgtttttgttttgttgttgctcaggatgtacatttttggtggatgggtcccacataagggggaaaatactgagacttcacctcatgattgtgaatggagatgtaccagttcattttcttacctaaatctgggtgagtcttttaagagttactcattgaattaatctttattaataagataatttttgtaattttgttaagaacaaaagattagtcatggatatttctatcttttcagatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactggtaggtaagaatatttaacaaataaactttttcctttaggtaagcactcaaatgtctgccttttgagacttactgtaaatgctactacctcttgtttcccataattaagtatgaatggaagaaacaatatgtatagttattctccactcctgagaagtatataattatcctctccttgagtgtaggctggatttaaagactcctttgcaaagaataaagtatggaaagggaaaatagtagctttacagaaacctggcaagcacgagaaacctggcaagcatgagaaacctggcaagcactaccttaatcaagtgatcaaggttaatatcactagtgataagttagtatcatttactccctaatatcatgtgataagtgaaagtacctcggtggtattcccaaatccataacctcagcctaactatgagaaaacatcaacaagcccaaactgagggacattctagatcttctacaaagaatatgtgagcagtactattcagaagtttcaaagtgaaggaaaacaagggaagactaagaaataatcaaaaactggaggagacaaaggagacatta

SEQ ID NO: 71113 - DNA, 1017 bp, Homo sapiens
tttgtttagcctatatcagatacattacagaagctagacaaatgattacaaacataataatgaggtaagttaaaattctactagtgcaaaaagcaagcatatgccaaaagcaaagcatatgaattaaacaaatgcagaatgaagctctcaccaagggcattgctgggataacaaaccagagaagctccttgtaaacattgtaaagtacacatttaaagagtaaagattcatacagccacaaaaaaggtattctaacaacaccatagtagtgcatttattttatctttagagtttggaaaccactcattatgtgtctaacaatttgcatattttcttcaagagaaacttaattagtgagacacattaattacaaatactgtagtataaaaatcccagttctttacaaaaattatatattaaaatattctatacactttaaattagtaactggaacacacatatatatcaattctgcacaattaaatccatctttgctggggggtatcatacatgaaatttgaggacatagctactcagtcaacctaaactggcataaggttatgtggtataaaaaaagatagacctgtgcccctgcagttattgaagctcttagtttgaaatatcttttctgcaattattgctctgtatattaattccagatttaaataggcagtggaaccatgaaattcctaaaaggtttaaaacaagttacctgtagcagagtgtttataatgcctatctgtatctttaaggttgtaatggaacctgagttagctgtctaatgcttatattttcatagtaaaaaagtttatacaatttcaaggtaaaaacaatgcaaaaataaaacatttagagcatttacaaaaatcttacaaatgtttaaaacactattttaaaacttgtgtcctgttaaggtgcttgtttttttctccaataggaggacatatactttaattttgaattcaattatgaagattttaattttagcaaaagcaaaattagagccattaagacaga

SEQ ID NO: 71114 - DNA, 1028 bp, Homo sapiens
ttgtttttaccttgaaattgtataaacttttttactatgaaaatataagcattagacagctaactcaggttccattacaaccttaaagatacagataggcattataaacactctgctacaggtaacttgttttaaaccttttaggaatttcatggttccactgcctatttaaatctggaattaatatacagagcaataattgcagaaaagatatttcaaactaagagcttcaataactgcaggggcacaggtctatctttttttataccacataaccttatgccagtttaggttgactgagtagctatgtcctcaaatttcatgtatgataccccccagcaaagatggatttaattgtgcagaattgatatatatgtgtgttccagttactaatttaaagtgtatagaatattttaatatataatttttgtaaagaactgggatttttatactacagtatttgtaattaatgtgtctcactaattaagtttctcttgaagaaaatatgcaaattgttagacacataatgagtggtttccaaactctaaagataaaataaatgcactactatggtgttgttagaataccttttttgtggctgtatgaatctttactctttaaatgtgtactttacaatgtttacaaggagcttctctggtttgttatcccagcaatgcccttggtgagagcttcattctgcatttgtttaattcatatgctttgcttttggcatatgcttgctttttgcactagtagaattttaacttacctcattattatgtttgtaatcatttgtctagcttctgtaatgtatctgatataggctaaacaaatacttaaccaaagttaaaatacatggtaagcaattttgcacatattaaatattagggtttgttgtgtatatgtgtatacttaattataaaagaatatgaatggaaagttatactaaaagtatatgtttcaagcccagttattttaaagatctattgctttaatagaaaaagtttggcttttaaccctttcttctc

SEQ ID NO: 71115 - DNA, 2706 bp, Homo sapiens
ggccaacatggtgaaaccctgtctctactaaaaatacaaaaattagctgggcgtcatggcgtgtacctgtaatcccctctgcttggaggctgaggcaggagaatcacttgaaccctggaggtggaggttgcagtgagctgagatcacaccactgcactccagcctgggcaatagagtgagactctgtctcaaaaaaaaaattttttttttattatatctattgatatagttaatttcaacatgctattaaggacctgataaagaaggttattaaaattgtgttttctcaatgtagataacagtatatagtgttctcttaatagttaaaaataagcatatgttcatatttgcataggagatttctagaaagatacacaagaaatgggaattagacttgttattgtctttttattcactgaatttttataatatgcatatggtacttttaatctccttttctttaattctgctcaatttaaattttctaatcttagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtg

SEQ ID NO: 71116 - DNA, 1012 bp, Homo sapiens
ctttaaaagttttatatagacttttacataaatgagtttatataaacttgggtttggagaaacatacaacctcttaatctagcagtattgaaggagccataggttacggtctgtaagttttatagctaagtcgtataataaatatttatgagtacctactctgtggaaggtgctgtaccaagctgtaggaaacacaaagctgattcgtgacattaagtagcaaaaatctaataggagaaatgaggaataataaaaattctaaaaatgtgtaagagaaaaggcatagagaagcacttacattttatgaaagaaaagatcatttttgaaggtggtatggagatgttatttgagatttttggagaatgggcaagtaggattttagcaggtatatttgaggataaaaagtgttctaggcagtgagtctgaaattaataaaaaaaaagttcagttctggctctgtaaaaattatgaagagacttgctatcctaatccctaaataatggttaagaggtgaaccagaatgattttattctggatcactttggtagttttttctatcttgaaatagaaataataagaagctttacacctaaatatttttatttctttagatactgaggacagcatgaatgatcatgaagacacaaatggttcaaaagaaagtttcagagaacaagatatatatcttccaatagcaaacgtggctaggataatgaaaaatgccatacctcaaacgggaaaggtaacgtagaggagaaatttaactaggttttttcaagggaaacacgaaactacatgaattcataggtcatgggtacagttagctgttgatttcaatcattcaggctttcagcaaatcaaatatttctttcatgtctacatacacagttactgaacagtgtcccattttcaattctgtcatgtccctaaatgttctcctctctcccacttattggaggcagataaaatagaatttagactgttttttttttttttttttttttttggggac

SEQ ID NO: 71117 - DNA, 1016 bp, Homo sapiens
atgctgtctttacatggattagctcctaacctgtacaggagcctgggaggttaagtcttgttctcatccagtttgttcacggtctcatggtaagtggcagggaattcaaactaggtgattcgattccagagcctgtgtcctggaaggactaataggctctgttctctaccccttcaccctgcctcccaggttatgtaacatttgtcctgcaagctgaggacagagaccttgtctgttgttgacagctacgtgaccagcacatagcatgaacctggtaaatactaagcgctcactcagtaaatatttgttggctggcttactgacaatctacagtctgttttataagtttttataggatgttttagacctagaaaaaacctttgggatgcatctagcaagtttttttccatcattcttatatataggcgaatggctggcatattctaagcatcaaagattaggttgacttattgagtgaaaggtactaagtgccatagagctttaaagaacagaacatttgtttttgaattgcagaaaggataaatcagaaagattaaaggaggatagagaacactgggattaaagtctggggcaggattttaatggtagaaagacagaggaaaggaagacagaaggcgtgaaatgatagaaagctaaaacttgcagaactgaagacacatacagttaagcagatgatgtgcggcttctcttcaaaggagggaggatgagatcgaatgtctgtggggtacactacgtgccaaacactgtctttagcagctttctagtctttatttaattctgacaactctaggaaatacttttatcttcacttttagaagactgaggtttagcgaggctaatgctgttagtccaaatgataatcatgttgctaattccagtgcatgacaagataatatgatttaaacttttttcctttaatacttttgtttgtgttatatttctaaattaattcatctcccagatccgcctggttatttgaacagtgtcttgctcat

SEQ ID NO: 71118 - DNA, 1386 bp, Homo sapiens
acagagggatcctgcagaccttgaactgagccttgaaatagagggtgggagtggattggtgaagggtgtcaccaaaagcaaaagcctgatggcaggatgggcaacttaagtttaggggatcgggagtagaggtgcatggtccagggtagatctcaaaggataatgtaggaaagagaaagcacttgtcccctctggatatttaattctggatgtgctactatatctgtaacctcgggtgtgttacagcttctttgagctgtggtcgcttcactcctaaaatgaaagaagtgcactcagtgatccctaaataaagcacattctagcacaaagatttttattaaccatgaagatagagaaaagtaggaaacaagtttggttaggttaaatgtgcgatctgctcatgtgaagtcatgaaaatgaggtttggatttgacacaggaagcctttaggaacctttgagaataggttcaagagtatagaactggtgttgtggtgagattagtcttataacaatatgttaagatgggctgggtggtaatccagtggaaataggaaagggaaagcatatctaggagacatttttaaagaggtaatagatgaggtagagcttgaaggagatggaagaacctaagatgatgctggtatatttggctgggcagagtgaagggctggtattcttcttagtagaattacagtagtggaaagggaaatctccctcctttccccgttgcagggaatggggcaaggtgaatttcatttcccaatatcttaaatttgccgtgatgagatattagacatgccctacaggcatgggttgcttgagtggcaagcagaatattggttgtagatttggcatttataagcatagaagtgatatttagtgagttcattaagaaaataagggaagaaagagaaggataaccttgggtgaaacaattagggggtggggaggaaaggatattgctttggaaatcagagtaggagagaattccaagcataaatgtgtggcgagtagtagccagcactacaaagaacagtcaagtaggatgaggacaagatcactggcagcttttaagagtggtttcattctgggttggggttaaaaagtacatgttcaggagtttaaataggaatgaagaggtgtcttaacaactgtcagggcaagaatggtagctaggcaagggtatggggcagaattaagattttatatatctctgtgtacttctgtatgcttaatgagggagactaagcatgtttaaggaagagtgaaggagctggtaaggaggattgaagatacattatagaagaggaatctttgtattatttcttatcctcagatagataaaaggaatgtaacccagaaaacaggtaaaagggtaaattaag

SEQ ID NO: 71119 - DNA, 1053 bp, Homo sapiens
tttaaaattaacactgaaaggatgtgtttttgttttggcatcctacccctcccccatttaattgtttcctttgagaaagaatggagcaaatgagaaatgaaacttgtaacacagcaattggtactaatttgttcagctatttatgccttacagtgagactgaagtgctatttcgatgcaattttagtcaaaaatggtggtgcttcaaaattataaataagggtcttgattgtgttgcttttttgatatcttctcagtgcagaatgtatcttcattacagtataatctgagattcttaattgaaaagcattatattctcagataattttttcctcctcttgagctatagaatgtctaaatgttactctgaaacatttaagaaaaccatcaccaaaaaattaagatgataaggggtgtgtttgcatcttgagtgttaatgttttaagtaatttagatgtataatttttggtctcttgcatattatataatttggtccctttttggtgtattgtaatgaatgtttatgatgaatatggctaaattcagggttatgttggaaaatccattttctcctttccccatggaattaacttgtttttaagttctccaaaataaatctttcaagtcaacaaacatttattgggtgcctttttatactattttataccatgtactccattgattaagaatagtagtcaaaattatacaagccctctttaattttatgagaaaaaaagcctataagtgatacatttgatgtatttttactattgatagatgttaggtcctaatagatgtttatcttttaggttgaaatcacaaagattagacacctttttagataggtgttcttcagcaccactgacaacacggttctgacagtatttcatgacagtaagtatattttaccattttggttgttaattagatttgaatagtaattggctggaaataaaattgtaaccaatttatactggaggtgcctggtagaatgaatgcatttcaagtctagacagacagtacctctgctcattcctgttgcttccttattttc

SEQ ID NO: 71120 - DNA, 1081 bp, Homo sapiens
aggcacctgcgtggggaggaaggcatggctttagcttccccgcagcctggtttgcgcgtaaagaatgcagccatctggcggtttgcggtccctgtacttgccccgaaggtgggaaggaagcccttcggattggactaaggttttaatcattagtggtgggaggcgggaggatatgcagggccttaaagaacggtagtcttagagaacaaagaattacagagcacccacaaatcgtaatctcgcccaaagcactctaacaggataatttaaacaaggttaggtagcctgcgacctttaaaaaaatggcatcccactaacccgcatggaccccatagttgcgtggttcgtgctacaaatcactggggtggtttcatctctcttagtatggaaactaatcagcaacataaagtgatgaaagcaaacggatcaatatcagtggcactaatcagtggggggtttatttgtaaagtattgaaagtttaaccaaaattccttaaaaggcaaattattccttccctgcattgctcttgtatcttaatttaaggattactgtatattgatgcaaaactctggttgttgatgccaaagaatggagggtggaggaagggactactgcttttcttggatacaaatttgcatttcttaaaacattaaacagatgtatgcattcccttgagcttttacatatatcaacctgcccttaagaaaatatacaccatatgaggtgacagtgtttttctttaatgtactgagtctaaatatatactgaatcaactatttgggtgagtgagtgtggtgtggtatgactccctgcccacacccccctctcccattccaagcaaaatacataaatatagctcccatgttttaagtgttctgagggcttattttttcaaagacactctttaaaaaataacatttctcgttacaaggaaggacttttctgagcagttttggggttagaggatactattaatatttgaaaagaaattataaattacttttaatattatagcaaacgtcaagcagtttttgctacctggacctttttagtggcattaaaaactttcaattcagtggc

SEQ ID NO: 71121 - DNA, 1054 bp, Homo sapiens
actaaaagtaaaaaaattagctgggtgtagtggtgcgcacctgtaatcccatccactcgggaggctgaggcaggagaatcgcttgaacctggaaggtggagactgaagtgagccaagatcgcaccactgcaccccatcctgggggacagagcaaggctctgtctgaaaagaaaagaaaaggaaaaaaagaaaaggaaaacgttctagttattttaactttctggttgtttgaattttgcactgaaatttagactttagggccatttccctagatctaatttccctaatattcaaactttttgcttgagtcacacacaaactgtgttacattttaaaagtgattgtaatactcagtcacctatttgtaagaccatctgtggtctagtcactcaaaacaaccaaatatgcagacaacataaagatgaaatgaatgttggtttcttttattgtagttgtgatggatgggaaggtggcctccaaaccacctgtggtgggtcactggaagacaaacctgaagggtttgttgcacctaatgcagtccagtcaggatcagtctgtgcctcaaaaggtgcctgaacgggcaccactgaaatcctaggcaagcagagtacgaagccaggctctttttttctcctttttttgagacgaagtctcactctgttgcccaggctggagtatagtggcatgatctcggctcattgcaacctccacctcctgggttcaagtgattctcttgcctcagccttctgagtacctgggattacagacacgtgccaccattcctggctaatttttgtatttttagtagagacagggtttcaccatgttgtccaagctggtctccaactcctggtctcaagcgatccatccacctctgcctctcaaagtgctggaatttcagacattagccaccacacccagccccgggaagccaggattttgccaggctttttttttttttttatcatacagacctaaattggagtcttacttcttgcattcattagcttgtgattttgagtaagttactgaacttctttgaggttccatcttc

SEQ ID NO: 71122 - DNA, 1053 bp, Homo sapiens
ggggaaaaataagcaaatgataaacataaacaaaattttattttccttttttgttagaggcagaatttaaggaaaaattctgatgattttgattacagttagtggctaacctcttatgatttatttacctatctatttatctttccatctatttgtacatttttttgtttgtttgtttttttggtaaacagtctctccccagtaagaatgcagttcttcttaatcacagaagttattcctttccttgtaatggccttctctgttctgtgtcttggcaaatatctgagcctaatagttgggtggtgcccttggcatagatgttatgtaaggaattgtcacctgcttttagagtcagtcatcccatgaaatcgaaggagtcagtaaggcgttatggaatcaggaggcttgtgtgacagctctgacgctgataccaattaatgacctgactggacctcagtttcctcatcagtggaatgaacacagttggcctagtgaccccagatgtctctcccaagctaacattctgtgattctcattctctgaaatgttaccacgaggaatgtttacttatacgttactttttaaaataagaaaaatggagaacagaaaatgagaactagagtttaattttaaaattttgaagtgtcatggatgaggctatcgtcatgtgtcatgttgctttagtccaatagttcttaattaacagtatgcattagaactaccagtgaacatttaaagtatatgcatatatgtgtgtgaacatatatgaatatatacacacataaatatgtttgtttatttatttatttacttatttatttattggagacagagtctcactctgttgcccaggctggagtgcagtggtgcgatcttggctcactgcaacctccacctcctgggttcaagcagttctcctgcctcaacctcccaagtagctgggattacaggcgcgtgccacaacacccagctaattttcgtattttaagtagagatggggtttcaccatgttggtcgggctggtctcaaactcctaacctcaggtgatccaac

SEQ ID NO: 71123 - DNA, 1630 bp, Homo sapiens
agggaaggttctgattatggcttgttggcaggatcccctgagaacatatcttgactgtgatctgagttaggaatattgaataatatgtcagaggttccagtcagatgaaagaagtaaatctataatcttcattagagtccttccttcctcagattccttattttggcctgtgggacttaaatggtaatgcttttagagtgaacctaatattagaaaatgcatcatcatgttttcctttgtgataattaccatccttacttccattacttctagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaggctttaaactcaaggggtttaaatggaattgaaggaatttgacagacttttgagctcaaatgtaaacaactggattttacctttaggaagagtgtatgtaggctgggcgcggtggctcacacctgtaatcccagcactttgggaggccaaggtgagtggatcacaaggtcaagagatcaagaccatcctggccaacatgatgaaaccccatctctactaaaaatacaaaaattagcccaacgtggtgtcatgtgcctgtagtcgcagctactcgggaggctgagacaggagaatcacttgaacccaggaggcagaggttgcagtgagccgagatagtgccactgcactccagcttgggggacagagtcagactccatctcaaaaaaaaaaaaaaaaaaaggaaaagtatatgtaggtgtaacttgcttcagagtaattgtaaaatgtggatttgataacaaaatattgtttgaataatctttctgagcttttgggaagtatgagacatattcaggtagtcgaggtcagggaaggttagggtgggggagttaccaaaccggttgatttgcggccctttcagatatgtctgtagggaatatttcataaggaatggttacttagggtactaccaaattttgataaatatctcttcatgctttggtttattatggggaaaataacttcacaaagaataaactgtttcctacttggttcttaatcttagattatcagagagaaaaggtcagtggttacagccaaggggaggattagtttagtccaccctgaataaaccagggtggacttaaccattaacgaaggtgagaattgaaaggcaaacctgatctgtctggtgcttcataggaaggctgagggcatttaaatgtcactgaagtttagctctaggcctacacaatggagtcttaggtaaatataactggccatctgtccaggttcactgagaggttaatttattattttttatatatatatatatatatatatatatattttttttttttttttttttttttttttttgagacggagtctcgctctgttgccaaggctggagtgcagtggcgcgatctcagctcactgcaagctccgtctcccgggttcatgccattttcctgcctcagcctcctgagtagctgggactacaggtgcccgccaccacaccccgctaattttttgtattttt

SEQ ID NO: 71124 - DNA, 1937 bp, Homo sapiens
aatgtttttctttgtacgtgaagtttttgctgtatttagaattattttcttaggatagattactggaatggatttatgggtcagagtatgaacaattctaaggttctagagccctttaaatggtgtgtactaattaataacttcataagctcaaagagttccctgtacttagtagtaagaaataataataggttttgggccaggtgcagtggctcctgcctgtaattccagtgttttgggaggctgaggcaggcagatcatgaggtcaagagatcaatactagcctggccaacatggtgaaaccccgtctctactaaaaatacaaaaattagctgggcgtggtggcatgcgcctgtagtcccaactacttgggaggctgaggcaggagaatcgcttgaacccgggaggtggaggttgcagtgagctgagatcacaccactgcactccagcctggtgacagagtgagactccgtcttaaaaaaaaaaaaaaaaaaacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcaggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtggaaaaaaaaaaaaaaaaaaagtgatctggctggacaaactgagccagtcccacacaaaatcttaaaaaaaaaaaaagaaaagaaataataataggtttttaaaaatcattatttgcctattggagaggtaaaaacagatttctttatcttaatttgtatcactttgattattaatgaggcacaatattttttcctgtatgttgtatttcctatgtgtaccttgctgggctcaggtggtcctcccaccttagccttccaagtagctgggactatctaaattgtagtcactgtgttgtatttcattatctgaattgcctgttcattttcctcatgggataataatactaggaagagccccggtgcggtggcttacgcctgtaatcccagtactttgggaggctaaggtgagtggatcacgaggtggggagatcgagaccatcctggccaacatggtaaaaccctgtctctactaagaatacaaaaattagctgggcatggtgacgcatgcttgtagtcctacctactagggaggctgaggtaggagaatcgcttgaacccgggaggtggaggttgcagtgagttgagatcacgccactgcactccagtctggtgacagagcgagaattcatctcaaaaaaaaaaaaaaaaaaaattagttggctgggcgtggcggctcacgactgtaatcccagcactttgtgaggccgaggcaagcggatcacaaggtcaggagatcaagaccatcctggctaacacggtgaaaccctgtctctactaaaaatacaacagggccgggcgcggtggctcacgcctgtactc

SEQ ID NO: 71125 - DNA, 1212 bp, Homo sapiens
tccccacctcgtgatccactcaccttagcctcccaaagtactgggattacaggcgtaagccaccgcaccggggctcttcctagtattattatcccatgaggaaaatgaacaggcaattcagataatgaaatacaacacagtgactacaatttagatagtcccagctacttggaaggctaaggtgggaggaccacctgagcccagcaaggtacacataggaaatacaacatacaggaaaaaatattgtgcctcattaataatcaaagtgatacaaattaagataaagaaatctgtttttacctctccaataggcaaataatgatttttaaaaacctattattatttcttttctttttttttttttaagattttgtgtgggactggctcagtttgtccagccagatcactttttttttttttttttttccaccggggcgttcctgagtttatttggggcacacccggacgagggccctgcacctagaagaaggtgttgggcctcttggtggtgaagcgtggcttgtgctgacggcgcaggacccggtggggcagcgggaacttgatcttggagtcgtggaactgcttgacagccggccggcggcacttgctggccgcgatctcctccaccttcatgatctgaatggagtgggctcgggcgcggtgccgggcacccatgtctcggtagcactgggtgacagcgcctgcggtggtcaggtcccggtattcccggtacatgttgtgggtgccgctccgggagtcatagcgcagccagatcctgaagttcttcacccgcaggggggacttctcaaacacctgcccacagtagacaatctcccctgaagacttcttcatcttctttaactgagatacaaagtaccagaagcgggacttggcgacgacatgattaggcgcaaagattcgcatgcggtagaggggcggcgtgtggcatttgggggtgggcaggcagcgacccactaccttgtactctcgtagcgtgcccgaggccttcatggcgtgctctccgcgttcgccgccacccgcaaaaggaagtttttttttttttttttttaagacggagtctcactctgtcaccaggctggagtgcagtggtgtgatctcagctcactgcaacctccacctcccgggttcaagcgattctcctgcctcagcctcccaagtagttgggactacaggcgcatgccaccacgccca

SEQ ID NO: 71126 - DNA, 1612 bp, Homo sapiens
agtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggtaggtgaggccggcgcctgtaggctggcggtttccttcctcttggtctttgtagagacagtttgcagaacagcggagaaaatgggtattgtatcgtttcttacagagtccgagtcttgaaatgtagatgacaatgtgttgagtggactgacagatccttgagaatattaagaaagtataactatgtaagaatgcttctctaggaattttcacaccatttaatcctcagaaatcctgagacgttggcaaaacacatggggtctccatgtttttacaagtagggaaagcaaggctcagaaagatcaagtggcgtgcccagctggacacagactattaaatggggcggcgacgacgaccccagggcttcctcactctctcaggcagtacaggacagtgattaaacgcgtcgaccacattgcctgggtttgaatcctgccgctgcttttgagtagctccttgagcttggacaagtttcttagcttttctgtacctgtttccctgtctgtaagttgggcctggtaatacttacttgtagagtggttgtgaagttgaaatgtaaatatatgtgaagcagtatagacatgttagctactattattacaattaagcagctatactttgttttttgttttttgttggttttttttgtttgtttgttttttgagacggagtctcattctgtcgcccaggctggagtgcagtggcacgatctgggctcactgcaaccttcgccccctgggttcaagcgattctcctgcctcagcctcctgagtagctgggattacaggcacctgccaccgcgcccgactaatttttgtatttttagtagagacagggtttcaccatcttggccaggctggtcttgaactcctgacctcatgatccacccgcctcggcctcccaaataagcagctatacttttgaatgttggcgtgatttatgtctaatgaataggcctcatgtcagtgtaactgtggaatctgtatgttccactgagttcaccc

SEQ ID NO: 71127 - DNA, 1214 bp, Homo sapiens
cagctagccttgaggccatgttttcagccagtgtgcggatttgccggggtcagactccaagcttgattgtgagttctagcctttgtcagaaatgcagcaagtcatgctaacttgcaagggagtcaacagagggcacgcggtgcctgcggggccgggacggaagccccgcccccggcgcagttcccgcctgttagcgggggagaagcaccttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggtaggagagagtaacgtatctttttaaacgggggatgagctcgttgagctcagcgtggtcacagcctgccttttaaagccagcgtggatgtgaccctccaaacgggacgcagcgctgggaaatgacgaaaaacgctcgtgggctagcgcatgtgttaatcgaagttgatgagacgttggacaaatttcacatctcgggaaacttgaaatttctaacgctttttatcttttaaaatagctttttaaaaatgtcctttttctcctatttccccttcctctttccctcccagttgtaaataacattttttagcagcaatgtaatctgctaaatgttagttgtttagggaagtcctgagaaaaggggatcaggaaatgcttatctttgtcatcaaggtggccctgtaatcttcctcttaattctctcaggggtaggggacccggaaaccccagggtctggaggagagcaaccaggaagctcttggggtgacttcgttttccttcaggtgtgtctttttagcccagagttaatagttgggtgaagggaaaggaagaagtcttccctttggctggtagcaaacgcagtagaaatccttccttagacctatgctactgaggagttatagccactgagggatttatagcctacagtgttagaaaaatgcttggaggctgggtgtatgtatgttttatttatgtatttaaaaaaaaaaaacagtcttgctctgtcacccagagtgcactggagtgcagtggcgtgatcttgtatcactgcaacctccacctcctgggttcaagcaattctcctgcctcagcctcccgagtagctgagattacaggtgcccgccactacacccagcttcacc

SEQ ID NO: 71128 - DNA, 1172 bp, Homo sapiens
taatcccttctttttggaggcattagtaatgtatctgcttttggcttgattaaagttgaggcctgaggaggactggaggattgctttgaagatgagggaagtgacagattctctggcgtacattaaaaggaagtaagggttgaggactaccaagatttattagagtcttagactgttagaactgcaaataaacgtagaaatttactggttgtagagtcgtgttgagctcctcctacttctaccaggtgtaaacacaaatctctttttttgctgtgtatctgttctttaatagtagcgtcaaaattctggtggtatagacttcagatttccggtcacttctcctgtttactcaccagcgcctgactattctaggcatcaccttcttgcccctatttacttttgcctggaccatttcatcagtctttaactggcctcccacttctgatctcccttctcttccagctcatattgccagtcatcttcctgattgctactcgctggccccagatctgcatccagaacgaaatgggagctccttagcttggtattcaatgccctccagggtctagccccaacctgcttttctggttatctcctgctctgctccctcacttactggaggctcccgggactatcattgcagctaaaatatttctccctacagttttcctcctcacttctattctttatttcaacacctgtcttctcttcctaccacaacccacttttccaactgcctacccgttcagaatacaagaccaaagttttccattcctttcctcctctgttcccacgacaatcccataagtctttatttttggaaaaggaggaatcctgccaatgataactttttggcttacatatcgaggtcagagagctagtcttattctttatgcctgtggtcccaggcatatgttagagcccagcagatacctaagcaaatatgcctgttaatgattataacatttatttgttgaatacctattatgtgttagactctaaatgttgttaatacttagtgattaaatccccacaacagtcctgtgaaggaggtgatattatccaggtttacagaagagaaaataaaagccttgagaatttaaggagcatgcccagattacaagctagttaagtggcagagtcaggactagaacccaggcctgtttgcctgc

SEQ ID NO: 71129 - DNA, 1051 bp, Homo sapiens
tcattcattacatgcttgctgaatggaacttcattcttctgtgcctacttgtactttctttaagagaacaatgaggctgggcttctaaaaaaaaatatacattttaatatcttccatatattgaaaaaaatttctttagaggcaaggtcttgctctaacccaggctggagtgcggtggcactatcatggctcgctgcagcctcaacccccctgggctcaagcaatcctcttgcctcagccgcctgagtatctgggaatacaggcatgtaccaccacacctggccaatttttaaattttttgtaagataaggtctttacaaaaggctttttgttggcttaggcttattttttaatacctagtgtgcattcagtaaatatgtattgagtgaatagatcgtggtagggccagaagagactcacttaaaggatttagctctaaggtatctggttttattgaagatgggctatcaggaaccaagctctaggttgttcagaagagattctaggcagcatattggaaagcagttcagaattaaaagctgtatgacagcaacattgtctgccttcagcattctatgcaggtgtgtccaggtcagttgggaacaaagtcacttcacatctatttagctagtatttactgagcacctgtgttgacatcgggctaggcactatctttgtaatctctaacgcaagtctgtagagcaatgtacttatttaaaaattcatttgtcaggctgggtgtggtggctcatgcctgtaatcccagcactttgagaggccgaggcgggtggatcacttgaggtcaggagtttgagactgacctggccaacatggtgaaaccccttccctactaaaaatacaaaaaattagccgggtgtgttggcgggcgcctgtaatcccagctactcaggaggctgaggcaggagaatcgcttgaacctgggaggtggaggttgcggtgagcggagatcctgccattgcactccagcctgggcaacaagagtgaaactccatctcaaaaaaaaaaaaaaaaagtaatatacaaacacttg

SEQ ID NO: 71130 - DNA, 2391 bp, Homo sapiens
gccgggccggggcggggctgtcttcccgcggagcgtgctgggggcgggtcgcgccgggccgggccgctagtgcgcatgggcgggcgtcctcggctctaactgccgccactttccacacgctgggagggccgttacctcagagatacccgtggccggcatgttggttgaaaaagcttcccggaagggagacgaagagaaaggagaggagcagctcgtgatcatccccggtagcgagtacgcggcgaagtaggcggcggcggagggagcgctgatgaagatggatgtgtcagtgagggccgcgggctgctccgacgacctcagctctggggaggccgacgtagacccaaagctcctggagctcaccgctgacgaggagaagtgccgcagcatccgcaggcagtaccggcagctcatgtactgcgtgcggcagaaccgggaggacatcgtgagctcggcgaacaactccttaaccgaggctctggaggaagccaacgtcctctttgatggcgtgagccgaaccagagaagcagccctcgacgcccggtttcttgttatggcttctgatttgggtaaagaaaaggcaaagcagttaaactcagatatgaacttctttaatcagttagcattttgtgactttctgtttctgttcgtgggtctgaattggatggaaggcgatcctgacaagttgagtgattgtgatgatagcatagctctttccttctggaaggcaatagaaaaggaagcaacatcctggatggtaaaagctgagacattccattttgtttttggttcattcaagctagaacgttctgcaccaaagccccgacttgaacaccagaaaaaagttcgcaagatggaagaaaatggcaacatgcctacaaagttgcagaagttggacctgagtagttatccagaagcgacagaaaaaaacgtagaaaggattttgggattgttgcaaacctactttcgaaagtatcctgatactcctgtgtcctattttgagtttgtgattgatccaaactctttttctcgtactgtggagaatatattttatgtttcttttattgtaagagatggttttgcaagaataaggcttgatgaagacaggctgccaatattagagccgatgaatgttaaccaaatgggtgagggaaatgattccagttgccatggcaggaaacagggagttatatctttgactttacaggagtggaaaaacattgtggcagcttttgaaatttctgaggctatgattacatactcctcatactaaagatttcttagtatagcatcctttttgtgttttttttctgaagttagatggagagtaaaatgtaaactgaagcacatattgtatctcttgtaaagtgaaaaagtattttcaagaacatcagacattgttttactgtgcagcatatttttcttagtaatttataaggtcatgatcttctgttattaaaacaaattcactggcatatttatgggaacgttttattgaatgccctttaagactattaataaaaacaagttttggataccaaattaagggatatttgataatttgcaaaacataataatttacgaaaatcagtgatgatgctctgtgatgcgttgctttctctgtcatagggaaccaagagaatcccagaaagggttcctaaccaggttgggcaaagagtgggtaaaaaacaaaagttaaaaaaaaaaacctgtctgtaaggcagtgaatatgcaacattaagactaaaaaagtcattgcaaggaagacttaggatttatgagtgagtatccatattctaaacaatttctgttattgtactcagcaaaagtagtgtctctgctgtagtagttgaggtatcagctaagggtgaaaggtgagtagaaacacgaagaaggaaaaggcattctaggcaagagaatagcaaggtcaaatgcatggaattgttagaagttaggcacgagaggaccattagatttatggaaaaactattatatttgataagctgggcaacaattgaataacttcatctattaatatcctgagaagatgtttttgtcaaactattatacattgaacacaagatcttgctatccagttgtagtttttatctactgaatttcttctctggcccctagtgtccctttgtggtctttgctagtacatagaatgtccttcacaatctacgctttttcatcatgtaacaactttgaatatttgtcccactttaattttgcatttctatctttttttttccccctcgagacagagtatcactcttgcccaggctggggtgcagtggtgcaatctcggcccactgcaacctctgcctgcggggttcaggcgattcttgtgcctcagcctcccaagtagccgggattacaggtgtgtgc

SEQ ID NO: 71131 - DNA, 1001 bp, Homo sapiens
aattttaaaaacaatgtttctttttttttttttttttgagacggagtcttgctctgtcacccaggctggagtgcagtgccatgatcttggctcactgcaatctccgcctcctgggttcaagcagttctcctgcctcagcctcccgaatagctgggactacaggtgcacgcctccacgcccggctaattttttttgtattttggtagagacggggtttcaccgtgttgcccaggctgattgtgaactcctgagctcaggcagccctcccgcttcggcctcccaaagtgctgggattacaggcatgagccacctcactcagtctcataatgtttcattctaaggtcaactgaatgcttcaattgcctgtgtcttgccaattggtaaattttacctacagtgcttaaaaatggtgaggttcattcagagcttttttggtaaaatctgtgcactggttgatacaatttgacttgaagcttgaaccaggagaagccaggttacatacagaatttcagtaaggaacggattgtaaacattggtgaagggaatatgtgacttttcagcatgaggatacattttctggtatttgttctagtaggtatgttggaggagggggattcctagaaccatggttttcatttagacagccagttattgtgttctgtcaccatctttgctaatttcatgcagataaaatgaggttgagataaaaaatgattgtatgttatttttccagcagaacatctaactggatttattagttaactcttaaaccaggaagtcatgctctttgagacccagtagggagtcacactagttacttgaagcataattgatcctttgatcgaatggctattattaccaaattgtttttcccccacagtgctttgtattgaaggaggaaccttggccataatgccagttgatgactactggctgtgtttaccagcctcttgtgctagaccttttgtgcagactgtcagagtggtgcagtcttgccccca

SEQ ID NO: 71132 - DNA, 1595 bp, Homo sapiens
tcctccttcacattgctccaccgcacccccttccacatcccaagaaccttcttcttccgctgaccccaagctctgcctttcaccccctacatctgatagtaggcaagagagaaatgtgcagtttgggctggtaagtttgggggcttttttttgttattaaagttaaggctttttgtttgtttgttttttaaaatgagatggagtctcactctgtgagactcccaggctggagtgcagtggcgcaatcttggctcactgcaacgtctgcctcccgggttcaagcgcttctcctgcctcagcctccggagtagctgagattacaggcacccgccactacacctggctaatttttgtatttttagtagagacagggttcaccccgttggccaggctgatctcaaactcctgacttcaagtgatcctcccgccttggcctcccgaagtgctgggattacaggcgtgagccactgtgcctggcctacttgattttttgaaaacattttattgtgcttgttaacaactttctcagtcattatctcttgttaacatagatttttattttagtaagcgataatattaaatatatcaccaaaatattgtatgaaacgaatatgaaatataattaatgtgtatcagaattatattagtggaatgaaatgattttttaaaaattaagtctaacacctaaattataaaagtctgttacttgctaagtatatggaaagtaaatattaaatatgggagacttcatgcatatgcaaattaaaggaatgagctttgcagagttgtgcctatttaaaatatcctacaaaagcagcaactttcacgtttaacttttcatgcaggtcagtatcaattgacagttttgttctgaatttttagatgttatgccccagccaaacagtatagaaatgtcttaaataaatatttggctggtcttttaaaattgttatattgagattaagctatgcccatatttaccaagcccctatctttaaaacctagtttaaaaattctaggaaaaaaaggctaatgattaaacctgatttagacctaagttggtttacttatgtagaggtactatacgaacacttcaaagtagttagcagtgaccgtctttggggttaataaactaagataaagcaagcagttcacaactttaaggaaggttgaatatttccatctgtatgctgtaattaaacagcatcttccctttgaaaattccttttgtttttctttaagaaaagattttcttacaaagctttttggacattgctgattttaagttaaattattttctcttctgttatttttctttaggcttatcaggagggcagacttcaaaagctactaaaaatgaacggccctgaagatcttcccaagtcctatgactatgaccttatcatcattggaggtggctcaggaggtctggcagctgctaaggcaaggctccttgtgttgtctgttgtctgttgtctgggtggtgattagaatattaacatccctgacagggttctctcctctctctgtggaatttatttgatccactcctgtgacattttgcacattaacttgggcaggacatggacatcgta

SEQ ID NO: 71133 - DNA, 2307 bp, Homo sapiens
aaagatgaagtggttataattccctaaggtatagcttgtgctgaatcagtaatgggtagaagctgcccaaatactgcagaccagtatgtagcatgaagcaatgctttactgaaagtaattgaggaataatacctgatgtattttactccagtggtggtgtgtttgaaagacgtgtagactcagtcctttcaaataacctttggaggtctagttgccaatattcaaagcttattctctgagaatgataaaagatattctgcaaaacaaacttctaactcttgtttccctccctaaaaatatatttggaaatatcatagatgttgtcaactttttcatgagcgcctcatgtgaaaattttaggaaatcttgtaatacagaagaaaaacttcttcagtattctgccttagaaaccaaattagattaaactttaaaatgatttttaaaatatcaccttataggatacaggttgcattaagggctgtagactatcagtaaacctgctttttcagctacttggcaacttgcttggaaatggccactttcttttttcaggttattgctgaatctgttattgtttgagtggaattatgtgagagaagtctaaggtttccagctgattctaacaattttactactctattctgcataattttaaaatctactctcagaactatctgaatatctgttaatttttatcctggagtttaactaatcatcatggtgtgtgaagtacccaggtattaattattcgttatgctttaagctctatagcttaaaaaaaaatcatggatttttaacagcccatttccaatctgtcatgttaacctttccaactcactttaataattttattttccaggaggcagcccaatatggcaagaaggtgatggtcctggactttgtcactcccacccctcttggaactagatggggtaagcttttaagatactctagaagtgatgttgccgaagtagttttcccctggcaataatctaactggttcctaaagcctaattaaaaaaatcaaaaactaagttaaagaaaaaacagccccaaaacatatatatcttttatttgagccaagttaaaatggatcaggttaaatgctaaaaatttaggttctttggcacagagtcaagaagtaagaaccctgtctacaagctatgatttaaaggtaaatatttgagtaatctagcatatataggggcttaataactgaaaatttaaacttttcatatgtggatttgttttaaatctacctcctacattcaacaagagttggaatcagataccctactgtatagcccttgctgcttctgagtcttgatgaattatatgttcataatatttactgaacatttattatgaaccaaggcaatgacgatatagcagtgaactcggcatattcaaagttcatgcccttgtgaagcttatattctaagtggggagacaaaagatacctaagaactttaggagttgtggtaagcggtattgaaaaaattaatatagtggcatagagaggaagtggataaaggagaatttaacttcgagaagattatcaaggaagacatctgaagaggtgacatttagaagaggccaaagaatgagaatgagccagctgtcaaaaggtgaggcagaaccttccaggcagcttctctttctttgaggatagcacatacaaaggccctgaggtaggtaaaagtccttcatggttgtggcatggataatgggagctggaggtggtagtgtgagatgagaccagagaggaaggcaggtgtcactattgagggctttgtaggccaagatgaggaatttggactaatcaaagcatataatttggactaaattggactaatcagagcatataaatgagcctttgaagactctaaggcaggggagccatgtgataatataagattttttaaagattacttggctgcttgcattagaaggaaccaagaagcaggaagtccagataaggcgatgtcacaatttctgattcatccattcagcagatatttaatgtgtcaatctgtgtcagacactgctcttggtactaggtatatcccttctgacctgtggagcatatactccagagtgacaactggtagtattctactcagaggacttactttgagctgtgaagtctgttgccatctttcactcttatgtcattttggtcacctgcctgtgttttgttctaatggaaacaagctgtcaccatattctttaagcttagggatactaaacctatttttagggagcaagggaagtcatgcatcctttaaaaaaccaagtgaatgctgt

SEQ ID NO: 71134 - DNA, 1090 bp, Homo sapiens
atgctccgaaaacttacattaacctacagttgggcaaaatcatctaacacaaagcctattttataataaagtgttgaatatctcatataatttactgaatactgaactgaaagtgaaacacagtatgggtgtatgggtatcaacataaagagaaaaatcgtaagtcgggtcgtctgtatagggttgtgtacatagtaagatttcaatttctggcatctttatcagcagtcagttaattttgtatctttgaagtatacggaaattgtggaaatctgcccctctttttgttttgttttaggatgatgttaccgtgtttggtatgtaagggtctctgaacttatggatgttgtaagagttaggaataaactttattactgaccacattaagcaaatataatacaatatttcttagagttgtaataattgttgactttgttctttgaatgtttgtaaggcttggaaagcaggttataaactgatttctcaatgttgttgtaggtctcggaggaacatgtgtgaatgtgggttgcatacctaaaaaactgatgcatcaagcagctttgttaggacaagccctgcaagactctcgaaattatggatggaaagtcgaggagacaggtatgagagggaaaagctactcttctgtttgtgcttttgggggtttgagctgcaatttttgtgatgcgtcgtccattttcatgaagatagcaaatagcctagttgtttttattgtttacatttttgatggatataatcactggagttatcctttgtcaagtatttacatagttgttatggtaacaacagatactgcatttggactatggtatttctgtaatataaaattagagttcttttgaatatattgtcatgtagtatttgtgagaaatcatacaatgtttataatttgtaaggaagtactaattgcatttgctttctttcatgttgcatttttctccctccaaagaagtctgtttcatgagctgatgtttgtggggggtgggggttgtttgttcaggagggggtggttaggctttgttggattaaaactatttagagtaccctagaaaccctagatgagtttaagaga

SEQ ID NO: 71135 - DNA, 1858 bp, Homo sapiens
cctgtctctacaaagaataattagtcgggcctggaagccctctcctatagtcccagcttctcaggaggctgaagcagggggataatttgagcccaggagttcaaggctgcagtgagctgtgattgattgcaccactgcactccagcctgggcaacagagtgagaccctgtctctaaagaagagattattgaggctgggtgcaatgactcatgcctgtaatcccagcactttgggaggctgaagtcggcagagcacttgaggtcgggagtttgagaccagcctggccaacatggcaaaactgcgtctctactaaaaatataaacaattagctgggcatgatggcccacacttgtagtcccagctactcttgaggctgaggcacgagaatagcttgaaccctgggttgaggggtacggaggttgcagtgagcccagattgagccactgcattccagtctgggcagtctgggcaaccaaagggttgatttttatcctttgaaatttaatattactttagtgtcctgacttaaaggattaatttaattatgacagaatcaaaaagaataaaaaagttttctctttgataagatatgggagtttggaggaaatgtgataagactcttaaaatcctgtctaaatgaatagtcagtgaattttttccgtaaaaggccatatggtaaatattttaggattcttggggcatagggtctctagtagctacttaactctgcttatgtagtgtgaaagtagcactagaaaatatcgaaataaataagcatggctgtattttaataaagctttatttacaaaaagctgatgggctggattggcccatggtgcagtttgccagcccctgacataaacactgttactagtgtagtaactccatactcggctacatcagaatctcttggattttcttacaaacacagaatcctaagccttaatatatcccagaaatcagtaaaattcaagttcgtttctagataaagaaggaaaaagtttgtgtattgttattttagtttaaaattgtcaggggatctgtcttgtattatttaattgtattagtcttataagagaatacttgaagatgaaaaagtggcatatgtgctcaaaatggaggatttgccctttcagattgccttttagagctctgctccctgtatttcacttgagtggttattgagaaatgatctttgccagcagttgaaaagccaaacaagattttgttttattttcttatacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggtaattgtgtgacatcctgactagctttttttttttcttttttctctttttaaaagctttggttagaaaatgttaaagtattataataaaagtaatagccactgtgacccagactatccagtttggtgattttgctatcatatcatcctatggggccttgtgtggaggtatggtaaagtgtaagtatgctggaccagaccgcctggttttgaggcttggctccagcacttactaacattgtgactttgagtaagtctgttaactactcagtcttaatttatcctttttactatattattgtcctcattatgaggatgaaatgagacaatgtagtgaatggcctttgttaactatgaagtttacaattctgaggaatgattacttaataaggttttcatattggttcctttgtaggcaacaaataataaaggcaaagaaaaaatttattcagcagagagatttctcattg

SEQ ID NO: 71136 - DNA, 1088 bp, Homo sapiens
ttacttgggcatccctggtgacaaagaatactgcatcagcaggtaaaggaaaaaagcagggtggaaaagaaaaacccattgtggatattgctttcgcatttttcttcaaacccactgcgtcaatttcttgggcttcagacagatttctttgccacattgtgccctctctgggggcaggggtttgggagaaagagaaaaaggaaaaatgattttaaaggagaacattttaaatattgaaaacttcaaacattggtcatcttgctacacagagtatcactaacatactagtatagatttacatttgtattcgaaatttatttatgcatgtatgagtatgaaagtatgtaataaaaccaaatggatattcacaaacattttgtaaaataggtatgatacatatatacatttagattttgtaaaatgaggatcatgtattaccctttaacacttgcagagtggctgctaaaagaattagaggctgtcaggccatttagatttatcagaatctagaccctactcaatgctgtttgaatggttgcagtgtcagtgtagaaggacctcctgaaacaagtcaagcaaggagatgttttgctgtgtggtttatttttgcccgtcaaatggtaacactgctgacattgttcaggagctttcaattatgaagtcattaagacagagtgttggtaaatgtgtcttcttggatgctttttgctcaggagtttctgattgtgttataaattactctactccttcaggctctttttggtatatgcttttatcctttctcacatggtgggagagggagaggcaggtctctggggccttttttatgaggacagtagccccattcatgagtgctctgccctcatggcctaatcacctcccaaaagcccaacccctaatatcattgccttggggtttaggatgttaatgtgtgcattttggggatacataaacattcagacaatagcaggctcccttccaatattttttaaaaactcattctctaacatgcttttatgatctctgtgtccctagctcaactagaagacttttgtcaggttctactccttatagttggcttttatatt

SEQ ID NO: 71137 - DNA, 2504 bp, Homo sapiens
tcagctgaggacaagcaacacaggtttttccacctcagagctgagtggtggcatgaggatggaggttagggtttgcaaatctataatttgttccaaacagttcaaaatcatttagtgtgaagatgaattggactaactgactaatatcagaagttacacagtttgctgtgtttagctatgggtagcttgagctactcccaaagcaactgagtggcaagaaagggtatctaagaattataaaaacttctcatgtattatgtgtgtagctagtagaatgtttatcatcttgaaagtatgttcttgtcaaagtaaaaatgtgtacttggatttagtaattatttatataggaactttctttttcttctttcttccttttttttttttttcccccagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagtaagtgggtttgcctgtaggtttcttgattctacattcacagtaaaaggcaaaaagagagttgagttggtggtagaagcatcctttcagcattataaaccatcaggaatgctgattcccctactgttgtatactggtatataaacttgtacctccctaccatctaaacacctatatagctttgttcttatttgtagattaataatctcttcctttgtcaactttctaaattttggttttcttctcttctgtttaatgctttcctttatgcattcctttgtcatctttggtctcttaatactttgtttcttcatatgtaccagagatttaaataagagttcaacactaggccccacctgcactccctggctccccacaggacatttccccttggtatatgataacataaacactacataaacactacatacttctggcatccctgaaagtgattatctcatttatttatgtgtgctaacctttttcgctcttttaatcttttgaaaggagctaatactatgccaagtcacacctgggatttgttaccattatcacaaatgttttcatatatgagtgacaaaattgaacacttagtgtgtgtctcagactaatagataattttctctagtgcagggaaaatggtgggactattttgttaaagttaaggaattatagttgtcttttttttttttttcatctctcagtgggttgacttgagttgtgtatgtgactatggatctcctaatgctgatagataagaatatgaactttgggatcagaatgacctgaattcagataatattctgccagtttcttgctctatgactttggaagagttacctctctgaacccgtttcttctgtaaaatgaggttgaaaatagcatctaacaattcttgtgaggattgcattagccaacacttataaagtaattagaaaagtacctggtagagagtaagtttaaagtgaatcatctcataatattgttatgaagattaaggcacaaatttcctggaagctgtcagtgcttgattactgtagctgttttttatttttaccttttttttttttttttttttttttgagacggagttttgctttgtcacccaggctggagtgcagtagcccaatctcagctgactgcaacctctgcctcccaagttcaagcgattctggtgcctcagcctcctgagtaactggggccacaggtgcgtgccaccacacccggctaatttttatattttcagtagagagggctttcaccatgttggccaggctggtcttgaactcctgacctcaagtggtcctcccagtgcagtgtcccaaagtgctgagattacaggcctgagccactgcgcctggcctgtagctgttttttagagtagaggtatatatgctatatttgcattagagctatgattcataaacaacagttgtatgtatatgctgtactgatagaaagtaacatcttcctatatacaattttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcggtgtttgtgtccctgattacttgagattagggagtggtgatgactcttaacgagcatgctgccttcaagcatctgtttaacaaagcacatcttgcactgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctact

SEQ ID NO: 71138 - DNA, 1121 bp, Homo sapiens
agtttcccaggtgggtttcgttttttttttttttttgagatggagtcttgctctgtcacctaggttggagtgcagtggcgtgatcttggctcactgcaagctccgcctcccgggttcacgccattcttctgcctcagcctcccaagtagctgggactacaggcgcccgccaccacgcccggctaatttttgtatttttagtagagacggggtttcactatgttggtcaggctggtctcgatctcctgacctcatgatcctcccgcctcggcctcccaaagtgctgggattacaggcgtgagccaccgcacccgaccccaggtgggtttctaagtcattatacctagtctgtaggttgttgttgacatctatttgtagtaggttggtatatttattctcctctgccatcactcaagtatcagggcttgctcatttctttctgcatccttaacaactgaaaacaccccctggttctgataaacacccacatctccttgcccactccgatttttaagactttgtaactgttacccatatcactatggacctgctgtaatgtaatctatcctttgttgtcaatgaaagctgagcatctgtagtcaaaagagaatctctgaatttgggcaacagttgccctccatgggattaatgattctgggtgaatcacaagatagaaacctgggaaaagcagtaagtcattggtttgattttagggatggtagtgtgctttctgtagcttgcttttcccccccatttttctctgaattttattgtttgagaactctttcaaagaaagcccctctagcagacaacattgagcagcgaaaaagaaggaaataatcatttatcatcctaataatgttaagtgagggagatgggacataaaagacttttcaagcacgattttatattttaactttgggttaaccagatggaaggggaaggtagagaatccaacttgataaatgtctttatttcacagtaaaactttatcactcttacaggttgaacaaattgaagcagggacaccaggccgactcagagtagtagctcagtccaccaatagtgaggaaatcattgaaggagaatataatacggtaaggaatgggcccaggttaatac

SEQ ID NO: 71139 - DNA, 1050 bp, Homo sapiens
ccatctcaaaaaaaaaaaaaaaaagttgttttggtaaacggatggcttcagattttttccactgtaacttaaagtattattagtcaaatggctatacaaaggcaacagaatttttaaatgagccagaatttctgtcccgtgttctttcctttcatctccccacgcaaccacttaaaaaataatttagttacagactatgatgtcattgtctttaaacttggataggtttattaaggcattatgaattctctttttcctaatcagaagtggaaaataatttctactatatcatatatgttcaaaggatttttttctgaagattttaatttatttaaactcttgcattactttcttactgaaatatttatttccaagtttgaaaaatgaaatcagattagcttaataagcagagaaaaatatgattaggtaataaatgcaaagcctttttgttattagtcactaatatattaataatttttcaggtgatgctggcaataggaagagatgcttgcacaagaaaaattggcttagaaaccgtaggggtgaagataaatgaaaagtaagaaaaaaatctttattatgtcatatttgtgggattttttttttttttttttttttgagatggagtttctctcttgtctcccaggctggagtacaatggcacgatctcggctcactgcaacctccgtcccctgggatcaagccattctcctgcctcagcctcccatgtagctgggattacaggcatgcaccaccacacctggctaatttttgtatttttagtagagatggggtttcgccatgttggtcaggctggtgtcgaactcctgacctcaggtgatccacctgccttggcctcccaaagtgctgggattacatgtgtgagccactgtgcctggcccattatgtcatatttaatactatttcagttatttacagcattggtcaattatagaattttagttttttgttggtatgtttgtttttttgagacagagtctcgctctgtcacccaggctggagtgcagtagtgcaatctcatgtcactgc

SEQ ID NO: 71140 - DNA, 1056 bp, Homo sapiens
ttaaacctaatttttaccatagttgagctcttcaactatgaagaaatgaaacttttcttccagtgccattcacattagtgtttcctgtttgttttcttttatccattttgaggggagttataatttagaatcctcactcttaaccactgtgttggagttcttccattctcagatttcttagagttttcttatttctttgattttcagaaccgtggacagaattgtcattatctgataagatttttgttcctttgagctgttttgttttatttttaacacattagaacattgccctcagctagagtcacaattttgggcttccctgaaaaaacggaagattttgttctccttaattaataatggtaattaatgatgatttttaactgaataaaattgcaggactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaaggtgagtgttgtgcttgttgcccattagatactgttgtcagtaatactcccagttccttatttagggggcagttgggaagtttcgcagatcttgaataatttagttattttggtgatggcatcctagatgtcctttattagttgtattccagacaagatattattaaggctgctgtacattgtgactttattatgaagatcgacactccgccgggcacagtggctcatgcctgtaatcccaatactttgggaggctgaggcaggcagatcaccaggtcaggagttcaagaccagcctggccaacatggcgaaaccccatctctactaaaaatacaaaaattagctgggcatggtggcgcatgcctgtaatcccagctactcaggaggctgaggcaggagaattgcttgaacggggaactgggaggcagaggttgcagtgagccaagattgtgccactctactcctgccatggctacagagcgagactccatctaaaaaaaa

SEQ ID NO: 71141 - DNA, 1060 bp, Homo sapiens
atcgtactatatatctatatgttaaattataatatctataatcttattatagatttctaaaggtgggattattgggccaaaaggataaaatgttttatggctgttaatattacctaattgatgttttaaagaaatcttttaattttttatcactgataatccaaaactatcagatttgggtacaccagtattatttttggctgctttattaaggggaaaaaagtgtgtcattgttgataacatcagttggttgatggatggagaagctgcatgaatctttttctcatagtcttaccagacttcacacttctatccactaaacttttcaaataagttaatggttctcaatgtagtagattaattaattaatatctcggattgagacttcacatactttggtagaaatttattactcttatatcctttgtcaattttgacttttttgaatacctttttttttaagttataactttgcctattataactccttacctccatttttaaacagtgtgactatgaaaatgttccaaccactgtatttactcctttggaatatggtgcttgtggcctttctgaggagaaagctgtggagaagtttggggaagaaaatattgaggtaagttcttttcctcttttctcctatgttatatcactacttttttttcttcagaatttaaaatatatagaagacttaaaaaatagtacaaagcattttcatatacccgttatccagattcatatattactaacattgtgccaatttattttatacacttttagtagtctctcattctgtgtgtgtgtgtgtgtgtttctgtgaatcatttgagagtaagttgaattctcctttacccctaaatactttattgtgtatttctatgaacgagggcattttcttatatagccgtagtgtagttaccactttcaggaaatttggtattggtgtaatatttttatctgatttaattttcattttctaattctgtcagttgacccaatcgtatttccttttactttttaaaatcacatttattgatttctctgggttaattataggaaa

SEQ ID NO: 71142 - DNA, 1411 bp, Homo sapiens
aggaaatgtcttttggaagcatttagcaagagaactagataattaccttaattgatcctggcaccttatttgtttcttgcccaagttgtcattcacagtggataacaagatagtattgagtttgggtgtgtgtgtgttttcaatgtatgacagcaggtaattaaatggcttatttctgtcattcccttgctcttttttgttattagttagggtgtactattttgaggtagagatatacataattaagggatgagcttatagcaaaagtgcctgacagcaaggagttgaaagtcatttaccttttgaccagattcctatttattccatgaattttattatttaatgaaagtctacttattaaagagtctctactgtctttcaccatatatgtttgacagacttaatgtttaaaataatgggtctaaattttgcttttgtatcttcttaggtttaccatagttacttttggccattggaatggacgattccgtcaagagataacaacaaatgttatgcaaaaataatctgtaatactaaagacaatgtaagtttaattctcaatcctttccagtaattttatttagttgttgttttttgttgttgttttttttttagatggagtcttgctctgttgcccaggctggagtgcagtggcgctatctctgctcactgcaacctccgcctcccgggttcaagtgattctcctgcctcagcctcccaactaactgggattacagacttgcgccaccacactggctaatttttgtagacgggggtttcaccatgttggccaggctggtcttgaacacctgacctcgtaatctgcctgtctcggcctcccaaggtgctggaatgtacaggcgtgagccaccatacccggctttagtttttaatatatagcttagttggtcacatggtgcagatggcattccttcagtatttcgcgtgccagttgtctcagctgatagatatcagcagctggcaaggaccttggctgcactgcctgctgccccctcatcttcactggcacagggccctacacttagtcaacaggcagccaaaacttactgagtgaaggaaccaaaggcacaacttgagaactgtctatgtttgtgtttatagaagaggaacaataaagtcatcgactatctaaatataatgaataacaaaaaagaacaggagcaatgcacgtttgatcctcagcagctggcactactaagaaagagctcttaattgagttctaagatttcattgcctgatgctacatgtaatgctagtctggtgttattacgtgtaaatctaatgtattttaagtgctttttagtagtcctcccacagatatactttattcataccataaacccccaactgtccaggtgaataagagtacaatatgcaatatattacagtc

SEQ ID NO: 71143 - DNA, 1008 bp, Homo sapiens
ggtcattttctttttttgagatggagtctcgctctgtcgtctaggctggagtgcagtggcacgatctcggctcactgcaagctctgcctcctgggttcacgccattctcctgcctcagcctctcaagtagctggaactacaggcacccgccaccacgcccggctaattttttgtatttttagtagagacggggtttcaccgtgttaaccaggatggtctcgacctcctgacctcgtgatccacctgcctcggcctcccaaagtgctgggattacaggcgtgagccactgcgcccggccagtctctggtcatttttgagttggatttttaagaaacagactggagaaatgctctaagctgtgtaggaagaggaggggagaaaaatcagcttaattgcattattgtatttttttttgccttaggaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtgggtcatctacacttatacagtttaaaatgtttaaaatgtgccacatagaagcacaccacccagcttatacatggcagatgtaggaccctgagtttgatgatgattcctcaaaagagggctttgtctctaaaaattagtttttgtctttcaatactgattgctcatggtatgaactggaggcttccgtcatgtcgttaagtggtaaaaattatgagagtgatttatagagctgtgccttaaatattttatttatcatatcttctaaattattttcatggcaatcagttaataatggaagagcttcaatcttagttattccacagctatcttgaggctaattgatactgtctgcctcttcagcttatggtatcagtgaatgagatttgaaaatgatgctttcaaaagatcaaatgacagtagaactagaaattgaccaatctaggcctctg

SEQ ID NO: 71144 - DNA, 1452 bp, Homo sapiens
gctcaagcaatcctcccgccttggcttcccaaagtgctgggattgcaggcgtgagccacggtgcctggccagttttttatttagactgatcaacgatggcagtttggcttcctccatctttttaacataagaacaacatcaatatgagaaaaaacagataagagctcattttggtggatttagttttgtatccacatctcctacaagttctatttctaaatcagtttctgagaaatagaacccaggcttgcaaattgataagcctggaatttgtttaaatgtattctttggctctttatttttttcctcattataaaaatggaaaagaaagcatgtttgaattgcccttaatacccctttctaacacagttatttttattatcatgtattgtttccccgtcctcatctgtactcctacattttttttaaacaaaggaattttattgcctttccaaaaaagttgtactagtttataatgtcaccagcattgcatataagagtgctaattaaaatgttgcaaaattcagtgtcaatgttttttctataatgagtataaaaaggataactattggccaggcacagtggctcatgcctgtaatctaagcactttgggaggccgaggcaggtgggtcacctgaggtcaggagtttgagacaagcctggtcaacgtggtgaaaccctgtctctactaaaaatccaaaaattatccgagcatggtggcaggtgcctgtaatcccacctactcgggaggctgaggcaggagaatcgcttgaacctaggaggcagaggttgcagtgagccaagattgtgccgctgcactccagcctgggtgacagagtgagactgtctcaaaaataaaaataataataaaataacgatttcaaggattttagcatatctttgctaacaatgatgagcctctttcttcttataatgatttttttttttggatatgaattatccatattttctaatgcatttgtattttaaaactttttaagatactggccattagtatttggtctggatttttttgagaagtaaaggctttgtcaccctctgaggctaaaacagactaaagacttttctcagtattgttcctcccttacacaaaactgttttcccccttattcacaagtatttttgtttttacgtacaggcaatcttgagcagtagcaagtaaagattgtctaaaactgtcaagtccacaaccatcaaatgtttgcaaggatatgaaacaaggagaacttgttagtcactgcaaatgagagtataggttggttcaggtaccttgaaaatctagtcaagccaaagtttcacctgccctctgactcagcagttgtactccagctctgtgtgcaaggagatgtgctggaatgtcacagcatcgtattgcaaagagcatattggcaacagcttggatggccagcagaaggagcccaaatgtgtgat

SEQ ID NO: 71145 - DNA, 2130 bp, Homo sapiens
gttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactgaatgatggtcttgggagtctttgcaagagtattgagtagatctctgatattgtgttgaaaagctagctgctgagtaggctccaatgatgctatgctgatttaagtatagaagaactaatcagttcattgccatttcccatcttctggcagtat

SEQ ID NO: 71146 - DNA, 1049 bp, Homo sapiens
tcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccaggtagggggcgcgttagcgtggttttgttggatattttcttctctctcgcgctctagctcgctccgcctgatttctgcctcttccaaccctacctctccgccttcggcctcttcggggctcctggctgcccagagctcctggctgcccagatctacccgggtcaccgcgtcgggatggggaggagaagggaaggtgtgcttcgccctcttcttcctaccggctccgggctggaggatgggaccaggaggggcggtagtttttttttttttttttttcttcttctttttttctttgtgtcccttgtctgtctgtctgcgaggtagcagggaaacggagaggtgtgggaagcaaccgggggtgaggggctggtttgaggagaacgaaactccctccctgctgctgccgaggtcggaggatgaaagagttacccggagccggctg

SEQ ID NO: 71147 - DNA, 1027 bp, Homo sapiens
ccgagcaacgggaatcccccgggcggcgtgggaatgaaccccattcctccggtcccttgtggctcaggcaaagttccacgtccgaaatctggactgggggagggacgaggctcgtcgcttcctaggggtgcgagggaaagtttgggttctggagagggaggggcgccctcgagcgcggcggccgggggtgagcagctcggctgcgaagcccaacaggtagaacgttccgagaagccttccgggtaacgcgggtctccccgccaagccgtggctcccctgctcccttttaccctcccttagcagccccctgccgggccacgttggctcagaaatccattttctacgcctccgagttgcctttctcagcgtagtcacagcaataatttgcttttctaattgcaaggaggagggaggtggaaacgcatttccttccagggaagtggggttggtgtttttcatttttgcctcccgccttctcctttcactgtgtatctaacactttaaacagacgcagtcccgaattcatcaagcctgcgtttgggtcgatggcagaggaataaagctgttctttccatcaaacaggcagggctgcaggctgcagattccttgacagcgcagggacagacggcccctttgccccactcggtctggagcagttgttaaggcagccacactgccaaggatatggtccgactctaccacatgtaacctcaggacgtccgagccagccctgttaaagatggcttttgtttgcagctgggtatttttagtttaatgtcagcaaactacagcggtgtttgtctcctcacccaaacctgcggttgtgaaacttataaaggaatttaaaaatggacctggcttgcattccggcaggcaggccttggttgcagtgggcagggccagacagccaggggtatctcagagtgccaagctccagggcccaccggagaccgggccagactcaccccagagcgccaggggactggtggtgtacagatacactcgggttcaaacagtttaaacaagg

SEQ ID NO: 71148 - DNA, 1096 bp, Homo sapiens
ccaatgcccctccttgagaaacagctcaaaactctatgtgtaaacagcatctggcgtagtacttggctgcatcccatgacttgggcaagtgcctggcaagtgtaggggcttaataattgattgaatgagtgactgagtgaaagtcgcagacaagagatttggtcccctcatttgccaagtgaaggtagtaatgttacctcttttatgggtggcggtggtaaagattaaatgagaagttagatgtgaaaatgcattgggaatggatgtaaacctatgtaacaaaactgcatgtcctgcacatgtatcctggaacttaaaattaaataaaattaaattttaagaaaagaaaaaatgaatgtaaaagcagtataaacatgttgttgttatgataaattacctgtgtggttcctcgttcaaggatgtgaatctccatgtcaacaagatgctgttctatttaattctgtttgaaacctgagcaagtttttatccttttaacatgtgcgtcctacactgtaagatttactgaaaggatctgacttctataagtgtgaggctcctgtgaatatcttctctctgtatgtgctcaccctctgtctgccgtactaacaggcatacccgctgccaaggccaaaactgtgtagcaatttgcaaagcagagtttatatttggtcagaaatcagccttgtgtttttttgctgaatgcagtgaccgcagcatttcctcccaattatgcacttaattactcctcaggttcccattagctttaactagtgacacttgggaaataacaggcactggtcaatgccatttctgaagctgaactccgaggaggatgaaaagcagtcatttcagaaaaataacagtggtagcatggcagcctgtatgtgagcagttgttgggtgggttagcatggctcattgcacaggacagcatcaattggccctatgtctccacattgggcttgttctgtgctgaggaggactttaagggctcttcctgtataggggtcagtccttcccactgcttaactgcaggtgtcatggagcttgctctgtggctggcatttgtagctggggcacagacccatttcctccct

SEQ ID NO: 71149 - DNA, 1010 bp, Homo sapiens
actgggtaatttataaaggaaagaggtttaattgactcacagttctgcatggctggggaggcctcaggaaacttaaaatcatggcagaaggcacctcttcacagggcagcaggagagagaatgtgtgcaagcaggggaaataccagacactgataaagccatcagatctcatgagactcactcactatcatgagaacagcatgggggaaaccacccccatgatccaactaactccacttggtcctgcccttgacacatggggattattgcaattcaaggtgagatttggatggggacacagtcaaaccatatcaaacccttatttgattcaacatttttctgatgctttatgaaaaaaaccagtaacaacaatgaccacttaccaaatacttgctctgtatcaaacagtatgtcagctgctgtatttggattatccatcctatttaatccccaccacaaccttgtgagatgcacatttaccaatcccattatacaggtgaggaaactgaggcttagagaggtgaaggagcctgcctaatcggaaagctggaacaggatcctggctcaggtctaactgacagcaaacactgtactcttcacctcactagtatgcccatctccatgttcttggtttcagataattaggtcaagaagtaattatttcataaaggccttaagctcagctgtaaactctgtaagtgggacattcaatgatagccccttctcttcttaccctacacgctatccctggtgagctcatcctctcttggggcctggggtatcatctgtgtttagatgacgctcatgtctttcttcaacttggatgtgaccttgggtcgaagtctagttcatgtattacctcttgtgttaccatccatcccctcttggtcagaatgaggggatagatgtccttcctgtcatccctgtggtactttgtgtgtgtacatctctaatattactcattctgatacattgactccttcagggaaggggccatgtcttgtttagca

SEQ ID NO: 71150 - DNA, 1197 bp, Homo sapiens
gtacaggcgtgagccattgcgcccgccccttccattttcttaaggggatgttgtctttcctgggttttagctataccctttgggaataatattgattatcttaaggctcaacatgttaaatacaagatattggctgcaaagttttatacacacacacacacacacacacccctctaaagtcatttcaggcctctaaggtatcttcagagtcttctagttaatcagtcgctatctgaagcttgattgtgctattgagatcttgacacagtctgccatgtagcaagagcaactgttactagctccattctacagatgaggcaatggagactcagaaggatttagggaattgcttaaattttgtttcaaatggttctaataccaacgtttagctgcaaagtctggcccaaggaacattcattctattagggtggatgtaaacacacatacttcactgtcttatggggccagatgcgattgctgttacaaagagagacaaactgtgaaggaaagggagaggagggtgattgattttggtggtggtggtgatggtggtggttgtggtggtggtggtggaaggaaaccttccagggaaagttgaggttggcaccgggctctgaaggatgagtagaaatttgctggcggaatctgggaagggagaggaaagacattccaggtgaggacgcctgccagagcagggagtggggcagtgaggagagtgatgtctgggaatacgggagcccaggggtggagaggtgaacctggatggctctgaatgctctaaagtttgagttttattcttggtaccagggagccacagaaggtttagtgtctcctgtttttcagatgatgaaatttaagctgaatttaaactctcttgtttcattagaaaggcagtagtttcaaactcactttctcaaaatgaactcggggccatttggaaatcgtttctattatcatcatttaatgggaggtaagattattcatgaacgactaaagtgcaaagtaagaaagagcttaaaggcactctgtagtgggatttgaaactcctctgttttgcattgctcgggccaaaattataggccatggaggttaaatttcagtctctcagttgctaatggtgccctagcttcaccctcagagggctctggaagcagtggcaggagaaagggaaagtgtgtaaatagtcgcagggaagag

SEQ ID NO: 71151 - DNA, 1819 bp, Homo sapiens
ggttcctgggaacaggcatccttggcttgagatcacaaatgggacagccccatcatgacgattcacgatcacattaacatactcagtgctctgggaagtcctgccattaagaaccccagttaacccagaatttcttaaacttacacaaccacagaatcttttttggggactggagaggtaccacttcatttattcattaaatagttactgagcacctaccctgtgcagatgctattcacacctgagatatggaggtgacaaggcagacctggcaaacttacaatgttctcatctataaaatgggtatacaggagtgtctaccttgcagggttatggtgaggtctacatttaatgaactaatgcagggtaagtgtttggcacagcccagggacattgtaagtggtcagtgatacatatgtatgattgttatcaccctagtggaggatcagatattaaacaattaaacaggtacctatttagtaacaatggcgttaagttatacaaaagagaaggacagggtgtcaagagagcacatagcaaggaaacctaatgaatgttggcaggtgggatggcggtagtggtcacagaaggctctctcctgagcaagccatgctgaagctaagacatgaaggatgtggggattgttggaaaagagtgggaagggagtgaggcctccttgccttgggaatcatggcccgaatgtcaggggcttacacacacgggtgccgtctggggagttaaattctctggactgtctatttcagaattagggaggtaggggcaggctctagtaggctgtggggtccagaaatgaatgtctttaaaacttaccccagaaatttggagcacccttgggaatattttttggaattgctgctccaggacagcgggcctcagaggttcatgtgcttagaaatcacctgagtctcactcaaaatgcagccgtggggcctgggaatctatttaacagacacatcctgaggcgattctgctgcaggaggttccccgaccttgctttgagaaacacatctctggaagattgactcttataaaaaatcgggaacacgaaggcacgacagcaaatgattccagcagagaatatacaggggcacctctagagactttgtatttgatcttagaaagtacacagtgggcaagaagagtggtatgcaaccccatgtcaggagggccacagctgcagggagcggggctcggaggagctgcagatcctaagaaggatccacgacctttgggaacctcgctgtttctggccttctgctcaccgcagagggtgaactggccatctgacacccagctccaacttcagggttgttcaatgtctgtgtgcagttgtgacaatggcagaaacaatcggtttagactttctctgcagaaggtagactgactcgggcacttctctatgttccctgacattgccagtcttaggaattggtcgtggggagccttgaattcaagcccaaagcaactttaacattcataaccacaacgcatctgtaatcagcgggacttatcatgagttcttgagctgcaaatggaaacggtggaaactgaacagacctcctaccacagacttcctgctgatccacctgcctcctcccttcagggccccttgggttgtaatcactgatgcaccattgttaggcggcagggtgatttaaggtgaattgggcctttgcacggcctgcttggttaaaagctggagcataagtcatcgcaccattctgtgtgcgtgtgtgtgtgggcatgtgtgtgcatgtgtgcacgtgtgtgcctgtgtgtgcctgtgtgtgtgtgccca

SEQ ID NO: 71152 - DNA, 1054 bp, Homo sapiens
tcaccagaactgacatttaaaaaaagtcagcgtggcacgttttagtatgtgtggcagatctaaagagacaatattttgatctcaggagtgtttattcttgaaccattttcagaactctaagatttgagaaataataaaatattgaccatccttcaaagagaaaaacacagggcgatctttggcatagcctgtcattttgctcacatttcacttctctctctccaacttcagagcccctgctgtggaacaggtgctgtgctgggtggcaggggaggtctctggcttttttttttttgatctccgtcttaacatctagcctactggaggaagtgtatttaatcatccacttatctgttaacaattatctctgagggcccgtcacattcagagaagattctaggttctctacaagtatcctctcactgtgtacatactaaatcaacatcctgctggatttcccccagacatctcccttcatcaccattggagagtatcctctaattgccagccctattcaccatactcatctcatttgatctggagttttctgagagtgaccgggggtgggatggacaggataatttagcaagagtgtataagtaaaatctatataataaaagttatctccctgtgccccccatgatctattctttatgtagcagtctgaatgagattttcagaaacaagaaccactttaccttagtctcttcttcttcttcttcttcttttcttttctttttttttagtattatggggatctgtttctgttgcccagggtggagtgcagtggtatgatcttggctcacagcagccttgaactcccaggctcaagtggtcctcctgcctctgcttccctagtagctaggactacaggtttgtgccaccacacctggctaattgaaaaaagaaattttttttcaatagagacagtgtcttgctatgttcccaggctagtctcaaactcctggcctcaagtgatcctcctgtctcatcctcccaaagtgttggaattacaggtgtgagctactatactcggccagtacccttctcaaaa

SEQ ID NO: 71153 - DNA, 1037 bp, Homo sapiens
gagacctggagaaaatgtgctttgataaatagatacaaattcatcctggtgggtcatgagtggaaagaaatcattattatgtaaatcaaatagacacttaagtctggacagcaggtagctcaacgctggaagagttcacaccaaaaaaaaagaaggaaaaaaggcaggaagggaaatgatcaaaaataggggtgggttttctgggcctggggctgcctccggtcctcagtgctaccttccctcattctgcccctctgttctcttgctgtcctccttctgccccctgtggccatgggactgcccccacaggttctggggacattttctgagccccctgcacctggtacagccagcccagggctcagtgggggaagtgctccatcagtatttttttgatggtggtaaataagattcatacagctttgcagtgtttgattgtggacttttaatctggcaccccaggtgacccttaagctccttctatttttccctgtagctgtcttttgagatgcatttgctgggccttgttaatggtttgttttttcccttttgatttattagattagaagctcagttcttggcctcccccttcctgggagaagttcttgcttcatctccataaaacgttgctcttgggctttttcctgttttattacttagcattaatacctggcagcttatatctgagctctcattttattttcgtaacatataatattgcctctcctctggcagccttggtgcttgcgaagggtttagtggcctcttgtttttttacattgggaggtaagaatttagatttattagtcccagcttggcgatgagtggcacagagaattttaaatgatttgttttaagccacgtagctaatcaggggacaaaatgaaccaaggatactagaaatgaacgagcaaggaagaaggcaaatgaacttctgacttcttctaccctttgatgttttaccaacacgagacttattcgttttttagtttggtatttctctgtgaaatgagcagaaagaatgacatgagctaaga

SEQ ID NO: 71154 - DNA, 1056 bp, Homo sapiens
tgtttcagggacctaggctccttccatgttgagaatcttccatctttaacacaggctttcaaggccacggtgaaggtcatctacttttttggcatctagctggaggggataaggacattgagcttactgaatcaggcccagaagaggtccccatcacttcttctcccattccactggccagaacttggtcttggggaggctgacaaatctagtcagccatgtgttcattttctgtttagtaagacctcacacatcagtgtttatgcaggagataggccaaaacatttttttttacacctctatctgtttttctactgctaaaccaatcttaaccaaaccctgcttccatttcatgcaatattggctctagactgcagccatgtgactaaaagggggcccttgaaccagaaatgggggaagggttggagactgtgagctgctgtttgcaatttatgcatgatgaagataagaatgttacttcgtgctgttcttagaacccagttcatttttagactgaatgtttatatggctgagagctgcaggaaacaccatgcccaccttgcttggtttaaagcctttgagatctatggtggctgaatgtgcttccaggagcagaatttaatgtgcagggagtgggtgactattaaattcagtgactgcagcaaaactttgctccttgctcctctttgtggaaacactgtttgtacagcatgtctttcataatcaatacaagggagacattaatgaagagaatgtcttgtttggcagacaaagccttccctttgttcggattgagatgctcagttaatttcctgggagtgtatttatgagaagttggttagtgattcttgtaagtgtatgtgagtttcttgttttttctttttttaagagaggagtcaacaacccattgtattactgtaaaatatttgatagcttgtactttgaggaatgtactcatgagagcctagtcttatagatttgggatatttatacatactttaaaatgagtaggttggaggggaactttaaatatgtatattttacttaaaaaaataa

SEQ ID NO: 71155 - DNA, 1084 bp, Homo sapiens
ctgaagttatagaagactgaatgtactattaataattattaagatatacaaaatcactgttagtgagagatttaaaaacatccagggtagaaagaaaatgaaatagactatcagaagcagtaattttctggtatgattttaattagtagcgctctacaggatcctttgtggaggcaaatgcattctagttagtagtatctgtgatatcatttagggctcctgttttatagattcagttccacaaatatttattatcgagtgcctgtgttatgtcaggtgctgtgctaggaactgttcagttaaataggtagtacagttaagagaataagtcagggtgttctccctcccaggccttagagttggggtgattgtgtgtcccagttttccctggacaatcctgtttactgctcttgtcctagcataattattcacagtgccccttttattttaagtgtcctggtttgggaaactaattatagggtcatcaatataggctattattgaggtagagggagtttctccagaaaaggactatggaagttctctaaacaagaaggagcatgatgaaaagtattttttagggagttgaattcaggctagatggtaggaccagtgaagaggtgggagaggggaaagcattttggagatagagtaaaccaaatactaccaatgtgatggacagaacccaactggaggtgccatctggaattccagagtgtgaagagcagcctcaggtgcgcagcctttttaggtttcaccaatcagcatatctcagatgttttcttggagactccattaggctttaacaattgccttaaaaattccccagcaaaagcattgtgggaatagggaacaactccaggttgcacatgagatgcttagctaggtcattggtttgtatggccatttccctcctgagtctaggtatgcaggtcttgaggggtggagctcaaggctacttttgcatttctgccagtgcttccaaatgtcatgactggggggggggggggttgggggtggggagggagggagaggtgggccagggtagtacccttccttgacttagtgtttgaaacttgaaaca

SEQ ID NO: 71156 - DNA, 1057 bp, Homo sapiens
gttgggaaaaaaaaatcaaaagaagaacaatatttcttgacacatgaaaagtctatgaaattcagatttcaatgtccttaaataaagtttcgctggaactcagccatgctcccttgttggcgtactttctgtgccacttttgtgcgataatggcagagttgaatagttgctccagagactgaataggcctgtgaagctgaaggcacttatctggccctttacaggaaaaaatgtgccagcccctgatgtaggacagtggttattgttcatcttgtagcaaggtgaatcgcgttctacacagaggtctttccctccgatggtgttaaagcttggggaaagctaaggctctcaaatttctgaggaagaaatcaaagctagtttgttttttcattcattcattcattcattcattgtttcaccaaatattctttgagttcctgctgtgtgccagacactgttaggggtggtaaggaaaatgcagtgacacaggagaaaatgcctgccctcctggagcttacagtctagggggaggagtaagataatacacaaataaaaactcctgacccgcctgagggtgatggatgatatggaagggcagggggagagagtggggactattaggaaaggccatactgagaaggccataggtgatgtgaaggaggtggggtgtgagccctgaacctacatgatggggctggggcagcggggagtctgcttaggcagagggcgaagcaagttcaaaagccttggggtgcaagcattggagatggtcaaaggagagcaatgtgcatagagcatttttgtgtgtattttaatttcagcattggctacagagctgtggtaatctgatatgtgatcctgttttaaaaaaattattttatcttcagaacaataggaaacacgaagggagaccatgtagtgcagtggttaagagaaggagttccaggcagataagagttgaagctcaaccttggcagtattgacatttagggctgaacaaaatctttgttgctggaagctgtcctgtgcaatggaggcagtttagtagcattcctgg

SEQ ID NO: 71157 - DNA, 1083 bp, Homo sapiens
tgagttgatacctaagtcaccactgggcatgctgaattaaaggcatgccttgctgtaaagaggaacggaagctcagggcaccaagcagaaggggcacattaggagagcctagcagaaatgtatttttgaatttgtgtgccctgttgggctcatttggattgatttcctccactctaccttctatcctatgcctaagttgatcatggagcaaaatgttcctgtttgttcttccttctagagttacgaatggtaaaaaggcaataactgatgtttactgagcacttcttatgtgctctaagctctcttcatgcattctctttccccccttccaaatcctctccatcatagctgttactgccacttaaagatgaaggaagagccttgagaggtttagtaacattcccaggctgagtggttaagtaactgggggaagctggaatttgatctctgcagccttttttgtctgtaaaatcttgggtgcactgtaagagaagcccaagaattgtccagcgaaattaaaactgcaccccaaagttcagcgcctgggctccatcctcagagccttttattgcacccgcgcttggatgggtgtcttgaagccgatttaatcctggtctgtctacacaggggagcagcaagctgttgacagcctcattttatggtcatcagtgccctcttccttctgaagcttgtcaattttaatgtctggagaaccagggggtggtgtaggggcttccagacccctgtttgcaatcatcacttgtacaccagagcttctcacacttagatgcatgtggaattccctggggttggagttaagttgcaggttgtgattccataggcctggcctggggtctgatcctgcatttgtaaccagctcccgggtgatgatgtggaggtgggtgtcctctggccacactgaagtccctagttctagatgccatcaccctcaccctacttcagaggctgtaccaaattcttagaagagaaattttgcctcaaaagcgacctgggaacctgacctcaggaagaatttcatctctgtgggaatgtggaatcggagtgatagaggtgaatgacaag

SEQ ID NO: 71158 - DNA, 2177 bp, Homo sapiens
tagtttctttatctgtccaatgggcccaatggcacctgctctgctcatctctcaggatcttacatgccacataagctaatggagaagtaaatgctttataagcctaaaggaatggacatgggtgcattcagtgagaggcagtaggactaatggttagtgattagtttgctaagtaggagcagcagttgttagtgtaagaagggcgggttagtacatgggtggtggtcaggaggagcaccactgctgctgctacttagccacttgtgtaacctttttttttaaacaaaacaaaacaaaaaaaaacaaacctctcagtctgctataggatagattgttccagcatctgaaattgcaaagcacttcttgaaggggattcttaggatggcgtaattttgttcactcataggatcttcttcctggggcatgatcctagccatgttcaggataagccctgagcatcaagctggtgcagtgaagtgttctgtggctggaggctaaatctgtcccaggctcacagcatgggagcggggatggcaggggcttttgaattcccttgagggcacttggcctttgcttgtatctgctcaggaagtcagacagtctgcagccagtggcgtgtgcagccaccccttctgttctctgaccctggaggcttgtggtccatttgttttaaaggtgactgtctgatattcctttggaatacgtgagtccggtgggaaagaatagaacatattctgaatcttaatggtggatttaaaaaatctatttagagaatctgagcacttaattagacatgtctttttttccccagctgccctaattaaatagtaatcataataaggataaggataatagttgatctcagtatcctgtctcccagtgaagttgctcaatacatatttgtagatgaatgacttggagatccaaaggaaggttcagagatttgccattgtattcgagtctaccctggtgggacctttaaggtgaacattcttcttctctgggcctccaccttttcccttcccatataactattttctccttatctgcatgcttttctgcaatgcatatccgcaacaggtgagcctgggtgaatatgattacatgcaggttggtttttctcccttctttgtggtccgcgttttgggattaaatccccctgcagacttttgtctggtcagcctggttgtgactgtggatcttggtttcgtatactgtcagagatggcaaggaattcaaagatgatgtcgttttacgtctttattttataaactcgggcccaaagtgaaatgacttgcccaagaatacactgagtgagtgaggtggtcatagagagctagctctcctgacgcttagctcagacctaattccaggaaggtgactgcatctagcttctgccccaacacatcctgggaagaaatggtatcctgctaagagaatgagggctggatggaggtgtcctgcgtaacggtgtcaaagtacttcactctgtcctctggggatcccacagtgattctttgattctatgcccactgaggaaaagttgatttgagtctactccactgtttgattgaaatgggcctcttctgtccccagcctggtgagtcgtatcttgtttccctgccagtgggcattttctgcctttatccccgctcatggctgctgaatgggtcacccaggctggggcaggctgaactacaggctaatgaaattgtttggcctagttcctgcttggtggtgaaatctcagacaggatcttatcaccctctctgtgcccggaaaattcgactctcctggagcttataaaattgggatgtctgtttccactagcatttctttcccagttatattaatcaataatgtgaaattaaatcaagaaattccttatgccggcactggcttctccaatacatttatctctgtattctagtatttgctttggctctttttctcagaaggggatttttccacacaatttaggagcacagagcgaacttcctgggaaagcctagaaattcaaacatccttagctgcataaacttgggagtatcagtatatctcactgagccgtgttatttttaatctgtaaaatgggcatcagtgtgccacccttgcagatgttgtaaggattacatgagattgtatggtgtgtaggatacacctcacttcgtgtttgg

SEQ ID NO: 71159 - DNA, 1047 bp, Homo sapiens
tgcatataacctatgtgcctcctcccatatactttactctctagattacttaaaatacttaatacagtgcctatacatcacttcgtttgtgtgactcagtgtagcactggttgtgcagcaaattcaagttttgctttttggaactttatggaatttttttctgaatattttccatctgaggttggttgaacccatgagtgtggaacccatgaatgtggaactcatgaatatggaggctgattgtacaggacaaaaagtcataaataaaatgaatgaataaagcctactttaaaattgatatatatttaaaatttttaaaattgtaatttgggagccataaaaaagaatacaggtagtgtctcagatttaggaaaagtcattatttttagctaagaaccatcaattctagacttgttaatcttatcttcactttaatcaatagctctggcaggccactttttggggagagccatattttttgtaaaggaagactgaaagtcagaaagagtgtgtatgtgtgcaagagacaggaacctcgagctattgggccacaagggcacatccccagtgacctgaggcccctctcctgtactcctccaccctcacctgggtgatcttgtcttagattggtgcctcagcagaatcagaacgattgattacatgtcaaggaccaccagggaaacctgcagatgggtgaaaccgcagggttcagtctgggaaagccacggctccaatctctctaattacaaaattaatgagggctggaggcaaagcctccagacggcccagggtgagccagggagcattttgatgccctaaaacagctcatgtttatttcgtggtcttacctgatcgtgtgtggattgaagtgaaggggtgaggtagaaatggagcttcccctctaagattttgcttcttgagttaaggttggggtcaggtcagaaaatgctttttcatcgctagtgttttgatagcaaaagcaaagagccagtggcagaacttttcaaatgactcttagaggagatgacccagcgtccctgaggtatc

SEQ ID NO: 71160 - DNA, 1057 bp, Homo sapiens
acacacacacacacacacacacacattttaaaagctttcatgtgccctgatcacgctgtgcttcttttgtgattaattgagagtctttggctttgctctggagatgcaaaaatccttgaggtgacctccacagagtgatgtaaacctacaaagtgattcatctcgtgtcagtgaagttgacatcttaaatgacagtctggcttgacatcccttttgggggtatttcttctcagagcctgcaagacccttttcatgaaacgtggtctgtgttcggtttgtatagtcatctcggtgcagctttttcttttcactataacaaaataacgatggtgttttctttttaattcctttagcttccttgcctgagtatttaggaagcaagtactcttaacattttttaaatgtctgtggtgggctagtggatattctgaaatagagttttggcatcacctctttctttcaaatccccctgttgggcataggatatttactttgaatgaatttgtctgaattttagagactctcttgctttgctccatctcatggggaaattgggaaaacaaatgagaaaaagggcagtgcaaataacttcaggtcagctaatctggaggggaaagaagtgtcttaggagtaaagatggttattagttaggcacggaggcaggtgcctgtaatcccagatactcgggaggctgagacagggaaaattgcttgaacccaggaggcggaggttgcagtgagctgagattgcgccactgcactccagcctgagagacagagcgagactccgtctcagaaagactgtcagctaccagttgctataccagaggtaataactgaatgataatacccctgcattttactttctagcaactttcatgtccactatttcatttttaacatcttggatgtgtaggaccaagttatgataagcaactaacttcatctttcctcaattgagaagagtgaggcatgcttctaaatgtagtgttgaacattgtggaggatatgctaacattttagaaataatccaatttagccactgtgggaaatggtat

SEQ ID NO: 71161 - DNA, 1048 bp, Homo sapiens
tttgaccagaagaagccatgagaaggtgcccaggtacttatcaaagggcttggttacatgcccctgtttccttgttacccttaagcaatgagagagagatgcttgaagaagagcagaagctctgcttgctctttaagcttggcgagggttgggtctgtttcccctcctccattcctgggctcctagtaccatgtggttgctcagtgaatatctgctctttctttttagccttcatgtgggaggcagttgttgtgtagagggaataagactagacttgggtccaatttacctgggttgaagtctttgccccaccactttgctcttgtccctggacaagtcacttgatgttgcccagcctccatttttgttgcatcaatagagtggagatgccagcgattgatcttgtgaccttgggggcatcacttaacctccctgaccttggatttctcatctttaaaatgagggacactgaagatgagtgtggagcacatgtcggaacagacaatgaaacaggcattcgttattatcattcccatgtcagaaatgggctactatcttactgttttatctcaaatgtaatttcaagagaatgatacatggtaacgtgggtaactttcatttgtcaatgtgtggatgcgccgcccctctccccggggtgtattcctcagcagcccggcaggggagggcacatccacacattgcctgctttaaatctgttgcccgctctaattgtgtagacccactacacccaaccagcttgtatcccacagatggaaggtaatttgaataactgtttaagccaaaatgtaattggagataaaagctaaatgtctaaggtctagcagtatcaagatgaccagaagtgatgcattggatcctctgctgcttctgaatcatctgggttaattaccgtactctccaccagctttggtcatcaaggagcacacagaatcattgcttataattgaagactgtggacaatgatcacataagatcatccctaagttaccagtcccttttattctaatggacatttgaagaaaaaggc

SEQ ID NO: 71162 - DNA, 1840 bp, Homo sapiens
tttatatgtgtatgtgtgtttacacaaccaaggtcccgacccacataatattttgaattctgttgctttaacttaaagcagcggtttaagtggttaatttaaactccattttcatgtcttcatgttattttaataacagtagcattttttgattggtccaagattataggaataatttcataaatgatagttcatatcctagagtgtttccaatttttggccactagaagggaaattctatagcaaacatctttgcgcgtccatcttttagtttctgttgaattaatccctcggtgtaatttcccaagagggaaattgctggatttgaagggtgtaaacatcatcatggctccagtaatgcagtgcacgtggggagatttttaaaatcagtgttctctctgttggcatcttgtgccagaaaaatgtcagaagaaaataatgcgaatgaacaattaaaaagctaatcccctctttaactcttaaaaatatggaaatgaaataggggttttggtccatggatgctgcctgggaagccccagctctgttactgcaggcatgcctttccttgggggagagatcgtctttccagctatctttgcttctggagaaaagatgctcacagtacttgttcaacagccgcacttcagcctcctgcacttgcctcgtactcaccttcagcaatgccaaagcgcttaggcctccagcatacatcatcaacgccttctgtctgttaactgtgcaacagctcctctctgatttgtgaaataattgtgtgtccactgattaatgtgtatgttttaaaacagtgagatttgggttggaatagaagagggttttgagatactctcaaataattagaaagacaagggagtggacaattagaaatgggaactaattatggcttattgagcacttaccttgggccaggccctgctcgaaacacgtgacatggatgaacttattcagtccccacaacaactctactaggtaggcaaattgttctccccattttataggtgagataactgaggccaagagattgagtatattgtcaaggacacacaagatgggaacccatgtgtatcagtttgctagggctgccatgacaaattcccacacactgggtggctttaaaccacagaaatttgttctcccatggttctaaagggagaccagaggtccaaaatcaaggtgtcagcagggccgtgttccctctgaaggccctagggaagaatccctccttgcctcttcctggcttctggtggctcccagcaatcctaggcatgtcctggcctgtagctgcatcacttgaatctctgcctctgtcttccatggccctcttccctgtgtgtgtctctgtgggtcccctcctcttctcataaggacactagtctgacctcacttaatttaactcattatatctgcaaagactctatttccggaggtcaccttctgaggttcccagtggatatgtatttggaagggacactgtgcaatccactatatcacggtcatagcacgtcacagtggattgtacactgcaatccatggttgcaggtccctagtggatatgaattttggagggacactgtgcagtccactgtaccatggtcatagccaggacctgttcctgccttctaggacaagagtggagaaaagggaaagaaagcagaagcctgggtaggctcagggtttgcccaggtgctcttgagatggacaaagaatgggcgaaaatcccttgggcttttaaaaggttgtgtggccgggagggactggagccctgggcgagatgcctgcctgagtgaggtggggttgctgggcacagtcagactgtgtgaag

SEQ ID NO: 71163 - DNA, 1033 bp, Homo sapiens
cacatcccacatattaaagcccagtgatgccccacctcactgtgccagtttggcaaactcccttgcgagcggggaccttttgctaagtgactgcctcagtaaatctaactcgttagtttaatgaggcagcaaacgtggcctctgtgccatcaattatgaaaagagctcctctttgagcaaaagaaaagctccaaccaaggaaaagtgtcttctgtggaaagctagtgcaaagttaggaggcctggttgccatggcaacagcctcagtggtgtgtgtgggtcttgatgtggagactctggggctgatccttttgtaggaacattaattagcacttgatgcccagaactggtaagtgaacaactagcagcagcatcagtggaccttcgatagccgtagagaaagagggaaaaatgtactgctttggctacagtctctgactaaatttaatacttctttggaccaaggtacctggtggaggaagataatgcacgggcctcaaaggtgtcgaatttttagaactcttgtaaagggatgcacttgagaactatctgatgccccctaccccccttcccaatctctcacctgcactcccttctggaaaaatggactcctgaatttatgcatcatgggtggcctaattaggttaactcatgccctgtcttgaggtgtgacttggccagattagcccattaattgccaagtcagtattgcctgaggcttcctgtactgggttcggtggtgactcagtggggaatttgatagttgggttccctttggtgcccaaaaaatctccatattataggcaggtctcccagcctgtccacacacaccctgtcctaaggaagaggcagaactgtgcttcaacaaaggataggatttctggtaacccgtgtcaaaaacaacacaggctcctcagatgcaaaccattcccttctttttgttgatatcctctgttctcagatgattttctccttcaaaacaaaactactgaaacactgctgcaaattttatgggtaacatatggtgtcatggg

SEQ ID NO: 71164 - DNA, 1001 bp, Homo sapiens
ggtctctgaggaccaaacagtgtccaagggatttagaggaattctggggaactctctggggcggggggcgggggggggaatggctccaggaaaactgagaatgacaagatcttggaggcccccactgaaatctctgttacatggtggcgcctcattggtcaagtcttcagggtgctaaagtaaacttacttctccatcagttagactccaggaagcaggatgaggaggaggatgaggagggagaaggaaggtcggaaggaaagaaggatgagagagaaaaaggaagacaaattactatttactaaatgtataatacatgccagtgaccattctacatatttttcacacgtctcatggaatctttacaacaacccgaagaggaaggtctccagtaaccccgttttttagttaagttaactgaggctcagagggttgagcaatgtgccaatcacacagctcctaaatgggagagccaggcctatgaagcctggctaggttgcaggatgaggagaggctggtgctttatttttcccgggtgaaaacatgcttccttgagattctctttcccagtgactcaagcgagacctgaggtatgctcaggaccagttgcaaaattcacaaaagcaggggccaggacttctggaatggcatggaatggacaatagctgtaaacaattacaggctgggcacagtggctcacgcctgtaatccaacactttgggaggctgaggtgggcagatcacctgagatcaggagttctaaaccagcctgggcaacatagtgaaatgtcgtctctaccaaaaatacaaaaattcgcccggcatggtggctcgtgcctgtaatctcagctactcgggaggctgaggcaggaaaacctgggaggcggaggttgcagtgagccaagatcatgcccctacactccagcctgggtgatagagtgagactctgtctcaaaaaataaaaataaataaataaataaatatataaataaaaattgcaga

SEQ ID NO: 71165 - DNA, 1472 bp, Homo sapiens
ttgatcttcattctgaaaatggcaaatgaacagaatgaccatgatgaatgggggctcctgagaaacacagcactcgttctcagtgtctcaggctgggggagtgaagcctgcagccttgatggagggaaggtatgtggaaaatgaattgctgagcggaatctcagagaatggctgctgaagaaaagcatttcaaggagcaattatgcagctcattaagatgcactccattccggcctctgatcctaggggaattgtcagagcaattatgtgcaaacctcaattttgaggtctgaaaaggggttggtgcataatcggcaggagaagaaaaagaagggagacggtttgaaacaatgggtattaaatgattgtcacagcaaggaagacagggatggaaggagtggacaccctgggtacttaagactgaatgtgtggtctcaggattgcatacgggccatgtgggcagtgcatttggtacccttaataggacttcttggaatcaaagtggtttgctttgtacaaagttgtaagcatggtgtttgggatatgtttgttgaatgaatgaatgatttgtgcttgccatatcaaatgaatgaagggaaaaatgaatgaagaagttaaaaaggttaagaattcatgtaaaatgaagataataatcatacataccttacacgactactgtgagaatgaggtggtataatgcacttaaagctgtcagcacagagcctgacagtggcaggctctcaattctagctagtattgggattacattttcccaggtgtgttagtcagctcagactgccataacaacataccacggactgggtggcttgaacaacagacatttgttgactcgggtcttggaggctggaaacccaagatccaggtgccagtaaggttggtttctggtgagcctctctttttggctcacagacggccacctttttggctgtgtcctcacatggtctttccacggtgcccgtgcactcctggtttctcttcttataaggacacggtcattctgggttagggtcccgcctttatgacctcatttaaccctaattacctcttcaaaggcctcatctccaaatacagtcacattggaggatagagcttcaacatacaaattttgggggacccacctcattccataacaccaggtgaagaatcagactttgctattgaggttattaggcctgatcttgtgactaagcagctatgcaaaaccttttaaagccactagaatcactgtttcctgagatgccaaactggagatgccccagtgttctagaaaagcaaatagacttccagtaacttatgtccttctgtgttagtgcctgactctgctattcagagatgccagtgaccatcctttttctttttctttttctgagacggagtttcgctcttgtcgcccaggctggagtacaatggcttggtgtcaggtcactgcaacctctgcctcccgggttcaa

SEQ ID NO: 71166 - DNA, 1020 bp, Homo sapiens
ggcatgagccaccacgcccagctggccatcctttttctttccactgttaagacaaacaggcaactcactcatgctgtttttctgaaaaaagcaaaatttctgaactgtcttcttaaggattccataaaacaggtgccctgggagttgaaattgaccatgtgaacctgtgattttgtgtcagagtgagcactactaaatctcattttcttccctgtcttctttttcatttccaaatctgcccagaagacagtaaaagctcattaatttgaaccctgctaatttagaatatgtaacatttcctccaagctcaccatgaaggaggaatttgtgaaacaaattaatagtgtgaacataattagaaaagatgagtcttgtagtgttgggaggtacctggaggtgatccagtccttttcattggtggcttgtttcttttcaaatgaggaaatcgaggcccagtgaggttctgtggctcttccacactcacacagggggactgtttaacctccttcaggacaccagcctaaaacacggagtcttatttgtttgtgaaagacacaggctctttattagctgtgggttccttttacaatgtgaacctcaagtactaaaagtgcatttttaaagaaatattctgcatttcaggtttcccactaattatgactggccttctcccaagttagtttgagctattttggtgaggttttatagtgatttaataagaaaagcttttttaaaacctcataaaaccttctgtacaattcattctgaccaacattccctcttacaattatgtcattaacaacttctttttaaaagaccagaacttttgtctattcatgttaaccttaaaagcagcattcaccgaacccctgagaaacaaggagagctataatactttacaggattggggcagagcacatgaaatcatgtgtgagagagggttctgtacatttgtttttcttaattgccatttctgacttgggcagcctccccacccaaaaaaaaaaaaaaaaaaacatg

SEQ ID NO: 71167 - DNA, 1079 bp, Homo sapiens
cttgcatgtgaactcatgtcttgtactccgctctgatgaacctgacttaaggccactgttgaggcacaatgctgaggggctggattctacagtagatacaacaccaacccttccctcgaggggccgactctttagcagggaagacagatgtaggcacagatcatcctgtcacagactgtgaagcagagccccgtccccgaggtgtctgcaatgtggggaggtgatgctgcctgggaacacgagacctcctggattccaggccagggttccgtcttctgccccaaatgatggatgaatagaattgggggtgatgatatgggggaaggatggggcaccacttcagaagagcacagcgcaagcagaggtgtagtggggggacttccatttagtttgcaggagcctacctgtgctcagtacagaagacttgaatttgaaaagtccaagttcctgcccccaggtggttcacaagagatgcgtacaaccagctctggtggaattctgtgcaagggaagtgccgagctaacggggatgaggcgaagtgctagatacaagaggagcctggtctcctaagaagttcccactaggtgttaggagtcctagagcttctcatcaaagaaaagattctctaactgtggaatttcagaaattggcaagctgtcagggttggtctgggggaggagggaacctcctgaaatcactttatgtgatgggttcctccatccgctcaaacgggtttcttagttttagcccatcagtctgctgaggtgaaattaagttctcttccaagtttgttatctgaaatgaccctgggtccgtcagtactgcagctgcaccctgacctgggctggtgacagtgctctgcaggaggcgcccactcgttcccggtcctcctccgggaggagcccacagacaccacactggtttcccagtacactgaagctatcgctgacgttaaggagcctcttctaagctgggaaatgtgggcagctggctgcggtcctccctggagggggtgagggaaggtgttggtgaaacgcttgtggttctcaggggccctgggaaactcttttctttatcat

SEQ ID NO: 71168 - DNA, 1063 bp, Homo sapiens
aggtctttgagagacagcaaggcctttttgttaaggtttagacacattttctcttggtgtgttctagagaagcacggctttatgtaaaaatgtaagatttatttttgccagtaaaatataacacacagcccagcccagcaacagcatacatcctcactggatgccagcaacagtcactgtgaaatgttacaagtgcaaacagccccagtccctcctcagacagagcatgctgcccatgccggcaacagtcactgtaaaatgttacaagtgcagacagccccagtcccctcctcggacagagcatgctgccctttttccagggaagtggggttatttctttttatggtgccattttgacttcctaagactaccatagatttataaggaaataattcctccaatgggcctaagtgacatcctaaagttttacacgagccggttatgaaattgcaagaactgtttcatggaaacatttccatgtcaccaatgtaggcccatttattaaatttatggaacttgctgtatgtgcttttttaaagataccaaaatatatttaataacctcaacccggaggcaaacctcgagggttaattacagtaatgaatgtggccaacacccgggctattcaggaagagagagtggctctgtgctctgcctgagtgcctcaccttgtgctagcagactcagggggtaactccataaactttcatcatccaacctcttcccactttcacctctctaggtaatctggtcactcttggatgaatagcagatgtatgagaataaccttgagatttgggatcgaaaggcctgactctgagatctgattctaccccatttattatgtactgtgtggccttggttatgtcactgtcctactctgggcttatttttacatctataaaaggccagcatactaatagcactcatctcaggatttgaggggaaacagaactttgggaggagcaaggagcagcatggaagaaaagaagagagtctagtcttaaaaacgtttacaaatgtatcatagtccagaaagtcttgtttcaaactgtgccatctg

SEQ ID NO: 71169 - DNA, 1038 bp, Homo sapiens
tacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatggtctcattatttctttttgtggcagcaaaattctaacatctttccagaagaaatctatgattcctgctttgcttgctacagctcatttgggggcatgaatgttctccttactaacctctcatggagtcatgtgataacagccattgtcatgtgtatggatgccaccattcttgaatttctgctagaaataagtaggttgctattgcacttagagtcatctttgcaagggactcattccaaaccaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccat

SEQ ID NO: 71170 - DNA, 1945 bp, Homo sapiens
tgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagactatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttttgccttttgttttgtttttgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttacgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgc

SEQ ID NO: 71171 - DNA, 1077 bp, Homo sapiens
gaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttcacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaagctgctttctgtgtatggtttgctcatggctcattaacaaaagactgtaggggtggggtgggccgtggaccttagcatgcggggggccctgctcatgtgtatcaaaggatggagatgcaggcttcgttggaagactcagccctggtaaaaaccgccatagatccaaattctttctgttcatcgggtgaatggaagcttttcttcttt

SEQ ID NO: 71172 - DNA, 1097 bp, Homo sapiens
cctctttcttatgtactcttttttgaaatacgttttacttatgtactcttttttgaaatacgttttacttttttgaaatagtaaatcctgtaatatattgttattattttttgcttcagttatttttaaaaagagactaaaaatgaaaaatatatcttttagattttatcatataaagttatatttccagcactctttcctttgtgtagatccaggtttttatctggtattattttccttctgcctggagaaattcctttaatgtttgttgtagggcaggcttacagagaaaatagagtctttaggcatgtctctcccagcgtgctctttcctttcccttcacctctgttcgtatctctaacaatgtctatttttaacttctttcacccctatctcagaagagctgattcttttgcccaggactgactagttgacctgtgccctggatactattccattacaattccaatgggagccttactccatcaattattttaacttttccggtatctcccatgtcttcctctcttacatcttttccctttagcttacaaatgtgcacaagttttttatcccaagtcacctttcccatagtgctctgccttctcaagcttctgttctgtctcttctactctctacaatcaaactttcccaagtgtagtctgtattttttcaactcattatagtatttttcttccttctcactctacaaaactgcttttactaagctctccagtgacctcctaattactttatccaataacttattttcagtcttcattctattcagttgtttaatactatttactataccctttttgcaattctaccattctcatcgcttctctgaaaattctttttcattttccttcactggttccttctttctacctgtctctttgtattcttcaagaccctgctcttgagcttctattcttagttttcaccttctttatgggcaatattgtctcatccagagattttcaaagtgtggtccccagaccagcaatatcacttgggatcttattagaaatgcagatgcttaagcctgaatcagcagctcggaggtagaactcatcaattgattttgatatatg

SEQ ID NO: 71173 - DNA, 1032 bp, Homo sapiens
cagagcaaggctgtttcaaaaagaaagaaacaaagaagaaagtagaatggtggttaccaagggactggagtaggggtaaatgggtataaggtttcagttttgcaagatgaaaatgatctagaggtctgccaccactgaattgtacaactaaaaatggttaagatggtagattttgttacgtgttttttcaccaattaaaaaaaaatttaataaaaaaggataaagaggagggaagcctaatgttatgctctttatgcccgaatttggcgaaatcgagccttgcccgctgttttttcctatgacagtgtctgaacctttctttttcccaggagtaggaatggcccctgctcccgcgcagcctccaggctgcaccacgctcgccccgcctctctctccgctccttactccgcccaccgcagtttcctccaatcgcggccctctccccgcccccttacccgagcctttttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtgacggacgggtgacggcggcatgggccgcacacgtgcggcagaggaggcgcggccggtgcagtttgggagccggccggtggctccctgcccgggctccgtaccctcgaggggagccccggggactgctgcggggctccggcgtgccctgcccgcggcaggggtgggggctttggggcgggcacccggctgcgggcccggaatggtttccccagctagtggttcttatattctgcaaggtagtgagcgcccaccctgccaggcgccgctgccaggcatctgccctgccctggaagctgggaagctctcgagttcttttggggaagggagggcttttggtttggctgcctgggtcggagcagttggctgatagggggaagcggagtaatattatgctaacagtccctacctc

SEQ ID NO: 71174 - DNA, 1037 bp, Homo sapiens
ttttgctctacttgattcattagttggaaacaaaagcagtaccagattttctatctgtagcaatatatttaaatctgaggacagagaaatacctttatttgtattagtaatttctctttctgtaatctgaaggggaatgagagctaacattcactattacgtcgggctttatttgtgtgcatgctcttagggagtccttccagcaccttattttacaaatagaggtcgtctacttgaccttggccactattttcttttcttcttccatacgctggacattttagtcatctgttatgtagccatagcagttacataagttttgagagtctgttatatgcgtggttatgtgctgggcctcttttgagagagaaaataaatatccttgtttgttgactgctctgtatttggcacagtgactgacagttatcactcctcttttatggattagtacgctgaggtttcaagaggtagaattaaatgtattaattaggattcttggttgcaaatgactaaaatccagctcagattgccttaagcaaaaaaagaaattatgttggctctttttattgggggaaaaatactccaggcacagtagatttcaggtgcatctggatccaggtgctcagtgtcctcagaggtcagccactctgtctcttagttctgctttcctgggtattggcctaatctagagcgtactcttcccccaggtgtggagagttgccagtttatcagcagcttcagccttatattcagccaactcagtcattcactcagaaagatttctctctcaacagttccaacaaaaggtcctgagtgatctattattggcccgactagagcagcgtgtcactgtgatgccactaaagcatggtacagtggccaaggatatggaggatgtaggcatgtatggggtgaggggcaagagtgactaagagtgacacaagcttaaaaggaaagccagggttatattatcagaagaaagggaacgtatgttgggtaggcagaaataaccactacttaattaactggcccaaggt

SEQ ID NO: 71175 - DNA, 1058 bp, Homo sapiens
ggatcatttgaggtcaggagttcaagaccagcctggccaacagggtgaaaccccatctctactgaaaatacaaaaattagctggatgtgatggggcacacctgtagtcccagctactcaggaggctgagaggcacaagaattgcttgagcccaggaggcggagggggcagtgagctgagatcacaccactgcactccagtctgggcagcagagcaagactctgtctccaaaaaaaaccaaattcttatcctttatgtttcaatatgtttgctgaatgttggttcttcccaatattgttttattacgactttttaaggaactgctctgaaatagatttcctgtccactactttttgcaggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatagtcaaataaattatctgaaaagaaacaggtgacatatgtctgcaaattctgtgaaaaagaatgtgattcacgggttcttttgcttttcaggcacctatggtgcttttatatgttaaaaactttagacaagttaaatttgacagagtttctttgggcaaagaatgattaatgagttaggtagcattgtaaactgaaaggggttcagagacctccgctctacagcaaggaaagtgtgcttttatcagctgaacacagaagtagagtacaggaataacttgatgggttacagctaggtgtttgcctaaataaggcaaagaggagacctaaggctgcctgatgtcccataggtatggtctgatctaaggagatctaaggctgccttgtccgatgggctgaggcttggctgtttgtgattggccagacttggctatttgttataaaaatacactcctgagttaggttttggtgtgtagagtacagga

SEQ ID NO: 71176 - DNA, 1076 bp, Homo sapiens
aattggctatagttccagatggaggagttctagactccatggatccagatgaactcatgattccctgtcttcttgtgacttatcataggccttctactggacccagtctctggaccctgtttggtaaaagaattgttcaagtaaatttggagagctcaaaacacaaatctgtgtagctttaatctgaaagggaaatcacacacaacctccagttgctgtgagagaggaatggttacaatagacccagcaaatacattcatttggtcactagggtgctcctgggcggttgttggaagtcgcctttggacgccacttctgacaccaaaaacttaattgttaaaacctctagacaaattaaatttaacagtttgtttgagcaaagaacaattttatgaattagcactcaaaactgaaaggttcagagtgttccactctgtggcacagagagtatgcttttataagtataaattgaacttggaagtaaactacagaaataactggattggttacagctaggcatttgccctatttgtgcatggtttgataacttgactgcctatgactggctgaagctcacctgtttctgtctggcttaaacctagctattcgttacaaaagtattctgctaagttaggttttggtttgtttattactgaggtagattgcagtttgttatataggaactacaagtaccaagggagtctcaggctaatggcctcctgcttatttaatttcacatatgtaatattggatgtattttgtttctcagagaaaccagagctagtttttaaagagttgggatatatagcatttggatgtcttcccagggtagaatgatctttattctcttctatggtagagtttagaaagcttaattttgtgcatggtgatgagtgaatttgttagcatcttttttcttcagcatggatttcagaaacatcaattttattttaaagtaaaaataaaggccaggtgcggtggctcacacctgtaatcccagcactttgggaggccaaggtgggcagatcacgaggtcaggagtttgagacctgcctggccaacgtgaatccccgtct

SEQ ID NO: 71177 - DNA, 1024 bp, Homo sapiens
ttttgaagcaaaaatctcattctgaataaatctcccatctgttccaataacattttaattgcgcatcaaatatggtacttatttttaaaaactgcctagcaggatagtttgtgttactctgcctgtatccatgaccgtgataagaaatgtaagaaaaggccaggcatggtggctcacacctgtaatcccagcactttgggaggccaaggtgggtggatcacctgaggtcaggaatccagacaagcctggccagcatggagaaaccctgtctctattaaaaatataaaaatgagccagatgcggtggtgcatatctgtaatcccagctacttgggaggctgaggcaggagaatcgcttgaacccaggaggtggaggttggagtgagcgaagatcatgccactgcactccagcctgggtgacagagagacagactgtctcaaaaaaaaaaaaaaaaaaaaaaatgtaagaaaagaggttgagtcttattttcatttgtatttctctcactgcctagcatagtgcctttcactcagttggaatatataataaatgttcattaaactgactattgtttccttctctttatgtcaacaaaataattcagcttaaacatcagttcacaatcctgggtcaaaatcctgaagcaaaaatacaggatatgtatgatctgtagacttttcccaaaagttttaatgttggaatctttgtgtttgactccccaccatctgttcatggaaaactcttgccagttactggtttaggaatgggcacgtgatgtgagcctaaccagcgaggcatgtggaaagtctgtagacttttgggaaggaaagtgcagtcatgcactgcgtaatgatgttttggtcaacgatggaccacatatacaacagtggtcccataagattataatgctatatttttaccgtaccttttctatatttagatatttttagatatacaaatatttgctgttgtgttacagttgcctacagtattcagtagagtaacatgctgtacaggtttgtag

SEQ ID NO: 71178 - DNA, 1126 bp, Homo sapiens
gatatgatggctggcccccacatagtttaaattttagtaaatagcttttgaagcaaattttacatatgatatagtagaaggctgatcctggtcgtatcataccatcttcctatctatgtaactttgggaaactctcgcaactcctctgagcctctgcttccctatgtgtaaaacagggatagtaaatgccttcctcaggacccttaataggagaattcattgcagtaatgtaagtaaagcacctcacattaatgctttgctcatggtaagtactcaaatttaactctgatttcctccgtcaccattcttaaaagatattgagatagtttaattaactagatgaattcatttcccacaacccttttcaatcatcaattcctagatatttttctcatccattgttctgacacaatgcctgatacagcagcactgaaaaatgccacacaatgaaaaatggcaatagtacaaggaaaaggggtgcttttctttgggcagctcgctcgtccttcatgggacatcttactttccatttttctacctattggttctgctgttcactggctgtgtgatcttgggcaagatagtaatctaatatctcagagcctaggttgagtatctataaaatgaaaatcaaatctctatctcagtaggtgttgcaaggattcagtgagataatatacataatgcacttaacaaggcgtttggaccatagcattgaagaaatggaaactattaacagcccatttcccattggcagacagaagtagtcaggtgagtaaattttcaccatctatgtgtgactagaaggcggcaaatttctgaatcacatgagtctccaaaagatagccagaaagttaaattctattaatcctcctttaaaaataaaatttcagtaaacattcctttttctttggctttgaagaagccttagggaatatttgtcattttggagacttggcagaataacatgaggggattgtagggaatcaataaaaactaaacaacaaaatcagagtcagagaacattttcaaaaggaagaataggaggtttgatcccagcatgataaacagagcgaatttggcctggaagcacttttgattatactatagctcatttaccatccca

SEQ ID NO: 71179 - DNA, 1069 bp, Homo sapiens
cgcctgtaatcccagcactttgggaggctgaggcaggtgaatcacctgaggtcaggaatttgagaccagcctggccaacgtagtgaacccctgtctctaccagagttacttttctaaaaaataaaaaaataaaaaatagaaatacctatacatcaatcttcctctttctcttgcattcattcttccccattcaccgttttcaaaagcatcttttgctgctgctactgctttatcaacatccgccaaagaagcgtaggatactttgcatattgtctatttcaaggtaagtaaaaataggccccatgagagatatgaaaatatggttcttggaattaatattgtattaatagaaaaaatagagtattactgattttaaaaaaagttatgataagaaatgagtatatctagtactacagtaaagaaaaagaacaattttaatatgaaaattgtgaaccagaaatttagtacttctcatatcatactactttatggaagaacacatttaggaagattggaagactgtagttcttccagtgctttaggaaagctgaatttcttgccatgagtcttcaaagtctggaaagttttttcacatatatctctatgcagatgagtgcctctggtgtgtataggtaaagctacctgtctaaatttatcataaatgttctataaaataggttactacagttaatagcagctggtaccagaattgagtcattgaaagaaaagcatgaagtacatttgtgtgaagtacttagaggcagagtgagagaataaaagggcttcttaagactgcctcttttacaatggtgtattaactaaaaatccatgaccagtgatcactactcacactaaagaattactcacagatccatctgttgggttgatagtgtcgtaagtctttccatcgtctgcatctgtgaactgtccatttatgaaacactggtatggcatttttaccatgatttcattgacctcctttgaaatctgagagaagtatattaatagattcaatggatttccgtgtttaccaatttgatgtcaaacagcaataaagaagcatattcac

SEQ ID NO: 71180 - DNA, 1032 bp, Homo sapiens
taaaacctttgtttgctcaatacctagtaacagtcaatggagctagtactccataggctattcttggtaaatgctgtcctggttcacgctgtatgtctagatctcaggggagttcatgcaacagtagtaaccaatcaggacctcacaactgttcaagcatgcctagtttcttgtcttgatcacctaggtaaaaaacagaaagaatataggcaattgaaatacactcaccctctgtgtaattaaaaaagtctcactgggtgttctggcacaatcctgaaatctcagctacttgggaggctgaggcagaaggatcatttgagcccaggagtttgaacccagactgggcaacatagcaagaccccatctcaaaaaaaaaaagtaaaaagaaaaaatctcaccaattgatagcagaggctcctctgtgcctgggcaggatggatgggtgataaatgatagagccgtgctttggactatcaattatatccatgggaatgaactgagtgcagaaagggagcacatttagctctgcacccacggatctgtaggcttctgccacttctttgatggtcttgcccttgaccctccatttaggaagcttgaacacaggggtcccatctttctctgcagccaaagctgagcataaaaaagaagattttttttttagaagttagccataattttacatcactatgaattcatatgttgtaattttacagtttcatgaaatatttacaaataaaacatggtgaagaacaatttagattgtgactagaatttcacctgttgtaattggatcacactaaggtgatacatatctatatacttaaggcataataaattagaactgaaaagtttttggctagatgatattttaagattttaatgaaagctttttcttttttagatcaaaaatggtacctttattactgatacaacattttaagaacatagctttagatttggaggcatgtgccaatacttcacccaccaatttaacatactcacctctggcacagctagaaagccatgaaa

SEQ ID NO: 71181 - DNA, 1585 bp, Homo sapiens
tcctctcgcacagaacgtcttgactaaaaaacaatccgtacagaatgtgcgggagagctgtaggaactcctacggtggcgacagagagggaaacaggcttgttggaagaagcgcctggtcagcgttatcctcgaggatcatgccttcctgttaattccccaccccatcaattctacctttttaggttagactggggagtaactttcccaggtattaaaaatcgtctagagagagcagggcgaaattagagtgccgaagtggcttgagaagcacagtgaatggtggcgaagcccgagccgggtcgcaagacgcccgctggcactgccggcgccatggcggccgccttcggccacggcggaggactcgctttcccaggggcccccgcggtcgcaggggcaacgagcccggccggccctcgcgagcggaggcggggccggggccggaagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagagtaagggagctgcagggcgagggctgcgggtggacgctccttcggcccgccgctgttctgggctgggcagcgctcctgcgagagggacggctgcgcagccgtctggtgcgggacacttcagagcccttggggtgtgcgagggacgcgctctccagcgttactttcggggttggggtcccagccacggcgggtcaggctgcccgttcagggctcggcgtgtgaggcggagactctcctggggagcctgcggtgccccgcggggagcggcgtcccccttcagctgccccggggcttgggcggggcgcgcccgggaggcccagcggccccgggatcccaggctgcttctgtctctggcctcttggggatttcgccagattctgagcgttcagctctggaggacgctgatgtctgggttcctgtttcggtttcctgtttttcttcttttcctcccaaatcaacttttgcaagtttgggtgtctttcccatcgcgttgctataaccgtagaagggagcgaaaaaagaacttttcaccctgcgaaaataaacacgtgaatgtcattttatcattttccaggccttttatttatgctaagtgatatttttcagtgatgttctgcagtttccatcgcagttataaaggcttcaaaaattacagcaaatcttcaaattttgcttcacaagatcgaattgtctgattttaacttagaagtctatcccgaaataaacaaattgtgtttctttcagtaaaatattgaggccaaattaattgtagtgaaactctacttgaaataaatacaagttggcaatctgcttcttatctttggtcatagtaatctgtgtaagtgatctaagagagattggagcatgctgtttgtgattttttttttccctcatagttttcccaaaaggtggaacgttgcttttaaaaattccggatgaattttgcttgatttacgaagagagactaatgcctacaatgttagatgaattaggt

SEQ ID NO: 71182 - DNA, 3826 bp, Homo sapiens
gttagaacgttctcagcccccaaaaaagaaaccatgtaccgtgtgataatcaacccccagttcatgccatggcatacctgccctaggcaaccaccagtcaatctactttttatctctatgtgtttgtctcctctgtacacttcatataaatgaaatcatacgatatgtgctcctttgttgctggcttctttaacttatgttttcaaggctcatctatgttgtcacatgtttttagtactttctttttttgctgttgctgaataatattccattgtaaggaatggataaccacattttatttatccattcatcagttgatagacattggatttttctactatttggctgctatgagcatttgggcacatgattttgtgtagacatatataagtatattgtatataaaatgtgtgtacattgtgtgtatattttatacatatgtatatatgggagtggaaatcctgggttatgtggtaactatgtttaactttttgaggaactgccagaatgttttccaatatggctataccattttacattactaccagcactgcatgagggttccagtttctctacatccttgccagcctttattgtcttgattatattcttcctagtgaatgtgaaagctcattgtggctttgatttgcatttctgatggctaataatgttgagcatcttttcatgtgcttatggccatgtgtctgttttctttggagaaatgtctgttcacatcctttgcccatttttaaattgggttatctttttagtattgcattataggacaagtattgacttttaattcccaccacaatcctataaagtagatacaatgtcatctccatttgtaaatgagaaaactaaggcatagaaaagttaagtaacttagtcaagtaagtgacacatttagttaaataatgaatatcaggcagcttgactccagagcctgtgcccttatccaataccctgaactgcctcacaaatactttatatatttgtaaactgaaattactttcctttgacttcttttcttgcaggctggatagacttagtcttactttaaaaatcatccccccccaaatttgtaattgtctctttttgttcctcaacacttctgtgagaatcattgtatgtaagttataggaactctactaggaaactgtcattctcaacctgtactatctctgagggtaataagtttcatatatctgtcacttggcattaagtaatacatgttgattttttaaacagatgctgttgggctttctcgccattaagtaatacttgttgatttttttaagacttgctgttgggctttaagggcctcttctagataggattataaaatctgttttttttctcaactctcagattttataaaagggtgaaatcatctcttagtttttatcttcccctacagaagctttctaatctttacaatcttattatatgacagactccatctccgcagttgctctcttcggaacctctgtttaagttctattattgggcagttattttattgtttttactatacaaggttcttagtattttgggaaaaaccacaaactcagataaaacctctgtaaacaaaaattacaacctaatgagaaagggtatataataacttacttgcataaatagttagttagtatgtaaccagaagggagatctgagatttcacttgataaatagatcacatatagtcaatgatcaggaagaggtggaaattgaacgggctttaggagtgaactccacatactattttaagtgtttctgagcatggatttatacaagaaaagatgtattttctgtcttgtttcattcttaatttattttgaccctttagctacaatatcttattaaatttgtggctgcatagaaaattcaaaaatgatgaaaggtttttccccatgatcataactaatggagtttaataatgttactattaccttattaccttgcattttcttatactgcactcataatcagccaccttatgctccataggacaagtagagtcgtgattgtgtcatgttgggccatttctttccttacgtgttgtctaatgagattgttttggatgaagtagttgatatggtgctaatgttgagtacaggatctaacacaagtttaagtcgaataaagctagcctcaatttgtgtttttaaaatttcagttatttttcaaattaaaagaaatgttcttttcctttgtttctgtagcttttgccttatgaacagtcctctcttttggaactcataaagactgaaaacaaggtacagaatcctaaatctaaaaaattgttttaaaaatgttttagttatctgtaacaatttactttttattttgtttttactcatgaaactaggtcttaaacaaagtcatcactgtttatgctgcactttgttgtgaaatcaagaaattaaaatatgaggtaattatttgaattcttgtcttaaaactttaaaaacatcatttagaagcaagtatgtgtttatatatgtacagtgtgcaataaatatttattgaatgttgaatgaattatttatttaacgtaatactaatacggactaccattcattgagtacttagtatgtacaaaacaccaggctaacactgtaatccttatagtaaccccaggaggtaggtgagacattgatgaggaaactgaagcttaaagagagtgtcacttgcataacatcttactggtagtcaacagtttgaatctaggtttacaaacctccagagtttgtgttacctgccatatatactggctatctagagaaaactgatttttttttcttaaaatgcatttagttttgtgtttccttacccaagaaccattaaaagtctggtagaagttgacaaacttcgtattttcttctcctgctttttgataccatgtggttgctctttatttcccataaactaatgggaggatgtgggacagtgagggtggtcagataagatgaagtaaaggctaaaggaatcaagatacagctttgagtatcagtaatatttttgttactctaaagatgaattgctttataaacagattttgaatttaaatgaatttgtatgcaaatgatgtagccctctgtttattactaagtatacagatctaagagagcataggaatttggaaacaaaacaacctttaaaattattttaatttttttcttaaaaacaggctgaaactaaattttacaatggtctcttgttttatggagaaggaggtaagtttaaaattccaaattgtgatgcctttttgatattgaaatgaacaaaaagttaacagacaattttaggactactatgattatataatagtgtgagaaaaataagtattcatattttttgttggtatgtttggtaaacaggtaaaaaagctgaggaagcagcagcaaatttgtgatatctttgtactttacgaagtactgtaggtagatgagaattttccttgaattcattaaatagtgaagcaaatacttctaattatttgattaatgattgtctgatttttctctttggtgtaaaaattctgttttcaatactatgcagagtaaaagatgtcctaatgaaaaaaaaaaacttttcccccttttttggtattgattgagtttaaatttaaaaaatgaaatatgcttattcatgttgccttttacagctacagatgccagcatggtggaaggtgattgccaaattcaaatggggagatttatttcattcttacaggtaactgatttttactttctactgagcttttacttcaaaaagtttgagtaaattacacaacacgtaaaaagttctgaaaccttcaaat

SEQ ID NO: 71183 - DNA, 1071 bp, Homo sapiens
acttcagatacacactgtttctataggtttaaaagttgagagcttctgaaaatggattttcagaaagtctaggatatgttagatatgagctaattatttaatgacaaacatatccctaggataagtgatacgacatttcacttgctgtgtgccaagcctgcttatacatacgattacaggtgatcagtgtttgaagttattttacagtgacttctggaaaccccttcctgccatagttgtactttctatactggcagcttttgagctccttcactcactcagatgtttattcatgtaatagggtagaaatttattgagaagcagttgagtgttagtcactatgctaggcagtggatattcaaagaaggaatgagacagcacctatcatttaggagttatataagtaactacaatattagacttgaaataggagtatgaatgaaatgcagtgggaacaaagagataggaacgaccctggagtacaggaggtgagttaagtattgattgcttgagggatgcttgaacttgtctggcttttggttaactggaggctttattggaaaactgttttgtttttgttagagttgttaccataaaattcagtaaaaaatggtgagatttaaagagtaactttataatatatacccaccttctcgtttcaggaactgtcttgctttgttacgaggtgctatgaagtggtgatgaacgtagtccaccagttggctgccctctatatcagtaacaagtaatggattttagaaatatttttgcttttataatagagatgcagaaaatgttctttctaaaattaataacttgtaatagtttttctttcattcagcattctttgaacacttatgatatttcaaacactacttgatgtgtatcatacgtaggttagtaagatgcagtttccaccatggtgagcgaacccattatctgtctgaatgacagtgtctacagaacaatcttcaagaaatttgaccatatagaagaaggctaacatggaattagtacatgttctgtgttctctctctttattcctttcctctacacgaatggttgcctgac

SEQ ID NO: 71184 - DNA, 1609 bp, Homo sapiens
ttctcttcttgggaaagtggacttgacgctcttaaattttaaataactagagccttaataaagataaatattaaaattccaagatcatctgctcctgtatgtatttgaaataagaataaactatgacaaaaaggaagttttttttaacttggttgttattttattataggattgcacccaaaattatagagacaactggagttcattttcaggtaaaagacatttagcttgacctgtaaaactgtaattattactatattttactttggagtttgtatggttggagagtatgacagtcataggaacactcttaaagaggcgtgtgtgtgtgtgtgtgtttgtgtgtgtttgcatttgttctctttcatctgtgaagttgatgagtcattattgaccattatcagtgtaacttagtttttcccagtagtgccgtaatgcagattctctaaatgatgtctttggacagtgaaataaatctgcagtattgcaactaaggatgaaattttgttcatcttaaaaagagaaaagtattctctatttaagactaaaagacaaatagtcctttctgaggatccaacctgtagctgaataaattgatttacccactacttttactaattcagtaatcagcccaaatgattttactttaaacgtctacatgaggcttaacttctaactagtgactaaatgataatcattaaaggttttttgacagactatgtatgagcacttgggagaactgctaacagttttgctcaccctggatgaaattattgataatcatatcacactgaaagaccactggactatgtacaaaaggtacaccaattaaaatattttaaaatgtttcttactttggttaatgtatttgtgttagtaaaaagtaaacagatataaataatacagattttctaaaagacctggggattgatatttagaaggagctcatatcaaatatttttatgactacagtaaccattctttaatttcacatgagtttgttgggacgagtataatacatctgtataaagcatcctaattcttatagtagtagaaagttaatttgcctagcttaggactcagatttattgttttccttgggttctattcaggtgacagttttttcttctttttctttgttgagacagagtctcactgtgttgccaggctggagtgcagtggcgtgatctcggctcactgcaacttctgcctcctgggttcaagtgattctcctacctcagcctcccaagtagctgggactacaggcgtgtgccaccatgcccagctaacttttgtatttttagtagagacggcgtttcaccatgttggccaggatggtctccatctcttgacctcatgatccgcccgccttggcctcccaaagtgctgggattacaggtgtgagccaccatgcccagcccgacagtttttctttcctgagcttggttttattttattgtataccctgaattttttttagaccatggtttattttattcatgttctgagtacttattaaatgtctggtatgtacagattatgaggcattttgattgaagatgatattaaaaagcgtaagaaaatctattaggattgttgtgttcaaatt

SEQ ID NO: 71185 - DNA, 1017 bp, Homo sapiens
ggttcaaatgattctcctgcctcagcctcccgagtagctgggattacaggcgtccaccactgcactcagctaatttttgtatttttagtagagacgaggtttcaccatgttggccaggctggtctcgaactcctgacctcgtgatctgcccacctcagcctcccaaagtcctgggattacaggcatgagccaccatgcccggccaggttaaggtttttaagacaacccttaacaagtctgtttaattcttcctaggcccagggaatgtaatttgggtttgcacagtctagtatggtagcttctaactacatgtggctatttaaatgtaaataaattaaaatgaaatacaaaattcacttttttactcacgctagccacatttcaagtccttaatagccacatatagttaatgactagttatatcagacagcacagatacagaatatttccatcatcacagaaagttctgttggagagcgctgctttaagcaggttccactcgaaattgcattatattccatttataatatacttcaaggttacctttagtttatgttttacatgatcacagtttttaaccgattgatctcaactcttgtttacagttgaccctttgaataacatgcttttgaagtgtgcacgggtccacttatatacagattgtttttcaataaatgtattagaaaattttttgaacattagcaacacttttgaaaaaaacttgcagacaaatggcatagcctagaaatattaaaaaaacttgaggaaaagttaggtatgtcatgaatgcataaaatatatgtagatactaatctatttatgtgttaattgacttatgttatccataaggcttttggtcaacagtgtgctattactagttaagtttttgggtagacaaaagttatatgaagatttttgactgcacgagggtcagtgtccctaactttatgtttaagcgtcaactatatatcaatttaaatgttagttcattaggttaagaagataatttttttgtta

SEQ ID NO: 71186 - DNA, 1680 bp, Homo sapiens
ttcaattttattactttcacataactagtacccaaatatataaatacatatatatttttcattcacaaagatctaaatattagattagattaagaacctgagctttagttttagtaaaatttaaatgatgaatatagaaatttatcatacactgtatttagtgtatgatatttaaatgtttaatcgtttattattgagagtctgaatttctctttcaatgtttcctgtctaggcctgtatagaacaacaatttgattctctcaatggaggagtatctgtgtcaaaaaatagtacttttgctgaggaatttgcacatagtattcggtcaatttttgcaaatgtagaagccaaacttggtaatgtaaatcgcattttttggtttttgtttataaaatttgcatttccttaaaagcataattgaagtatatttgttctgctttctcttatgttattgatttgtaaggagaaccttctgaaattgaccagagagacaagtatgttggaatttgtggactctttgtattgcactttcagatttttcgaactattgataaaaagttttataagtctttattggacatttgtaagaaggtaagaacttgaaacttatttttcaatttgagcagattaaaaagattgcagataaaactaaatattttaaaatgcattttattcctgtttacaaaaataatttaaaagtattcacttgtaaaattcaagtattccagaaataagtaacttagtgaatgaaaatacgtcgtatttctacatcatattactacatattggtagatggtgttcagatttgttcctgtacaacttctcttagtgctactaatactacttttttcttttccttttctttgccactgattttcattactgaagatgaagaaatttaaaatatatttctttctatgtctttgctattttcataatgtggtatctgatttcaaaattgaaagattagtttgtgtgtaacatcaagtgatagtaactatgataacccagccaattttttaaaaaacttatgtacttaaatagaatgaaactaaaagacatgaagattcaagtttctattgttgcatttttttatctgacagtccatgaaagggtgttttgtgtgtgtgttatttaatattcaggtgaataaaattgtcatgctcaacaccagatgtagaaatgccttaactctgccacagtgaaagatatttgtctcataatatattaataagtattttttgtggttattttttcttgaaatcagttgtcttccatgtgtattatagaacttttaaacagcttgttgtttagcctgcatttaatgaattttccccttttcccttttctgtttcaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaagtaggttttataaacaagtataatgaaaatatttagatatcctttattttcaaagattatactaacacttaatgtatagtaccatttgaattataagattaaatgtacttgataagtaagggtcaggcaatctccaggagatttgttttctagaagtttttt

SEQ ID NO: 71187 - DNA, 1317 bp, Homo sapiens
ccaccaccacgcccggctaatttttgtatttttagtagagactgggtttcaccacgtcagtcaggctggtctcgaactcctgaccttgtgatctgcctgcttcagcctcccaaactgctgggattacaggcgtgagccaccgcgccaacgcctggctaatttttgtatttttagtagagacgaggtttcattatgttgggcaggctggtcttgaactcctgacctcaggtgatccgccacctcggccttccaaagtgctgggattataggcgtgagccatcacaccaggcctctttttaaaattgtttttattttttatttttaaacttttaagttcaggatacaagtgcaggtttgttacataggtaaccatgtgtcatgggggtttgttgtgcagattacttcataacccaggtatattccatggaatttttattggtcagatcatagctggtgtttggtggtgccatgttttgagagggtcacaaactgcagcatccctagatgcagctgatcaggatgtcagaaggtctgagaaccatgccttcttgtttgtcttctctttgttagtgtctgtatagtttggcctttaaaagagaaatctgtggaatgatgtggtgggtttctttaaatatttgagggacattcagaatgaagagggaacagatttgatctctgtggctccagtaggctaaactaaaaccaaaaggtgaagatgacagatagtaatgataataattgccaacatcatgaagctctcaactctatggcaggcattatgctaatagctttaaacataccatgttccataaagcatgtaacagccttccggcagaaaataataaatgtaacaattaatgtttatggagtgcttactatatgctagtaggtattccaggaacttgacacatacctcctgtaatgatcagaaaattgtatgaggtagatacttttgttgccattttgtagatgagaaaaccctacagagattaaacttgcccaagtttaaacaactagtaggtggcagatgcaggcagttcaactctacagcccaggctgttaactactactataaaccatttttatcccatttttagataaaatgagtcttagagaaatgaactttgccaggtcacacagctaagtacatgtcagagagggcattcaaaccagtgccaatcctattctggtgcctctgcagcaggtagcattgtgtaggctgctctgtagtctccttcactaaagctgtgtaggcagaatatagataactgtcagtccaagatctgtgggaagtgagtcttactaagtggacagttg

SEQ ID NO: 71188 - DNA, 1662 bp, Homo sapiens
tgcctgcctcggcctcccgaagtgctgggattacaggtgtgagccaccatgcccggccacatactaagttttttaaagaaaagtatagcttaaacagcttgtgaatgtaaaaaggttcccatctggaatgagactgagttgggaaacattgatggagagatttagtatttgtaatcatcccgaatagtagagagaattacattttgtattgccctagtctttctgggaggggaaagcttcctggatgtgagcttgaatcttggctgaacttatgatcttgctgcctacttaacttctctgtgtagcagtttcttgttctgtttggaggttgtagtacctgcctcataaagttaatgtgaggggtgaaagaggtagtgtgtgtgtgtgtgtgtgtgtgtgtgtgtgtgtgtgtgtgtgtaaagtgcttggaatggtacctgtcatgtagtaagcattcaataactattagcttttatagtccgattctgaccacttccactgttcctattctggttcaggctgtcatcctctttcttctgcattattacagtagcttttaggtggttttcctgcttttaccattgcctcctctgtagtttattttcaactcatcagatcctcttgaaactaaacttagatcaagttactttgctcagatcctctagtggctttctgtctctctgagtcaaaatccctactccttgtaaggccttccacaaatcccttccccatcaccccactccctccctctgtatctcgctcatctaatccctgctcacagtgcttcaggtatactgacttttttgttattacctgaacaagccagacacatttccaaatgtcttaggattttgcgtttgtctttcacttttctgcacttctcgtatatttgcatgaattactcattcatctgcttcaaactttggctcaaaatcacctactcaatgagcctactttgatcatgctatataaaattgtacctccaccccagtccttatcctttttcccctgcttttatttcttctgtagtatgtatcttttaattaatttaaaattttacttactgatttcattattatacagctctcctttctagaatgtaagcatcatgggaggagggatttgtattcattttatttactgctgatttcactgttgtattctcagtacctgtactgagaaacagtacctgggatgtttgttgaatgagtaaattatatatgtctatgtaatatttatcttttgaaaaccagaaagatgaaatgactgctgcagggaaataatgtactgcaatcagtatcaagaaatggaagtaaattttctttgctgagtaaccccaatattttcctttgttagagatgtacagtcttactacgtctttgtgagctcatggatgatgaaaatggaatctattttgtctaaagagcagagaatggataaatttgctgaagatctcaccaatagatgtaatgtttttatacaggtagttgcatcttatttcggggaatcatttttttgttaatccaacttacagaagttaaactttgaaaaaactgaacaaagggtagagtatgtttttgtttattaaagcaagttgatttggttatgttgggatctgtgtgacttattaatttaaattttctaacaacccattcaaagctc

SEQ ID NO: 71189 - DNA, 1411 bp, Homo sapiens
ttcctttattccactgtttcactgagtttaatagcattaaaagaattttaacacctcacaagacctggcttccttcatgaatagaaggggagggagaatctgttctcattgggctggaaggagagaaagcctaatgcagcaccaaactaggcaaggatgagatagcagatggactgtggggattggtctaggtgaataggaaagggggacttggcttggaactcaaaaatttctttgcctatctgtattgactgaagaacagccctctttctccttatttttcaatttgtaactcctcagagtcctcagctcttgccttaagtggcaacagataggagtctttattctcttccctggcaggtaagataaggatgaatagatacctttctaacattcaaattgtttcactcaaagcttttttaagggaaagattcttaagctgtaattatacactattattttgacagtacaaaacttctggtatgtgacaggataaataaacggttagggctgctttgaaacttaaccaccatgtataacattgtctctgtgaggaagagtatttccaaatcttaagagctggctttaagatgaactttagaaacattagttattggtaagttgaggaatagctgctgttaaatagataatgaaatcttgaagaaaatctttccttgtgattataatcaatgttttcctttacagggcttcttgtatgcatatagtattagtaccattattaaaaccacaatgaatctctacatgtccatgcaaaagccaatgaccaaaacctcagttaaggcattgtgcaggcttgttgaacttctcaaggtaggttttagattattttactgctccatcataattgagaaatgacccaggcttaaattaggataatcttgtaaggtttgactacatgattatatgagaacagaaaattgtgagaaagtacttctctctcaattgaataaaggaactagccatttaaataaatttctgagtaactacttatggctggtcattatatttaaactttattaaataaagttaatatatccagtttacacagtaaaaaaaaaagttaatgtagtgagagagaaaagaaagaaaatggaaaagttaactttaatattatcagtaaagctttactcttggaagttttaaaaaggttgcatgagttaaaaaaaaaaaaaacagcttgtctaccattatccattatagtgtttacatgcgtatgaggttagttaacataaggctatttattttgtaatttagatgaagtgctgtaatcttgtgatttgaacagtggactacttacagaggtggtcaaatgaattaagaattacagtgcacttatgcaagtatggtaacgtgtttcttagcttacttctgtattaaagaaaaaacctgt

SEQ ID NO: 71190 - DNA, 1816 bp, Homo sapiens
tgctcagttgcccaggctggagtgcagtggcgccatctcggctcacctcaacctccgcctcccaggttcaagcgattctgcctcagctacaggaactacaggtgtgcgccaccatgcccggctaatttttgtattttttagtagagacagggtttcactatgttggccaggctggtctcgaactcctgacctggtgatccacctgcctcgacctcccaaagtgctgggattacaggcgtgagccaccacgccaggactgtaaggtttttttgtatctcatttacaaatcccttccctagcctaaggtcgtaaagatcttctataattttgcctgaaatttttaagttgattgtcagaaaattatttctgattctttttaggcaatagagcatatgttctacaggagaagcatggttgtggctgattcagtttcacatataacacagcaccttcaacatcaggctcttcattctatttctgtggccaaggtatgcagcttattatgtatttagcataagtatgttatcttttttgtttgttctttcattgttttatatgtgttttctggtttaacctgtttattccattccttcaaacataatatgctcggttatttatctccatagtattttacaatttttacttcaagttattggcattatctttactgtgaaattgcagcatgtaatacattaatacacttctaaaaagacattgcacttttgaaattgatgcatcatttaaaaaatgatttcttagtaaattaacatggaaattttaaagtatgcctaatacatttgctgtttctgacagtactaagggatcatattacagaagtaaagtataaatgtcagaagcttaaatggggaaagtatttgtgtatgctctcttaaattgaatcatggaaaagataatcaagaagtttttcttctgagtcttttgttactgcctcagaaacaaatagttttcctgttttatttttaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatggtaagtgtattgctattacttatggaacagaaatgagatctgagatttcacagttcccttgttactgaccctagaaacctttgactgcaacttctctgcctttttttcctgtccctgatagaaaacatttaaagatgaagaactctttccacttcaagtagtcatgaaaaaactggatcttattagtgaacttagagaacggtaagtaggactgggatatgctgtggtactccaaagacagggttaatagaaacattgattttctttttagcatagcaagagaagaaataaaattcagatcgagcattagttcctttctgtaacttctttagcatgaccaaaatgagattgtgactagggatcatatttatttagctttgcttctacaggaagcatgtagcccctagaaaaactcacatgagaaaaagcagtgcaacctcagagcatctggccgactttgatgcatatcgtgattattatgttgggtatctttattggacttaaattgctgtattataacagggcttcctctatttgtgtgagacttagcaatccatgatacgtagtgttctatgattttattttaagacacgaatttgaattaacattgttgaattagtttttggaaggcttatttttgtagctccttctggctttcttgttttctttttgttgagtaagcgt

SEQ ID NO: 71191 - DNA, 1027 bp, Homo sapiens
ataaacttttaaaattgactgttttgtaaactgcatattcataaagtgtttatagtctgtagttaaattttatgttactgttaacgaagttaatttatttaatttcttccttcatgttcctaatcattttcatttcacttaattttagtttatgtcatagtaatctgacatttactcatcagcaaattacaatgcaaaagaaaaaatatttttaagaaatattcatatttttctttatggaaataagtgtgtttaaatgcacaagataggaaaggactagcgaatgtgattttttttgggtatatttagttaaagtatatgctttaggttctttttctttaggaaagttaagacagttgtggaaaatcatttttccttcagatcgaggttttgtctttcaagataattaacttttgcagtattgtttagattagagacctggtttttctaaattcatgtacattttaattttcttcttagtacatgttcagtgctttgcgcgactgtgtacctgctatgatgcatgcaaggcatttagagtcctatgagatacttctggattgctatgacaaggaaattatggaaattttaaatgaggtaacatcatatttgagattgaaaagcttaaaacatgtttggaatgtagtgtttggaaaaaaaatgttcgattgaagcagactcactgagttaaaattatttataaattgctgggtagaacaaagaactatttttagttacaatatcactgttgtgctaattggtctgtaattcatttatttagaaatcacactaggaattaggagattttaaatttacttttgtaaatagatattttaatttaaagttgtttattagaagaatgcaaatgtgaaatggttttgaatgttgaaagctgctaatggtccagttaaagcaacttaaccattaatattttactgaattttatttgcagagctcctgagagaaggaaattatatatttaaaagatttagtgtgtaacaaaagtaatttgaatccaatatgtatg

SEQ ID NO: 71192 - DNA, 1166 bp, Homo sapiens
gagggaggaattaaaaatgaggaaatttcacaatataatcctacctgggtttgatgaaattgtgaaaaactttttataatttcttgtattacgtattcttatttaggaaataaaatacatgcctggatagtaatttagaactccttggtagaccagaaaagatgattaattttattacctttagcacaatgaattttgtgattttttttttaacagttattacaaggaagcttttttcttttctctcttgcctgttctcatgccctttcctcctttgttgctggtttccataaattttatgctttaagttgcatattcatgttccttatgatggtaccatcaatcattagttttagattttcttttcaagagtattaaccttaaggtattggtgaaaataaagacttagaatttatgtaactgcttctgaccaaaaaactattggtttaaaatggagcatagacatgtagggaaacaatacaattgcaatatcattttgaaaaattaaagtatcaaatcttttgtgaatagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcggggtgagtgttttgctttccttcttagagtcatattctcttttttttttttttttaccctactgttaaacaaaactttgagggtatatttaaattttgtgttgttattctttaattacattttgtttcttttctcatttttattaataccttattttaaaggaacaaatctgatgttcaaggacaagttgttgttttttccttttaggtttcatttcttttccttttctactgtttcacaagttgaattttttttttttggtagcttacgtaactcactacctagacaagactttctacaatctaacaactgtagcccttcatgactgggccacttatagtgagatgagaaacttagctactcagcgttatggactggttatgacagaggcacatcttcccagtcagactttggaacaggtatagtataaaatgttttttttagcatactgtgactgttggctgtaac

SEQ ID NO: 71193 - DNA, 2432 bp, Homo sapiens
aggattttaagcctggttatagtatataaaatttagtatcttaggaaaaatggttaaatttacatgattacaaatgtgttttttgttcttaaaatgaggagtataggaaaacatttagctttgctaattcaattagttaatgtacagtatggcattgtctcatgaatgtaataatttatgttatcagataatttgcgtggagttctctttaagatgatccagataatatttaccaaaaaacatttattcagttctaaaatttgaggattctagttttccctttatcttgctgcatgtagggattatttctaggatcagtttgtatatcctttcatttattttgtatatcctttcatttattcatttatatatctgatatttattgagaacatgctaggcactgaactatgtttaggaatacaaagataaatataaatagtcccagctcatgtaatatcctctgggagaaaaaatgtgtaaacaaatttttagattagaatatgataaaagttataataaaaacttaaaaaggtattgtgatgctcctttgagctctaattagaaaaaactatggaacagtttatatgataccattgggtgttagagtaatatctatttaaagaatgaaggattcttaatagaaaacttgtactatttaaaaggggtctggtgtgatcaaaagaagcataacagtttggaattagactttctaaagtcccaaggccctgctgctgcctagctattttgcctcagagaacaacttccttagcttcttttttgtcacctgtggaatttagaagaatgatacctcatattttagaattacatataaggaaccttgcaaagtacctgaaaaatagtatgtattttatgaatgtcacagcacattctgactaccttttagaatctggctactagtttactttgtagaaaaaatgtagagaagattgttgaagagacaaatattctcaaggctggtggggagatgactgtgggtcatggatcttttaatatttaaacttaactgttcctgtctgcacaaaagataaagtaataagcagccaggtttccctaaggagatagtcttgatttgtcttttaacgtttgatcgtaccttttatatagttctttaaaataacttaaaaattattaggaaacagtataatcaataagtcattatgctgatacaagtttaactgattattttaatgaattataataaaacttgtatgtgtattatgttgtagggccttgatgttttagaaattatgagaaacattcatatatttgtgtcccgatacctctataatctcaacaatcaggtgagtagggtttataaattttttttttttaatgtaggtggagatagttggaaggctgaggggcaaggaattgatttttatgggtgaaaattaaatgaaacaaaaaataattgttttcgaggccttgtttatttttttgccttgattataccagttgtgtatcttttattcgaaatgtttaggacaagaagtgttttggatttcagatttttttttggattttggaatattcgtatcatataccacttgaggatccctaatctgaaaatccaaaatctgaaatgctccagaatcgtaaacttctgaccaccaacatgacgctcaaaggaaacgctcattggaacattttggatttcagattttcggattaaggatactcacctgtactgtcttgattgcattttcaattaaattgtctttaatgaaatagattctaaaattttctttggatacctgtttgaccagtgtttgctatgggttgcgttgttactgagcataaatttgtttcattgcagatttttattgaacgaacaagcaataacaagcatttgaatactattaatattcggcatattgctaattcaattcgaacacatggcacgggaattatgaatacaactgtaagaacttttctttgggggttgagtgggtaatagacccgtttaatagcttggaacgtggttttctcatagaatattgcggtaaacatacactactagtttatattttacatgaatttccattttttttctggttagtaattaaaatgtctggtcctaaaattgtgttggatgtgatgggagctgtgatacaaaagacactttagggtagattaccatctcagagccatcattataaatagtgctagatatttgaggacatcagcacattaatatatgtgtgtgcacacatatatatatgtttatctgtgttgatctgtgatccctgaaagtttacttttgaaagtcaacaatagatagtaatttacttaatgttatttatgccctttttggggcagggtttgctaattatttgatgtccatataaataggaacttactaaaaatatattgaatcttcttagaaatgggcattcaccgcttggcgtggt

SEQ ID NO: 71194 - DNA, 1029 bp, Homo sapiens
acacatcaaatccagattgattaaagatattcgatttttcagggaaattaaggaccaaaatgatcataaggtaggctacctattctttttaaggtatttgattaagctattgagtatatggcaaatgtgtatgctaaaattcattatttagatctctattggggttttagttttattttccctataatttcttactctgcattatctgtaggcttaaggtaaggaaaaaattaaatcataaatgtagccaggtgatactttttctttattttaaaataatataaaagcaggacatgcttattttgaaacatttaagcaatatagaatggataaactgaatatccaccttcatttctctttccattccattttctggaggcagttgctaacaatgtagtgtgatggctttcagatatctttgtatataaacatgtatatttacacacatatattgcttttaaaagcagtatagtaaaaatggagtaatattatacatagcattttgcactgtgctcatcacgtcagtacatacagatctgcttcaagttgatagggatacatccatgtatatcataacttatttaaccttcttctgttgaccattatttaggtttttctaatttttcattcttacaaacagtgctgcagtaacatctttacacatctatctctggaaatctcagactttctgaaaacttccttaaggagaaatttctaggacaaggaaatgtgaacatttaaaattgtggtacatattgcctagcactccaaaaacacttcactattgatattcccactgataatttatacgaatgctgctgttagcagggtgcagtggctcatgcctgtaatccagcactttgagaggctaagataggtagatcacttgaggcaaagcatttgagaccagcgtgggcaacatggcgaaacctcatctctactaataataccaaaattagccgggcatggtggcacatgcctgaagtctcagatgctcaggaggctgagtgtattagtctattctcatgc

SEQ ID NO: 71195 - DNA, 1103 bp, Homo sapiens
atattgtagataaggtgtttgttcttgatatattttgagataaaatatggaagaaaactattaattctactagatttttctcaaattttaagactgcagcagacttctgaaaatatttctcttaagttaatttatcaatatggtttatgaatgcatgtaaagattacatgattttaaggattaaaatattcatatctaaaattcaatttggaactaaagtggtgatatgaataatattactgaaatgcacagttgtttccaaatacatagttgaaaattttagagtcctgcagtaccacttttatatctgtgtcaattgcacatattttacttgacctaataaatgccttcccaaattcttatgtagatttgttcctgatcttgaagatattgtaaattttgaagaactagtaaaagaagaaggtcttgcagaagaaacattaaaagcagcaaggtaatctaaatttggaaatataaaaaagtgtgtttataaaaaacattctgaagagaagaccagagggtaatatgtaatttttatgccactgtttttattatacaaaattatggcctcagtttatgaagtataatttttaagacttcagtattctaagacctttccagcttctagaacatgctgtccagtatttcagccactagccacacatggctcttgagcacctaaaatttggctggtccacactgagatgtgctcaagtataaagtacataactaaccttgaagatttagtataaaaggaggaatgccaaatacctcaatcataaaattcatttcacctattttctttttactttttaaaatatttctcttcaccaacagtgttctagaatgccagtcctttcttatatgtaatctatagcagcactgtagccactaccatatatggccggtaaacacttaaaatatggcaaatgcgactggggaattgaagtgtaaattttatcttaatttaaatttaaatagctaatgtctgtcttattgaacagtgcaggacttgagtcagttgtgcatttgtcccataacacgagaggcatgcagaattggtaagaatatgtttagaaaactgtatgttttattcacactta

SEQ ID NO: 71196 - DNA, 3020 bp, Homo sapiens
gaagagctgaattttcaagagacgtactgttttgaggattcacacttaagaacatgaaaagaaatagtattttcgaatgaattaggtaggtgtaagtaaggactgtcttgcatatgtttttaagagtacttgtgctttgaaataaagcaggcctactttgctaactccagcattcacttaatatatgactttgggtgagataataaatctcccaagcctcggtgtccttctctgtaaaatgtgcataatattttataatgagatatacaaggcactgttcttgggctaagtagtgattgagggagtgcccatatttaaaggacttggaaaggagatccatgaagatacacttgtatagattgtatcttcaccaagagggtacctaaggcaaatgtttcagatgaaaaggacaggaatctagattctattctattctatttatagtgattctatttataatttttaaaatgtctgttataggaattctgaagattttcttagcaaaattgtttttctaacatgttgttacatctttttagaccctcaactttgtagagcattccattagttgcaaggaaaaattaaataaaaaaaataaaattggagctgcctttactgatgatggctttgccatgggtaagcttaatggaattgtttttccattaattttatattgaccttgtaatggattcttagaaacatctgcttgagaataggtctatatgttctttatagatttttctttcttttttcttttttatttttttgagacagagtctcgtctcgctctgttgcccaggctggagtgcagtggcacgatcactgcaagctccgcctcctgggttcacaccattctcctgcctcagcctcccgagtagctgggactacaggcactcgccaccacacctgcctaattttttttgcatttttagtagagacggggtttcactgtgttagccaggatggtctcgatctcctgacctcgtgatctgcccgccgcagcctcccaaagtgctgggattacaggcatgagccaccatgcccggcctatagatttgtttttcatgagtgttgtttaccgtgtttttagctggaatacatgattgacgatacttgttttctgtagtttataacttattgaatgccttcttagtattgctaatcacttgtccactttggcctaatatttaggctttgtttttgttggggttgtacagttttaacgtcttatatttagtttctctggtttccttgtagcttcctcaattgccatctttttagcagttgaagtgtttttttcctttctttttgaggcagggtcttgctctgtcacccaggctggagtgcagtggtgcagtcatggttcactgcagcctcgacctcctggacccaagcgatcctcccacctcagcctcccgagtagctgagactacaggcatgcatcgccacatctggctaattaaaaaaatttttgttttttttagagacaggagtctcactgtgttgcccaggttggtcttaaactcctgggctcaagaggtcctctagcctcagcctcccaaagtattgggattataggtacaagtcatggaaagttttattctttatgcttacagctatatcgtttctcctggtgatttatatggccatgttagttatttattttcttcttaattgacttgtctttagttatacttctacattgtttttaaaggaggaattaagccattttgttaaacccatcattcatttatgctgtaaaatgtaacttgaaacgggacaaacttaaaatgctaggaattattactcagaatgcttagtgttgggaattattggtgaaggagtagaataccacttctgtactcactgtaatttaaccttagttttgcttatgcctgcaggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggtagagaggagcctaagagtcacatctgctttgacttaccatttgatatccatgacttcttaatgtctgaaaagcagaagccatatagaaactaccattttcacaagtgagatgaatagtggcaaaaagattatattttaaaatgagtgctatttggaagccatttgactcacatcttaaaaatgggcgggttacttatttcagtttctgtatttatgatttccactagagcttttaaaaataataataagaggcataaaaatgcatatatttttggtattttgccataataagtatttttggtttttatttcaaatttttaaatttacttaggaatttgaattgctgtatttctcactgagcagtgcaagaattttcttcagagcagacaagactgcggctgaagaaaaccaagaaaagaaagagaaggaaggtcagtgagtggtttaaatttggaaagaccaataaatgtctttagtaatagacagtaatgcaccattttatctggtcagacatctagcttctttgtccttttggaaaataacacagacctagcattaagtcttttaaaaaaagtaaagcctgtatagatcttgtgtgaaattgaaaaggaatttatgtagtttatgcatttcacacttggtaaccctttaaaaccttgttcaggatcatctgcttttaatttaaatacacttttcacaagtttggtttttctttcatggctcaaactattagatttgaaggaacaaatagaggaggacagctaaatgttgctgaaggcagagctgctgatgactagatgttgactgaatgagatgggacagatgattaaagaactgtaaaatcataggggctatttagttgtagtaaatagcatcctgccttctttcatagtcaggccctggagactcaggcaatatag

SEQ ID NO: 71197 - DNA, 2708 bp, Homo sapiens
actccaccttcattaaaaaccagtggaaacaattgcagtgtttagcctagatttttaaaaattttaaagtgtaaacaaggtataatttgtgatgttagagaaacatttgatggatgcaactgtaatttgaagtttggcaatacagctcttctcaaatttcttttacttcttaatttattgtttaaaaatgaacataaatatccattattattttcactcatgctttcagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagcaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaattgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaatttccttcccctggatgtttatgttcaaaattgaatgtcgtaaaccagtagttcttaatattaacctttttggggtcccccttaattgaatgaaatgaaatctgtggaatcatttttttataaaatgcatgcacataggtaaaaatttgaagtttaaaattggctcctgtcaatgtattccaggtgaaagaaaggtgttttctttcctttat

SEQ ID NO: 71198 - DNA, 1072 bp, Homo sapiens
ctgtgcctaacttataaactttatcataggcatgtatatataggaaaaaaccgtatatatacggttagatactatctgcagtttcaggcatgcactgggcgttttggtgtatccctctcagataagcagggactacagtaatgacaacagagccttcaaaatattacactggagacgaggtacaatcctgttaaatactacactgcagaaatcattcttggtaaagttaagtctggttgctgttccttttttcttctgaggcagtaaatttgtaaaattgtgggaaagatgagaaaatattggatacttcatgttattattttatgctgagtctgctaaatgtaaaaggtaggctttaattgattttaataattgtaacaggattttctttccagcttcacattgcagatgtttcagaagacggtattcgttttttaagggaagttttaataccacattttttttttaacaaaggctttcagatgttaggaatactttaataggctgtcaaagatgtgaagtttaaaaagggaatccagaataagtggaaatctgtagagactaagcaaaggcagtgaactcaagagatggtgatggcaaagttagagttcagtttataacacaggtcagcatatatataatgtataagaaaagttgggcaagtaagtattttcttttcagtagtttggctcctctttaccactcagttcacctgatacctccatttcccattagtggagatatactcaggaatgtacatcaaatttattcagtcgatgcagatctgataccataattcttggatcatctctaaggactataaatacattctgtaggtaagagtcaagcattctttaataatgccctcatttgatgggggaaggagttaacttttatacctagaagcacttgtctttatcagattagtattaaagtatttactcttttcagaatctgtacaaaaggtagcaaagtattaaggatattatgctttaggttgatactgctattgaataaatcgtcaaagcttaatgtattgagaaatatttggagattgcttagtatctggttc

SEQ ID NO: 71199 - DNA, 1589 bp, Homo sapiens
ccatattcaatctgcatattaaattgtgcagatataaatcatttccattattgcagaaagttctgtacattgctgaactagaagccccctgggggcagggactatatctgtcttgttcaattacacaaactaggctctcaaaaatttgctgaatgaacaaaagattaaaagctgctgaaagacagggaggtctcagaatcctcatttcttaaaagctcccaggtgacgtctgtcaatgctgtggggcatgtgatcatactctgaggagcaaggccttagagcagcacacggtgggtacttatctatcatcttaatctgaaagaggaaatctagccaactagtatgcaagcaagaaaacagataagcaggagctccagcagtgataagaagtcctcatgtgttaacagtgaacatggaactagctgatcaaaaacctctggtggttagaatacttttaaaaggaaatcccaaacttggccacactttccagtgaacatcacttttctttttgaaaagactcttggtatgtgtacacagatgtgttttgagtagctactaaaccagcgctagaatgcatcttaccttctgaacctcaataatttcttttcccaaattaatagcataacatatctgcaaaagacaagaaaagtagtgattggcaaaagtagagaaggataaaattttagaacaaatgtgatttgggagtacagtgaggtcactgttctcactgttcccacttgggaacacaggacctggctgcaggagactcatcacatagggcccggggcatttgcgtccaactgtcctgacctctgttgccaatttatgccacacaaaaaatattccaggtaagtgaaactcaggtaattccagtgttaaaagttcttaataggaatttttcttctctctcttaaatgtatttagccacgatatgtccatatacacagtggcaaacagataatttactgaaaggattggttaattgtgataaattctaagtagcagatagagtcaaaagtttttcatactaaaccaacagcttgtgtgtaacttttctaatatcttccttggttttctctctgagactaaattattctctattgtagcttttgccttaattttttttaaagaacaaatttgaggggaactgctttcaacatttccttatatcccgactaaataatatgtcttgccatgaaatttcttcctcattcaccctattctggttgataggtattttccacagagaaatttaaatcgagttttctttcagtgaggccttcttaggaggtattatctgaactcctggatggagacatgcagaataatcaactaaatatccaaggaagtaatgccagaaaactcttttaaaatggacttgtttggactgggatattatgggatcttcacatgaaaaagagaccttttcgccttctgagttgctttcaaaaatgtatgtactcagagattcttctccagtggattcaggaacacggatgacaaaaccaaccagtctcttgttttcttgatgagcagcaaattgtgtgacactggtaagttcaaactggggggtggaaaaaaaggcaaca

SEQ ID NO: 71200 - DNA, 1006 bp, Homo sapiens
tctgtttgggtaagttgcagaatcctgtgaagttaaatcttctacttgctatataatcttccattataggtaccctgagctttagctacacaggttccttaaaggcagaaagcaggacacgtggtcacacacagctatctcgcctcaccctctaacaggctttatctctatttcggggaatttgtatttattctggacttctacaaactcttctaggaatattaaatttatccaacatttgtgacataatgtatcttttaaaatttcaggttgatagatccacagactcaagtatcaagggccaatgtaagtaccgcatacaggttcatgttagtgattactccttaattcacctttgtatctaccttaaacacagcctaggcactttattaataaagatctgccactaataggactaataggatactttttctcatgacttttccagagagtagccttgtcagtttttaattctagtagttgtatgatctgttgcctttttttccaccccccagtttgaacttaccagtgtcacacaatttgctgctcatcaagaaaacaagagactggttggttttgtcatccgtgttcctgaatccactggagaagaatctctgagtacatacatttttgaaagcaactcagaaggcgaaaaggtctctttttcatgtgaagatcccataatatcccagtccaaacaagtccattttaaaagagttttctggcattacttccttggatatttagttgattattctgcatgtctccatccaggagttcagataatacctcctaagaaggcctcactgaaagaaaactcgatttaaatttctctgtggaaaatacctatcaaccagaatagggtgaatgaggaagaaatttcatggcaagacatattatttagtcgggatataaggaaatgttgaaagcagttcccctcaaatttgttctttaaaaaaaattaaggcaaaagctacaatagagaataatttagtctcagagagaa

SEQ ID NO: 71201 - DNA, 1050 bp, Homo sapiens
tgctctctctgtgatggccaagttatttaggcagatttttaagtttttttccattattttttataaatagtactctcagaaatgaaaaaaaaaaagcaaaaccaaaaaacttccattttcaagctctgagctataatatagagaataagtctagtgtgatggcatctttgtgaacaacagtattcactcaccactggatttttgaagataccagttcttgtctctaagggagcactttctaggctatctatcttatgtaaaaagtagtgggggcaaaagcaagagtagtctcttcattccagtactaacatttcagatgggtgcattagccttaaaaggggaattagctgaagccataagaaagtctgaaaataaaactgaacgtacctcaaagattgactggtgaccatcagatgggattctgtcatgcggaagatgttatgaatagcccgagcagccaatacttgtctcatcgcttcataaatcacttcagtagtgctgtctgttttaactgccattgatcccaaaaaccgaactataaacatctgctgcaaaagagaatctggaagacagcattttccactcaggatctcatttacttcctgctgctgttgatctgcataccagggtcagatgtgctagttttgcctgctttctgtggaggactttctaccaaaatttctcaataccacttttataagcccaatattgccaaagctctgcgtcttccatttgtctacatcttgtcagtttgtttggaactacttcattagactagaaaggcttttcttcatctataaaatgaaatgatggtggtaccagatgaacatccttctaatgctgaaactctaggtgactacattgtaccttttctctgaaaagagtgagttcactagacaatagaaaattcattactttggcccactgataaagtcctcttagaaaagaaattttatttgcaggatataagatctcatgttgggtctcatgcaattcatacttcatgtgtattacggaaaggcagtgatgatgtttcatagcctaaaggaa

SEQ ID NO: 71202 - DNA, 1069 bp, Homo sapiens
taatgaggtttgtcctctagcttacctgtcttaaggccaccaatggtagagtccctcatcatcccagtcaaatgtcagaaaagccaaaatcgagctgcattaaagaagaggggctgaccaggagcagtggctcacacctgtaatcccagtactttgggaggccaagatgggtgggtcacttgaggccaggagttcaagaccagcctggccaacatggtgaaaccccttctctactaaaaatacaaaaatgagctgggtgtggtggtgcatgcctgtaatcccagctgtttgggaggctgaggcatgggaatcgcttgaacccaggaggcggaggttgtagtgagcgaagatcatgccactgcactccagcctgggtggcggagcaagactctctcaaaatgaatagattagatagataggatagatagatagatagatagatagatagatagatagatacatacatacatacatacatacatacatacatacgtagagagtgggggaatatggaatgtccaagcccaacgttccttacctccagaagagagagaatcctgaggtgctcatgtggagaaacactggccccctgtttgcttctgattttaaccttgtggttgccgtgtctcctgtaacacagtgcagaggaacacctcctctaaattgtgatttctcagatggatgggccccgttgggcagattgtgtttaggactttgtaaccaagactgtcactagtgggtggggtggcctggtgcggtctagctcagtaggggaaaagggcagccaccatttccacacctcagcacacacctccatgaaagccaggggctaatgtcccagagccaggccatccgcccacttacccctgtgtgggcagcccttggcctgctagcctatgaagcctcagggcagaactatggctgttaaaaaaggaaaagcattgcctttggctttgttgttgcaccttagtaccacttcctggtcattttcctgtcaccaccactcctgcctaaaccaagagcaggggaggcatgactaccatttcattccttcctttatggaacttgc

SEQ ID NO: 71203 - DNA, 1053 bp, Homo sapiens
aaatttaaaattacaggaaaaatagcattcaaaacagtactttagctatctgaatcaagtgctgcaaggttcagtttggaaaccccatcagctgcctgtcaccccataactaaatacagcttgtcagacagagggggtaactcacagaaccagccccagcctgcacagagaaggccatgtagcccgggcgcagaccctgacgttaatgcccgggttgtggttctctcaggatggctggtgctatacttgggttggcctaataatggttaatggaaatgctgacaagaagggaagacagaggctctaggatctgcagaaagaggaaaccatggcaactcacacgcatgggcacaaatgtcctgctacccattcagaaaataatcaggtgtgtgaaaaaaattgaggcatagatggttcttccagaaacacagaagtgcgaggaattctgagagttaaagcaggatgaggaagagacagtgaaagatgagggacagaggatacttttacaaagtgaccatttaatagcctctcatcttctacctcctcctaacattcccaggggctaagaaccaaataaattaaaaggcaagaaactgcaatcagatttcacaagttggtttctagcataattataaataaaagctacatcactcactgctgccaattattcagagctaaacagctcagtgactttcaggtaggggtatatgctctcaacttgctttgcatctgtctcaatgctcagcactggtttttcttgggactgattatttttggagcatttcagatagacttctacctagatcaattcccttgtttagccttcatgaggtgtggtgaaatgcaacatcttcaagaaaatgagcaactttctcttcgtgtatccacatgaaataaaattcctattcattatttccattttgtctatttgtcaactacacacacacacacacacacacacacacacacacacacacacacacacacacacggacctatttctgtactccagaactcgtcgcaagcgcttgggaagcccatgctgtgctccgg

SEQ ID NO: 71204 - DNA, 1098 bp, Homo sapiens
atttttcattgctctaagacggtcccttttctccttttcagaagtaagcactttaaaggatctatttggactcgctagcaatggtaggcaccttctccattcctggtgtgtgggtgtgtgggcttactgtggcggggaggagacccccaatgaatgttcttccctttcgaccctgaccctcctgggtgttcagatgtctgtttatttttagagcatgacctctcaatggcaaaatacagcaggctgcctaagaaaaaggagaatgagaaggtaagaatactttacatgttgtttttcacttcatttacataaaggcctttcatgccttcctcttgtgaatttatggcatgaaagggtgcgtggttatttttttttttaactatacatggacttttaaaattgttcattccaaatctcataagtagacctccacttctctattctatcttttcaaactggtttattaaacaccagcttagagccactgtaagattatgatcacacaggggttttaacttcagcttgctgcctcgtctgactcatttatcacccaggtcacttgaactccttgccccaagtgttgactctgattctttaacccatgctttctaggaccttcgctactctagataatattgactattttcatgcatataactttttacttctgttacatgatttccttgggctaaattatttccttggcatacagtcttatgagtgaactagaatgtctgcagccttcttcagtacatgctgccatattgttatcctgaaggactgtaggactttgcactgctcccaggagggtacaggcttcacctcaccgcggcctcacaagcactgagatgctgtttcttgcatatttttaatttggattttttagaaagttgaagtgcagccttatctgtgttttgttatatttgtcacaaaaatggttataatgcataaacacacattttgaagcacacgcttttacagaattgtcacgtacagtagacaacttgaagttttcctttcaccttttaaccaggtgaagaccgaagtcggaaaagaggtggccgcggcccggcggaagcagcacctctcctcccttca

SEQ ID NO: 71205 - DNA, 1078 bp, Homo sapiens
aacagctttctaagcaactgctggcatatgaaaaacaggtaacttggtatttatgtggcctgtgatgctgctgtgttcaggactttcttaagtggaattatccagaggcatccttagagacctaaattatttgtttcattttcttcatagtttttttgtcctgtcttttcccttccactgatgtattgaaatcagtgattatcccaaagtctttatgaggtattctaattagcctctagaagtaattaactgccattgagggttccaagtctccaaggaactacaagtgaatcaacattagcaattccaggaaataaacactcaaataaagtcaaaaaatatgtttgacagaaaggaatggccagggagggtcagatgagtgcaccctgggggcaggacaaaggggatagctgtgactccctcttcaggtagacacttctgataggacgtgctcttggagaagaaaggacgtcggtgtggagggtcgtgttctgcaggtgatgcttcgtgctgaattccccagtattcacttaacacctgcttcttttattctttggtcttagaactttgctcttggcaaaggtgatgaagaagtaatttcaacactccactatttttccaaagtggtggatgaggtaagatagcaacatagaaaatttgtatttgattctttctcgaactttcttttgttgttattttggcccactttccatttttaaatttctacttaaatatctgagaaggtatctcaacttcttgatcttacaaagctcctttcctaggagaggttatacactaactattaatgtttgtttctggtttgaggggaatggcttcgatatatatgaagaatagaccaaaagaaagatttctgagaattcggtttctaaaggagagtatattagtttctcagattgccatagtaaattaccatgaatatgtagcttcaaacaacagaactttattccctcccagtgtgctgtaggccagaaggctgaagtcaaggtgctggcagggccacactgcttccgttggctccggggagaatcctcgtgcatcttttggtggctccaggtgt

SEQ ID NO: 71206 - DNA, 1048 bp, Homo sapiens
cctgatgtatttcatactgtgattatgaatttttgaaagttcagagagctcttctaacacaaattatacactgtacaaattctgtgttgtttttctttcactgagagcttttttaaacatgatgttacaatttccttattcattattgcacagtggctcttctatggataagcattggtactgaagacagtacattagtcctggtgtttttagcccggaagactgggcaaagcgggataagcatgcattgctgtgaagcgcatcagagttttggagcagagtctgggtagagcatgtgtggtgggaggtaatgatcccaatgcataggttcttattctagttttttgagggtgctttggggtcagttactgttcctttacctgaaataagttagaaaaagaaaaggaggaattgcaatttatttgcagggaaataatgagccttagtgagttgtatttggtaaagtgctttgatatcacctcaaaggcattcctgaaattattcttcattctatgcctaatgggttatattttgaagttgtgatccaattattgctaacatagtactttaaattcccactgtgctgggcacattaacgaaaatcccttgagtagatctgcctctgtgcaccttaattcttgttcgtacaccatccagtatgtaaatatttctctagtgctttttgtgttctgagcaccgtggatgaaaatgataggaaatgcctttcagcttatgactttgctcagctgctctctgagcactgaggagtttgtcttcctaaaaacggtaaactagcattcttattaagttgctatttgagttttatgtccagagctgctgctggtgggcccaggggttgtgaaatttcttggccgtgagtttgaaaatggttgaataaaatataattaaaaacaagcaggccaggtgcggtggctcacacctgtaatcctagcattttgggaggccatggtgggtggatcacctgaggtcaagagtttgagaccagcctagccaacatggtgaaaccctgtctctactaaaaatacaa

SEQ ID NO: 71207 - DNA, 1402 bp, Homo sapiens
gttgaaaaaatttggcagggcctctgacatgaatacttgatggcagaagacccagcatattgagggccttgctgtggttagaaatcatatattcccattggtagccatgatgagattttccttaggtcggaccctgtgaaataggagcaggaagagagagagcagatggacggattcatccagggatggagaggaataggtggtgaccagcaagtgctgcagaaatacttgactgcaagacatgtgctagggagagagggaagggaaacacgaggggctgatggatagggaggacggggagggatggatgaactggagctgatgttgcaataagaaagcagccttcttgggaatgatgggactatcgaaaggaggatttttttttcctccctagggagtgggattttctactctaaaatgtggtaaaatagttccaggaactatactccatggagcagccatcggagtatgttagcggagcagcacagaagttgttgggatagaggaagtcagcaaaatatgaggtgagaggttggatgggtggttttcacgaatttctttttctttttctttttctttttttttttcagagttttgctctcttgcccaggctggagtgcagtggcactatctcagctcactgcaacctctgcctcctgggttcaagtgattctcctgcctcagcctcccaagtagctgggattacaagcgcatgtcaccacgcccagctgatttttgtgtttttagtagagttgggattttgccatattggccaggctggtctcgaactcctgaccttgtgatccgcccgccttggcctcccaaagtgctaggattacaggtgtgtgccactgcacgtggccattttcatggagttttaaattgaccaagataatggtgcttagaaagaaaaactttgggtcagggtcaaaatctttggtgctctggggacagttatggcagggtttagactccagagaggagaggttctgagtgaaaatgaaatggccccacctgtaagagctctgtggggagatgaggagcatgctggctctgtctcctgttaggagaagctagggtaggtgagaacaagatgcatattcttgaggttttgagaaaagtggtgccagcaaggaaaagccaaatttcttaaggtaaggagatgaagagtgcacccttgccttatagcaaatgatatttttacaaccaattctgaaataattcctaacactgtgtgccccttagtaagagaataactggggggaggagagctagagaggacagggaatttgcagtctggctcttgatctcttgcttctggataaagagaagttgaaagcattcctttgaagtgaatgttactcatgttctccagtcatacactctggaagaaagaaaggga

SEQ ID NO: 71208 - DNA, 1135 bp, Homo sapiens
ggaaagtgaaaatatattttaaaaccttgaatatatccttaagcacagttaagcaaaaggggaaagaattaaaataaacggatatgtaaatggatgtgaaaagaatagtcatggccggaaatgtgtgtcataagctaccagttatatacagattcaagtgatttcttgagaaagttaatcactcaggaccaaagtaaacagttcttatcagaacttaccttgaacgagtttgtcctcatcatttctccattatctatgctaaaggattataaatccattttaattaaaagtagtgaacaactctctcttataccacatcaataagcataacaccattagtatgactttgacacttgaactaaaaaaacaatccagcgttaagaggtaaatgaagctgataaccatctagtgaatttaggttatatgctcagtttggatgaattaggtctcaagatggattttgcactctcttccagtattagctgttcatggccagcgttcaccagataattattaaatctacactttccttctttatagacttggacttactggctgttgcaataaagcaaaaatctcatgcacatatacagtcacatttgaaatattcacagcttttaagtgggtaaaatcatagttagacaatctctgaatcagaagagtcaatgacatttagatgtttgcagtctgctttttgctcaactgaagccccttagtgttacaagttgaattcagccagatacattggaatcttgttgaattattttttttttctttcagaaaagcaacttatgtatgccaactagtgcttcaaggaaagtgtcctgattctcttagaaatacgccaaggaattctggtagaatatggactccttttttttttttttttttttttgagaccaagtatccctctgttgcccaagctggagtgtaatggcgtgatctctgctcactgcaacctccacctcccgggttcaaggattcctgtgcctcagcctcttgagtagctgggactacaggcgtcaccatgcctggctaatttttgtatttttagtagagatggggtttcagcatgttggccaagctggtctcgaactcctgacctcaggtgatccgcccgcctcggcctcccaaa

SEQ ID NO: 71209 - DNA, 2084 bp, Homo sapiens
ttttagcaatgatcagtgtgaaaatgaaagctaatatttatgtaagtttatggcattttcatagaacagaaaggtaaatttctgtaatataagatgactgactgataagcaatctgctgtttaaaggaaaaataattgcctattgtataattaaatgaaatgaggcttcattttctgagttttaatagttagcaattatggggccaatgaagtccttttgactgatagatatcttcttgctcaaggcaatttttaagcgaggctcatggtaaacaatgctgatttataaaaccactgtacaatgtattgtctgatgtatagttttaaatgactattaacatgtttgctttatacacaaggctgtattacattattttgaacatactatatttgttcctcattgttctttctgtactttgtgatttagactagcaaatacatgtatgtcattactgtttaatgttctatagaaaattagaatatgctatttataatctgaacatttaacttttcttaattttctctttaagattagaagaaaataacatcatgactcaagaatcaagaggtgctgtatatttttctaaataattctatatatttagacttattgatgaatggactgtagatattatttgctctataaaaaatttctaagaaatcttgaactttacaatttaaaggaggggtttcatcctatggaattgagtgtgttttattgcatagaggtgaataatcagatcaattttctttcagctacttttttcatttcattttgttaaaaatgaatatttatttaataagagcaagctaagtgtctccctaaaacattgagatctcacccttcttcattgcagaaatctttgagggcctaggacttgagaaatgacagggagagaccagagaggctagaactggggattagattagaatcgattttaagtggtattagccagtggttaatatacagagaggagatgtgtcagtaccagaactccagtagagatgggcaatcggtcaattaagtcccaaacacttaatattgattctaatctaactgaacagagatgtagttatgcaggaaggaatagtaagaatcagagaataagttaacagattggttttacaaaacacgttcagtatggacatggcaaagagctaggagttagaattataataagaaacaagaacaacgacaagagaaaaatagctttcatttgttaactaccctacataccagtctttaaaagacatggagcagcatttccatacagacaaagaatcttagttcactgggtccaccaagggtccaacaacacattccatgctgggctctccactgtatttcactcctggtgaatgacacccaacctcttttgaggcctccagtgattaggaacgtcctatctcctgagatagcctgttctattctggaagtcaggttgccttggttatgaattcaggctctcatttactagctgggcacgttccttcccctttatgacctcagttttgttatctgaaaaatggagccaatacttagactgaagagttgttgttaggattaaatatgaaataaatgttagcatctgctatcatcatcgtcatcaccaccatactattaattttttttgataaccagaatctaaccgttggcagaccaaaagcaagactgatttgatactgaaccaacttcttgcccagggccagtactggatttgctgtttgggatggggtgggattacagactaatttcacaggtagagacaaacaaacttacctgctagagaaaggagacgcagaaactgtaaccagtttcttcctgacaagaactagaacaatctgtgggtagctacttctttgaagatttgctcatcaaggcaacattttggagttttatcccctcgtacccatgaacagagggtattcggtttcttcttgggaggtcactggagagtttctatttctagtatttttaacatagttctagccctccatatagatttctgagttctccgctagttttctcctgtgcagaagtacttttattatttgtatcaaatagaaaagataagttgaaacca

SEQ ID NO: 71210 - DNA, 1050 bp, Homo sapiens
tgctcagatgacaatggatggcctggctgcatcagaatcccgtgggggagtgccatgtaatgtggaggcctaggctctcccaggaggtttggaccaagtggggaagggatggaattgtgaccgaacagtctctatttttaatttggatgatgttaatatacatgcagctaggtttgggcattgcttatcaagatgtattttaattgtaagtttgtaagtctcttttcctacccaactttgcctctttatataattatcatcaatgcttggctctacactggccacctaagtcttaaattaatattgggtgaatattaaataggtgttttacttaaaagaaagtaaataacttgtaggcttaaggctaatacattttttaacctaagttgtacctgtttgctcactcttttctcctcttctgttgtctccttagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatg

SEQ ID NO: 71211 - DNA, 1044 bp, Homo sapiens
tatgcatatctgattgcaaagaatcacagtactagtcttattatacacttaggtgtttaggcttatgttaatcattcttaacctgacataatccccgtaagcctattaaaatggtcacttttgtggctttaagtttaccaacacaatagttcatctaagtttcaaacaagaaaaacaatgctgatattcagagaaatggactcttaatgtcgctcagctagtaaatgattattaattggaaataattgatcaaacacttttacaagtatcctaagaaccattctctgtttaacctagagcaaagacctccctattcttcttggagcaaataacaattattttgcaaacaaaattagagaagatttaaaaatgggaaaatggttgcgttggactttgtttttgattatctgctccatcactgccccttcccctgcactattcaatctgtaactcagaaagagagttcagctggctgatctgtgagttattgaagttttggcttagaaaggaaatctgatctctgtctaagtggcactaatgtgtgggctgagagctgctactgtaaattcagcaagggattcattaatgctgtgagcctcctggagcactgtagatgggtgacctctgaaataaaagcataataagaaaaagataaggcttcatgcatgatctgcaagactgtttctggtgatcttcaagatatcttaagtcaggagtacttagggctggaaagccaggaattgtgagggggcgggggaagaccacccaaagtttcaatgatatcatacaattgattcttggctttttaacactctttggaaaagctctctctttttttctctctctcacactattttctttgctgagaaaaacagactgctgtttttgaaattttgatgatgcagttaacaaagcttgtaaattgcttatgggaagacatagctggaaaataccagttagaatcctacagggagacccagttgttggggtgtcagtcagctttgtcagattctgactttggcatgggttatggggttggggatg

SEQ ID NO: 71212 - DNA, 1033 bp, Homo sapiens
aacaacaacaataaatagcaaaattgatgatgagtcttctaggtgtcccaagtgcactgaggcctgacattccttatgtcatttaatcctcacaatgcccctgtgaggaaggggctattatagtttccaaaggggttaactgcggcacaacaaatttatgtaactgggaaacattgtagagcttggatttgaacctatccatttttagtctgggccctctgtatgtaatcatggcatcaaaatgtactattttgctgttaagttgggaggcttgagattactacatggaaagcctgccatacccagctcctagaaggagatcactaaggatcataatcaaggtacaagtgtaggagggggccaaggattcagcctagaggagtggaggaagggcttggtgtggtcaactttttaatctgtgaaattggaaatttctttctacctcccttcaccccaagtacctggcagagtctctgcccactgaaggcatttctgaaacatttgctgacttgtaattgtgaatggaactaagcaataaaaggatcaaggactagcgatgtactccagcagccaagagacttgaaagaaccaggaaaatactgctaaatattctgaaaaatattacttagtaagttgataaaagtaactagaagaaattccatgttggtactaatgacaagatgcagggagaaaggactttttttgagggctttcttttgcaaacagcttacaaacaaaagaaggaatcaatggacacatgatgtttcccctccacgggggagaaatgccaggttaatgactgcagaggccaaaccatttacaaaaatagcaatatttcttgcacaatcaagctctgaaaatgcaccagcaagcatgaggaggttgcgttaacagccagggacacactggaagctacttgtttcattaagtgacccagtcctctcaaggccaacacaagcaaagaattttgtggcctacctctgagtcaacattgagaggaggcccctaatgaatgaaaatgcattgagttctt

SEQ ID NO: 71213 - DNA, 1039 bp, Homo sapiens
attagttactcatctccttaaatgagtaacctcaaactccttaaacctcaatttcctcatctgttaaatgagtttttcaaaaaatgtgtggtaaagtggacataacataaaactgactattttaaccttttttaggcatgaaaggcattcacattgctgtgtaaaccaggtttttgttaagattagattaaataaagtgtttggagcagtacctgataattggaagttgttcaaaaagtggcaactaagtttattattattattattattttgcattatatattaattatcttgtgcttttcaaaatataatgcctgtaccagtgacaagtgtttcttgggtgtgggcaggtgctaagcagtggatgatacaaagataaggggaggatgtggaacctgccaactgcctcaggaaactcagagtctggtagggaaagcaaatatatatatgtatatgtatgtatatatgtgtatatgtgtatatttgtacatatgtgtacatatacatatacatatatatgtaaaagtgctgtcataaatgataacacataaaacacttcaagaaaccaaaggagaagagaatgactccaaggtgtgtggagtacaatgaaaacaaggctagatgaaacatttgcatcaaacttgaaggttatgaaccactgttacactcacggtgtcatcttatttttttttttgagattgaatctcgctttgtcgcccaggctggagtgcagtggtgtgattttggctcactgcaatctccgcctctcaggtttaagtgattctcatgcctcagcctcccgagtagctgagattacaggcatgcaccaccacgcccggctaatttttgtatttttagtagagacggggtttttccatgttggccaggctggtctcgaattcttgacctcaagtgatccgcctggccaaggtctcatctcgattgatttctttttcttattattctcatgatgatcctgtgagctagaacagggaagggatcatggattcccattttctggtgggtaaactgaggctca

SEQ ID NO: 71214 - DNA, 1061 bp, Homo sapiens
agccatgtagctcattcctctccccttccctgcctgatgttgatttgcagagcacacatctggcattggaaattatttatctggcactgcgagagggtgtggtttctaaaaatattcacacagtcggtcagcagaaagaatgagagcaatgtgctgctttgggctgcattccgtactctggaagcatgtctactaaaatagacaccaagcacagcactaatttgcaattaataaaaaacgggccaaattcacagcccactctctgggagaatggaatgctgacaattcccatagaaggctcctgtaaaaatgtcttacaatgagaagaggtccaggcaccagggtcagccgacctcctccaagagggctgggaatctggtgagctcccagggctcagagtagaggggcataggggaaatggcctgctgccccttaagacaatggaagcgcggctgctgtggataagaaaagaagctttgaatggccagggccaagatgagatagaaacctctgaagcttaataagaccaagtggggcagctgagagtcagcctctgggctttgatgatatgaatgggagagctctgtgttcatgcatgaattaatcaattcatgtgttgtgtgtatatatccacgcatacctgcattcactcatccattcctgcatttattcactgaggaattgaacgtcttttctgggcaatatttatttgatcagaaatattcattaaggtcctactgtgtacttgaccctgtgctggggatttaatagtgaactagatggccaaatttctgtcttggaactcaggatctcgcagttgttaaactagcagtgataatgagccgtgaggaggatacagaagtcagtgaagaagagaaggtacctgctctagtgagcttaaaattccagttggagacacagcagtaaacaaataaacacataatgtaattggctggcagtgaagaaaatccatgcaggatgagaatgaagaatagagttgctcttttacctagagtggtcagggaaggcccctggtataggacttgaattcctgtcatcca

SEQ ID NO: 71215 - DNA, 1046 bp, Homo sapiens
tacaaacgtaactggcttctaatgctaagtaaataaaagaggatagacgtacacttttcagtgtgtgatactaaggaaagcctaatcaagagaaaagaaagaaatctctggcaccatctcaaagagggacccctgtttccagtcaaaggaattccattctctcagcagggaggtaattgacaatatggaaaaaaaagctgaaaaggaagtgcccactggagctttcaactgggttgcctaggatggaagagataaaaacagtttttgcctgaggttctgatttcaggaccgaagttcaaacatcaaaggcgcactgtctcacccccacttcccctttgaaagcctaggagacccgatctgcaaaaccactgagaacaaacatctttagcatcccatctggtaacagtccggcatataaaattgaaaaggtgggtggaggggtgggggagattcggcctgtgacttccctttgacacccttggttttggtttctggaaatctctcctcttggccatgcaagattgcatctctttatgggttctttgcattgtgatgtgctggaactggccaaccctttcatcacttctcctattttagataagggtgatcctggctttctgggacaaagtaggaagcctctttggcatttgttaactgtgatctctcatccgttggaagtgtttctccaacttgaaaagaaacgaaatagacaaacacgtcctttgataagcatttgaatctgatgcccccaccctgtgagccttaagcatgctgcccacgagaagataagttataataagtctgtattctcaaatattctctgaattcccaccatgaagacactttggatgagtgcactatcagttaaaagctcctctcatcttactagagaaattgcactacaatatgcttttgcaagctacctgtgctccctgagatttggataggtctttctgggaggagataccactcttggcgaaaatcactgctctaaaaatccagagaagcagaagagaaatcaagagacaggggctgtggaaaagcct

SEQ ID NO: 71216 - DNA, 1137 bp, Homo sapiens
gggaagaagcaccagcaatcctgagaagggagaggtctgtgaaggcgggagtcagcagggaaggccctggggctccatcctcctccttctctgggtcacgcttccccttagcattgtatgcacagcattgccaggtgcttctcagtgacagcagctggagaggtggctcaagcccatcccaaacccatttcccactcttggaggctgctccaggcgggtagtttttcagagctcagcagcctcctcaggctgctctcacactggcctggcttcgttcagagtccagccctccatctgagaagcccaggtaatcagctctgcagagtgtgcaaggtttagatgcaaaatgcatctgcaaggttttcaaaacatttttttctgggttgtaaatcaagtactttaagtattgcaaaccggctggggtgcggagttaatgtatgtcttgaaaaaacaccatcatgatttgccttttaaatttgagaaaagaattccacttcccttacttttattagagatatggagatctccagggggaaggcgctaagtggaggctgtggtaggtgttagctccttccctggaagggcggggaatggtgagtggcttagggctcaactttcgtctgtttggctgaagggcaatttccctgtttaaaaaaggtagcagctgcttctcttagttatctccagcgggaccccattcacttttgtctgtgtcaggctcacgggccacaaaggtgcttgattgcagcaggttcaaacgaagccttgctggctgctgccatttcactatgaactgggctcagctcacgagtggttcaccccaactgccagaggtcactcatgtcccagtcttctacaggatcatggaagggaagtggaccgtccaatctatacatcaaaaagggaagcgggagtggtggctcattcctgtaaatcccagcactttgagaggccgaggtgggtggattatttgaggttaggagttcaagaccagcctgaacaacatggcaaaaccctgtctctactaaaaatacaaaattggctgggcacagtggcgcacaccagtaatcccaactactcagtaggctgaggcaggagaatcgcttgaacccgggaggcggaggttgcagtgagaga

SEQ ID NO: 71217 - DNA, 1049 bp, Homo sapiens
acttttgggggtgttttggaggctcaggtttgcttataaacaacaaatgactgcagggaaaaaggaaaatgagctgtcaaataaaatagcagcttagtattgacatgtttcttttgcatttcggcaggaacagttctgtgaaaaaaacatgggggtgccagtcagcaaagttcagtccccaaattctcaaatatctggatacccggataacgccctcccaacccatttctcagatttgatgtttgggtctatataacttcgtcccataacgttattttaaaaaaaaatctgttatcaattaattggaaatttgagatggcgtacatttctttttaaagctggctctgtaataaattctacagcaagcaagtagttgagaattcactctgggcaggtgccattttcgtaggatgaaattgttaaaggggagggttgtaagggtggcctctgatgaaggcaatttcaggtttgtggaagaagaggctgggaaacgtgcacttcattcatgcttttcttctgaggtgatattccccaggctggatgttgaataagcaaaaactaagcttagatccctgctcatgttgtcttaatagctgctgaagaatcgcactgggaaggtgggaagcagaataatgaaaaacagacgcagttcgagctgcaggttgagaatgtgaggctatgaggggttgttgaagtggtaagggtgtgtctagggtctgtgaagggaccccaaagtctaaatgctggggcactacctcagacctttctaacgaacgaacccttgtcttatggcagacgcctttctgagcgtcagtgggacttcctgtcaggcgttcttgagctgtctgatccacagactaggttagagtgaaagggatttgcatcagtaggcaggagtccgcctttctcttttgggggatgtctttctctgtatttgcagaaactgaacattccgtcaggatttagtcaagcggccacgagggggcgccctgagaacgagagaggcttctttaccagccgcaaatctgaagtcccgctgtgttattgtt

SEQ ID NO: 71218 - DNA, 2984 bp, Homo sapiens
tctgtcttttccctttttttttcttttttttttttttgcaacaaagcattaaaggtggcaccatgtgccacctttaatggttattaatccatttatttccaggttattaatcattgtgctgtgcagcctgattagtcaggcctgggttataaatcatccctggagcactaggaggggaccctaggattggtccttaaaaccatatggactatatgtggaaggatgtttctccaaaggaaaattgtggtgacattctggaaaaaaacaggacctggaggctgggcagacaaaaaaagttgtatcatgtgaaactcatcagctcttctcagcaattaacgtctggattttgattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttttccagagtggttacattctgagaatttcgtaattatgatgtgttttattagcacatggtataaacgattagcaaataggtaagtttactattttaaggctgttttttcttttaattctgaaaccgagatggcctcactcttgggccggggacctc

SEQ ID NO: 71219 - DNA, 1042 bp, Homo sapiens
tgctttggggtttggggcctaaagcccagctaacaataagactctttctgggtgtcacctcccttcgggactgcctgggggaagtttcttcatttgtggaagctagtgataatgaaagtctcaggtgggatttaggtgttctcaggatctctggctgcattgtccaaaatactctggattgtcggtgacagaactgcagcccagttacctcaaggaaagttggtaaatgtttaacaactggcttgccaggaaaaaaaaaaaagaaaaaaaaaaaggcctgatttgtagtgcttagtgtttgcagagttccatgggctggaaactcccatcggtagactgagagtaaatacttccgccagggctgatttcaagctcccaaccatttaacaaccagtttacaaaattcctgaacatttaacaataggctgttgcaagccagagaatcccactctagcacactaaatgaaaaatgtaaaaaagagcaaaatgattcactcacttctgcaacatgtgggaagagcagggacacagaacgtgacctcaggaaggaagagaaccagggaaacgaaggccaatagggttctctctgcaaaccaacctagtttttcccaactacagatccactctctctgtgtttcaagagacgtcatgccagcagctgccagagttacagcctcaccaattcccaaccagagaagaaggagggcttcggtgctggtttgaaaaatcccagtgccaggttggccagtctttaattgtgtactctcccctggggtcagagggtaggtgcactgcctgaggatcatggggtctgtcaggaggtggggagggagggttgctggccaggaaaaaaaaaccactaatcccattacagtgaccatctcaatgccatcagaacctcgttcccatttctgctagtctccagagtggccgaatcaaggatagcatgaagaagctgtttcacccgtgttttggcattatattttatagttttcttttctttttttttttgggatagtctcactctgtcacccaggctgga

SEQ ID NO: 71220 - DNA, 1074 bp, Homo sapiens
cctcgcacttactgtgggggacgtattgcatgtttgcagtcttacagaggacacggggccagggagctcaggccatttgcatgaggcaccacagccggctgtgggggtaaaaccagatcgtctgaattccaagctagtcatctttccttttaacttgaagttccagtttgggttgcaggggaattttaaacgccctcaatatttactaaagaatttgcctgtgtgttttctgggggagagactccacagctttcatcagcttctcggaagttaaggacagctgccccacagcgagctgcccagtgaagtgcggctgtcgacatattttgttatctgataaggcacattttgtaatctctctgagcctcaaaatctacactgacgtggaatagggaagtggagacgtggccggagaagatagcaaaggagagatttcagggaaagagaacaggatacttgaaacctcctcggcaagaccattggatgtttttgaggaaggaaagtaaatccagtagtattagagtgaagaaaaatagaggagaagagataaaagacagggttaagtaagggtcttgattatgaaaagtttcaataaacatctgacagagcttggactttgtcttggagcagagcttttgaagggtttaagcaggaaagtgacatgatcagtaagtctatcggattataagaacctccttggctaggcgtggtggcctgtaataccagtagtttgggaggccaaggcgggcggatcacttgggctcaagagtttgagaacagcttgggcgacatggcaaaaccctgtttctacaaataatacaaaaattagctgggtgtggtggcgtgcacttgtcccagcaactcaggaggctgaggtggaaggatcacttgagcctggaaggtcgaggctgcagtgagccgtaattgtgctgctgcactccagcctgggtgactgagaccttgtctcaaggaaaacaaaacaaaacctctttataatagtttgacaagttaaggaagttgaattagcagttccaacagattcagtctataagtgcatgcaataggctgctgatc

SEQ ID NO: 71221 - DNA, 1018 bp, Homo sapiens
aactctcgaggatatgctagtaagacgatgcagaaatggaatgagaatgcattaatgaaaagatttattaaataaaattcatggattatttttctcattttgattttgataaaaatttgatgttcacctattattagattccattatatgatctattatttgagcatatcatcagtactctttgcacttttgctaacctgtttactttctctttctatctgtttaggtgaaaggccttgtgaaacagcatatagattcatttaactatttcattaatgtagaggtaagcatcagatgttagaaatagacataaactaaggattaattggaagccagagtctttgctaatgttgcattttccactgcagataaagaagataatgaaagccaatgaaaaggttacaagtgacgctgaccctatgtggtacttaaagtaaggaaccaacattcttaatttgctatgtgggttacatctaacattttttaaagtgagtgaagttgctatcaaaactcttttaaaatcattgtcttggccaggctcggtggcttatgcctgtaataccaagcactttgggaggccgaggtgggcaaatcacctggggtcaagagttcgagaccagcctggccaacatggtgaaaccctgtctctactaaaaatacaaaattagccaggcgtggtggtgcacatctgtaattccagatactcaggaggctgaggcaggagaatcgcttgaatctgggacggggagatttcagtgagctgagattgtgccactgcactctatcttttacagcagagtgagactctgactcaaaaaaataaaaaatgaaaaaataaatcattgtcttttattaactataaagtgctcaaattaaatttttaactggcaaattataatgagctatggttgggaaaattttgaaactattaggttttaaatatttaaatttttattttgaaataatgttaagcttaaaagaaaaattgcaaaagtagtacaaagaattcttcaatatt

SEQ ID NO: 71222 - DNA, 1057 bp, Homo sapiens
tctcactaaagcctgtatgcaaagtttaaaccaaacatttgagttttttgtttttttgttttgttttttgagacagagcctcactctggagtgcagtggtgtgatcctggctcacggcagcttccacctccaagttcaagcgattctcctgtctcagcctcctgagtagctgggactaccggcacacaccaccacacccagttaattttttgtatttttagtagagatggagttccaccatgttggccaggctgctctcaaactcctggcctcatgtgatccacccaccttggcctcccaaagtgctgggattataggcatgagccactgcacccagcctgagtttttatcatctgtactagacgagcagcgtgcctgagaaaatacttcattttgcttggcttccatgtaattgctatttctctgccttttctaacatggtgcatagatagacccttagtgaggtggtgtgcactgcatgttttgtattttttgcagcttttatcattgacagcctacatgtgatattttcttttgttttattttatacagaatgcccataatgctacgtagttcaaactgtgttcttacaggaaaaacgccagcagaatttgccaaactgaacgaatgtcccttagatccaggtatgtgtgaagtcttggatttgtcccactttccttattcttttattctgctgctgctgtggttttaacattttgtctcaaaaacagtaccagcttttctactttataatgaacttgttcacaaaacacccagaaatttgtctctagctttatgctactagtctgtatttctttctttcttttttgagatagtgtctcactctgtcatctaagctggagtgcagtggtgtgatctcagctcactgcaacctctgcctcccaggctcaagcaatcctcccacctcagcttcccaaatagatgggactacaggcttgtgccaccatacccagctcatttttgtatttttagtagagatggtgttttgctatgtcatcctggctgatctcctggactcatccaccttggcctccca

SEQ ID NO: 71223 - DNA, 1081 bp, Homo sapiens
agaagttatttcctttcctgccttcacacaatatatttcaacctgtcaccattagtgtgtgtatcagtctcttttgctcattagtattctttttgtctttaaaagtcacgctttgtagatatctaaaaagacctcatgccactttttatagtgcatctccccttatttttgttcaatggtattgctgattgctagagtgtaggggacctgctgaaatgtattatctctgctattttttcataagtttattatgtaggatttacttttgacttattagaaaaaatgatttcagatatctggagtacaaagaggtccatataaagccagttttcagatgtctaaattatgtctttaaagtaaaatagttgagcattttgctgtcgtttccatagcaatatgtcatttatttgtagctgtgactactgaaggctaaatagtcataaagtcagttcggtctttgcagctggtgtgctttgatgataacttgactgagttatcgcccctgtatttagtgacttgatataggaagagtttagtccttttagagcaaagctttggcagtaatcatgctttttgcacatatggtgtcatttaccatgtgcttggcatatctttgcttcatagcttagaaatatttggaaggcctaagcagtctgtttagatccctgttaggacatttgagaattttatgcagttatgaaatcaccacttagattcagcatcaagacaacttgaagtggcaatccatacgtcaaatgaggaaagactttttcgttacaggttgagcatcccttatctgaaatgcttgggaccagcagtgtttaggatttcaggttttttttttttaattttggaatattggcattgtccttatccttatggttgagcatctcaaatccagaaatccaaaatctgaaatgctctaatgagtatttcctctgagtgtcatgtctgtactcagaaggtttcagattctgaaagctggtcatggtcgcctgtgcctatagtgccagctactttagagggtaaggtaggaagattgcttgagcccaagaatttgaggctatagtatgcactgcag

SEQ ID NO: 71224 - DNA, 1047 bp, Homo sapiens
aaattccaggcaaatgtgtgaaggagtgagccctagtaccatatggaatctacaaagacttgcgttgctgctgccaccttgaaacacttaagtgggtttctgaaacctcttaagtgtattcctactttttttattttcttattttttttcccgagacggagttttgctctcgttgcccaggctggagtgcaatggcacaatttcagctcactgcaacctccaccgcccgggttcaagcgattctcctgcctcagcctcccgagtagctgggattacaggcacatgccaacacatctggctaatttttgtatttttagtagagatgaggtttcgccacgttggcccagctggtcttgaactcccaacctcaggtgatccacctgcctcggcctcccaaagtgctaggattacaggtgtgaaccaccatgcctggcccatgtgttcctactttttaagtctcctttgaaacctgcatgaagtttggtttgatatctttagaatagtgaggtaaaacgtgttttaggaaaaattcttttcctttttaggaaaaatatgagtgatttgacagttctcagaaaaattaattttgtgacaagactgattggggttctgcttattttcagcaatgcatcttttctgattcactgccttttggctgtttgtctttacagtttgcctttgtagtcatgaccagttgtctttaccatacctcccagcctccttttttcgtgatgaaactcttagaatatttaaaaattttagcagatagtacacatgcaaaaaatgtttgagaatgtttgttttccactttctaatcaaaatatctgtttcaggtttttctgcagcttgggcaaggctgccaatgccagatggcaccatttctgagagaagagctagcttttgcttagaagtaatacccacaaacaatgccaaattagcataagcaaatgtcagtgagttaacacaaagccaacactctttctatcttttctttccttcctaggccatgggtgttgagagtgaccaggaaattgtgcagatgattgg

SEQ ID NO: 71225 - DNA, 1527 bp, Homo sapiens
ttggaccctgggaattttagggcaagactcaaagatgaagactgagaaatacacacacacacacacacacacacacacacacacacaccccatagtaaaaataattgcacttcccttcccacatggagggagccccagcagccatacttaggattttagtcccatatttgcaagtgctttcctaagtataaatcaaagttaacatccctcatagccatcctgggaggtgggaattccccactatagaatcacaacagacagttcttacctatccacgtgtacattgtctattctgtgggttatgtatgacatatgtaaactctgggctgcttttttctcttcacccaggatgcttgtagagaaagcatttcccacttatatctgttagtgtgtattctgaaatcaaatcagtattgatatttttgtagactacactagatatttaggaagatcgaaataggtcagtatatatatataattccaaagcacaaatcagtaaggattattctcatcaccgtcttcctctttttctacagttaattaatagttgactgcagttacagggcaggcagcaccaggaagggtggtttggatttaggagattctatttttggcctttatcaaaaatgaaatatttggtaggcatgaatctttgttgtacactaaagttacattgtccaagggttccaagaacatgaagagaaaacattaagaaatatcaaggaggcagaaaatgtagaatctaccctgcaaacaggaatatttggttccattttgggagataccctattctttaatgctgtgtagtgccctacaagtttaccttaatggttcctcagtggcttcagtgaaatccggtatgcagtttatttcaaacatcatcattggggtcaaataaccctagcattgtaaagctgtttgagcagagcccaaacagtaggttggaaaatcattcatttatttctgttaaataggttctgacagaaaatgtcagctaactaaattagatcagattagtgagaagatggcaggaaaagatggaaggaagttaacataagaaagacaaatgttccttttcctcgaaagggaagtataactttgacagtgctcgtactctgtgtgcaggattaaggcacatattagctattgaaactaataaaaggatatagagatgcaaataacccaaaatagttggtatgtagaacatatattaacagttacgaaaacatgaatattctatgctattcaaaatgaagatgtagtaagtacactttatattagtctgttctcacattgctataaagaaacaccgaatcagcctggaccacatgataagaccccatctctacaaacaataaaaataaattagccaggcgtggtggcaggcaccagtggtctcagctgcttgggaggctgaggcaggaggatcacttgagcctgagaggtcaaggctgcagtgacccatgattgtgccaccccagcctgtgtgacagagtaagacctttcctcaaaaaaagaaatacctga

SEQ ID NO: 71226 - DNA, 1001 bp, Homo sapiens
acaccactgtactccagcctgggcaacagagtgagaccctgtctcaaaaaaaaaaaaaagcacattgttgttccaaaataataagaaccacatatgcctcttctttaaacattgttgattaggaaaaatttcaacatatacaaagtacagagaatagtgttataaatgctcatgtatccaaggcctaccttcaaaagttgtcaacactcttacttggttattttaagtaaatttatgtacactaaaatgtacaaatcttaattgtatgactttacaagatatagaatatttccttatcccacagagttccccctcatgccccttcctagtcaatctttacctctactctctgatttttttccccactattctgatttttgcaccgtagattagttttgccaattacagaactttatatatggaattaggcatcatagtttagtgatttttgcaccatagattagttttacctattttacagcattgtgtatggaattaggccatatatactcttttgtgtctagcttttgctgagcttattgtctaagattcatccaagttatttcttttcattcctttttatgtcagttatccatgtagttcatttctttttattgctgagtagtatttcgttatatgaatataccacagtttatcctattgatagacacttggtgtttcagtctttagtaattataaataagactgtataagcaaatctttgtgtggatgtgtggacattttcatttctcatgaatgtgtacctaagaatagaattgctgttaaggagccaagatggccaaataggaacagctccggtctacagctaccagcgtgaacgacgcactaagacgggtgatttctgcctttccaactgagataccgggttcatctcactggggtgtgccagacagtgggtgcagcgcaccgtgcgtgagccaaagcagggcgacgcatcacctcacccaggaagcacaaggggtcagggaattccctttcct

SEQ ID NO: 71227 - DNA, 1113 bp, Homo sapiens
tagtggtatctcatggttttagtttttatttttatggtaacaaatgatgttgagcccttatgtgtttattggctatttgtattttcttctctgtgaagtgtgagccaaatgttcatttttcttagtgaattgtctttttattattgactttaagagtccttttaaaaacaaatcctggatgtaacttccttgtcagcattatgtattttctcccagtccattaactccctatttgttttcttaattcttttaattttgaaaaaacttaggaggatttttttatttgtttagcttttatatttattgctctctgtgttctgtttaaagaaatcttgcctaccccaaggtcagaaatatattcttcaaagttttcttcttgaaactttatagtttttatggttaggtctaaaatccatcttaaactaatttttatatttgttttgaggtaggggtcaagattaattttttagtttatggatagttgtttcaacaccatttgttgagaagatttttccttcctcattgaattgctatgatactttcatcaaaagtcaactgaccatttagtatgtgtttatttctggactttttattctctttcattgatttatttgtctatccttgtgccagtatcacactgttttgattacttaggtttagagttaaaaatcaggtaatataatactccaacttttttctttcaatcctgttttcgctactccaggtcctttgcatttccatgtaaattttagaatctagaattttagaattagtcagtttttgctttttaagcctgctaagcgtataatgaacagttatgaatgtattggtcagtttggagagaattttaacattaaaccacttttaataccattgaatcatccagtccacgaacatgtcatgacccttaatttatttaggttttgttttctgtcagcactgttttgtagctttcaatgtaggggtcttacatggtatgattcatttttgagaggaaaaaagtactactataaaatttacctgtggttttctctgggtgaaggactgatggctgctatatgtctacacacacacacacacacacacacacacacacacacacacaaatatatt

SEQ ID NO: 71228 - DNA, 1040 bp, Homo sapiens
gaggctggatcatctggagccctgtgtgccatgggaagagacttggcattctacatgcagcagaagaccattgaagagttttagtcaggggagtgacatgatctgatttttagtttagaaagatctgatgtggagatgaacaggcgaagagtggaccggctagaagctgtagcagttttctagatgagagatagtgcggctgggatgatcacagcagatagtaccacaactaaaatttaaaaactagaattatgaaattatagtaactttaggttctagaaaaaaaaattagcatcaggactactgaggaagctctgtttggttaatggccactacttagcagtttggtttttggccaccttcagattgaccattgtgcaaggaattatgggtatcctcaccatcaatcccatttttactattttttacttcggaaaaaccatggtgttaaatgagtccattaaaaaaaagttgattgtttagaggaataaggaatggagtaaggagggggaaaggagagctgatcctgttgcttaaaaaattagaattaaaaagagggttcccatgtgcaagaaaacatagctttataaacaatgtaaagacataaaaggtattgtgttagcaaaaatgtgtaaaaacaatagctgctaatttcacaccccatgggatgagggagcataaatgtgcttcagctttagataacagagttgtctccactggccaagcgggttcacagagctttccttcagtcttgatgccacaagagggttggcaggccagccgccagtagaggtgttagcaaaacctaccgatttcaggcttaatctttcacctaccttttctttttcggtaatgtgttcattatttgctgagcattactctattctttgtctgcaaattttttgtttctaatgcagcttgctttgtatgggtgagatatggaatggcaccaaaatccggcaccctggaaagccagggatttctaccctatgacaaaagaatgccgtcttgacttcagagattgcctaatcccagctgtt

SEQ ID NO: 71229 - DNA, 1764 bp, Homo sapiens
tttcttccttgggttctctcctttatggaattccccttcaccttccagctactcaaatccagtagttcagatctttttcttctgtttcttcagtccagtaagactgcaggtctttctctgagtttcagcttcccagtgtggcttggaccctttttattaacgtggcctacccttaggtgaaaagccttaaaaatgagatgtgtacccagtgccattcactctcagtgtcctgcttttggacactccctagtgccttcaaaaagtttttaaatgttttgtccagaatttatgattattatctgcagatgaatccgtctgataggacctactctaccaattcgggaaacagagccacctagtctgttttcatgacttactgttctatcccgttgatttggcttccataatcactgttttaaaatatcactgtggtttaatagcatttataggtaatttttaacataaaaatttaaatgttacatttatatgttatgaagggtacaaataaaatgaacaacctcaaggccactactcaacaactagactattaccaatagcatttcatttacctatgtaccccctactccattcttcattttcccctaccatcctgaacttttgcattttttaatttcttgatttattatatcatttacatctttaattttaaagttttaaaattatttattacagtataagctttgcttacttttgaactttatagaaatagatccatataccgtataatttctctgcaatttttttcttctttcaacattaagatgtgtctatattgttgcatgttactgtagttcattttcatttctgttttccattgtgtcaagatgtgatacagtatgatgaataccactttattcattctactgatcaaggactttgtattgtttctccccatttgacattaaaaaaaaaaacacaacaacactggcattcttatttatatctcctggtttccatatgcaagagtttctctaaggaggattgcctagtcatggagtcagagtcaagttaaatttttacctgaactgcagaatgtcacactagtttgccaagtatttctacattacgttgtatatgaatttctgatgagctccgtcccatgacttactatcaaacttttaagtttttgtctaatagatgcaaaatggcatctccttgtggtcttaatttgcattttctatattactaatgaggttgagccccttttcatgtacttattgactattcctgttttctttgcaatgtcttttgggttgttcccatttttgttactgatttcaaggagatttttgtatattttgcttcctaattttttgttatatgtgttgcagatatccttttccagtctaaattcttgttttaataactttatatatatatatatattttttgagacagagtctggctctatcgcccaggctggagtgcagtggcatgatctctactcactgcaacctccacttcctgggttcaggtgatcctcctgcctcagcctcccaagtagctgggattacaggcatgcaccaccacacccagctaatttttgtatttttagtagagatggagtttcaccatgttggccaggctggtctcgaactcctgacctcaagtgatccacccgtctcagcctcccaaagtgctaggattacaggcatgagccacggtgcccggccaactttatagtattttaaagtgctactaatttgtgcttttagttgcagccatttgtcaacttatctaact

SEQ ID NO: 71230 - DNA, 1043 bp, Homo sapiens
tagtgccattttcttggtagaattctcatgagatctggttgcttaaaaatatgtagcatcgtccccttctccctcttcttcctgctctggccatataagacatgcttgcttcccctttgccttctgccataattgtaagtttcctgaggcctccccagaaactgagcagatggccagcatcatgcttcctatacagcctgaagaaccatgaaccaattaaacctcttttctttataaagtatatagtctcagttgtttctttatagcaatgcaagagcagactaatacagtgctctttattttttaaacttgtgtgtttagtatttgttcttttgttcatctggaatgaagtaaggaatccaatttcatttgttttctaaatggataactggttgtcccagctccatttattgtatagtctttcatttcctcgctgatccaaaatgcatctctatcatataacaagttttattgtatgtgcagatcttttctggactctttggtctatccattggtcagcttgtctatgtattcattagtacctttaccttttttaggagtgtcttggctatttcagggtcttagcttttccatataaattttggaattattttgtcaattttcatcaaagtaagtcttctagggattctaattggcattgcattggaactgtagatcaatttggagaagattcgtaatcttaaaatatgtaggctttttatccatgaatattttcttttcatttattttggttttctttgatgtttttcaataaagatttataattttattcatgagggtcttgcacctctttcagatttatttctaagtttttaagggtttttggtagacattttaaataaaaatatgaacattttcaaaaatatacaaaaatagaatagtaaaattaactgccatatatccatcacagaccttcaactattatcagtagaaggcaatcttgtttcctctgtacccttctcaactctttcccctccccttattccccaaattatgttgtttaaacaaattgtcgccatcaa

SEQ ID NO: 71231 - DNA, 1024 bp, Homo sapiens
aggtttttttcttagattcttttggattttctatgtggatgaacatattatctgcaagtaaagacagttttattgcttcttttccaatatttatatcttttatttatttatcttgtcctatggaactgaatggcacctccaatacaatgttgaataggagtgttgagcatgggcaatcttttctttttcccacattttctaaaggaaagctttcagtttcctgcccctccctgtggtatctggcccctgctgtgtatcagtgcaggatctttgcccaaccaggtttcctgctcctcccctagggaaagatgcttctccctcctcttctctctggcattgcaccttttcctggaatcagaggatttgctggacctcttccgggggtagactgttgttgctagttactgtaggtgcagagtttgttgggagagcctgggggattagggacagacagcttttgcttctgtccctctctgagaagaggttatttttgcctcctgggactttgccaggcaggagggtgtcctgcccccttcccagggacttaggtgttgcttcctatgcaagaaagcccagggaagtaggtaggtagggttttattgcctgttttccaacaaaggggtctttctcaggttttctcctcactgcagcctttcatgagcactccacagaaaggaacttgtgagtgggagtggacacttcttgtgcctgggcttcagaagaattctgaacttgtgtggcagtccacatttggcctttaagaagtccttaaaattttagctgattccttcaattacactatttgcatcctaacttttctttaaagtttaaccacctagttgtacctttctaaacaatataatgtagttgtgctgggttttgaaccttatataaatggaatcatgccatatatatgttgttttatgtctggtttcttttgctgagtatttgtttttaatactcagccatgattttgtggttagttattttttgttcattttcattgttttacagtgtttcatta

SEQ ID NO: 71232 - DNA, 1097 bp, Homo sapiens
cattgaacaatactataatctatggatcttattcaaattttgccagttgtcccactgttgtcttttttctgatccagaatcacacattgtttttagttgtcatgtctccttgtctcttttcatctgaaagagtttttcagtctgtctttatttacctttcgtgaccaagaaacttaagggcactggccagttattttatacagtctctcatttcaggccagaagttttatatttttatgtagctgcatttattaatgttttcctttacttattttatacaatgtcatcataatgactgtaatgttccaatgtctgggagtaattgttaatgtaatcagttttgttgggcatttatgatgtcgtcagcatttacaattacaaatagtactgtgctgagcatttctgtatctaaatctattttatatccttgcttgttatgaagagaaattcccctgagttaagggatatatatattttttaaaggcatttgtgcgaatcaccacagtatcccctacaaagttgtactgctttgcattgctgccagcaaagtagtgagctattttcagatgtaaactgtactttgtattactaatgttcattcttagaaatgaccatcttttgttttttaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtgggtatattatagagacatgttggtcctagatagtctgtgaagagggggagggaatccattattatcctggtatttaaagcacagatagactttaattctgggcccaggttgaccttcacttaaaggtagaaaatacaatgataacagaaacagttactttgttggctgggttatccaaggttctgagaggatatagctatcagagctaaagggtaactttgcagaaagtggctgctttctccccttttgcagttgctggcatatccttagtggaatacggttcaacatggtatctttaagta

SEQ ID NO: 71233 - DNA, 1049 bp, Homo sapiens
aagaaaaaattttaatactttttgacatcatatgttattcaataatatttctgaatatttggcaaaaagggcagaaaaaagtaacaacctataaaaccaccatccaaactcaaccaatgaggtcatttttgatgaatttccttccagtctgtttttctatacactatgtttttacctatcagtaatctatgctaactataattttctagttataattttgaataatagaaaagccactttaaggaaatatttagagtagtttatgtccctgcatctgcactggtatttcttcatttacacatttagcttacagactactttagaattttatccccctgcaaaggtatgactccattataattacaaacttgtaatgcattttgttgatgaaacaaatagcccttgcccttatgggtctcacaggctagtgcaggagactgacattgatcagaggatcatgcataaatccaggttaaggaatcatataggtaactatgaggccattttatagcaagagaatttgaccttgttgggaagatcagcatggctttcccgaggaagtgagctggaatctgaaggatagggaagagttaactaaagaagaggatcagggagcatgttctaagtaatgagaaaagcttgtgcaagggtcccagagcttggtagttgaaaggtctgaaagaagaccagcgtggctaacaagaagagagtgcagggaagcatggtgcacatgagttggtgggtgacgcaaggggtaggggccagagtaagcaagtccttgcaaccatgttagtattgtctttattttattttattaattttatttttgagacagggtctcagtctgtcactgaggctggagtgcagtggcacaatctcagctcactgcaacctctgcctcccagactcaagtgattctcccacttcaacctcctgtatagctgggacccataggcacgtgccaccatgcctggatagttttttgtattttttgtagagatgaggtcttaccatcttgtccaggcttgtcttgaactcctgggctcaag

SEQ ID NO: 71234 - DNA, 1404 bp, Homo sapiens
actattaagaactaggagttgagtctgaaatcccagttccactttgtgtgagtcatgtgcccttggacaagttacttaacccctctaagcatcagttttcctcatctataataagggaataacagtatggactgttgtgaggattaaattgcactgtgccttcctcataataaacgtgtagcattgtaaaagggaaattgtgaaatttgaatttaatgttaaaaaaattgaagtcatttttcagagcccaagatgaaaatgtcagaatactctatggtaggcatgaaatgaaatataacatgggtgagaagttcacaaagggcagtttgaaaactctgttttagtgactttctcttaacaccagctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtaaactgtatcatttctcaacttgattataaaacaatatatgaatgtatttgttaaccacttaaataaaattcccccatttaaaaaatttactttggaaaagtattacattgttataaaaattaatcttgttttatttcttagattaacctgtttatatttaatggcatttaaaaatacatggtagacttgctcctctatgctgtctgtttcattctcctgcagttgctatgcccagaattataattatagatacagtctaggtgatgtgcctattgagatacatgtagctgttcaaaaaataaatagtagtacctttttttttttctgaaagatacatctttaaactactatatgttctgttgagtcatagtgtcagatgttagcactagaagacacctcagagttatccgtccccttgtttacagatgaggaagttcagaccccgcattttcagtggccagtcaaggatacacagctacttggttgctgagctggtgttagaacctgggtctcctgaccccagggcggtgctttgtgtgtgtcttacatctaatcccattggcaagcctcactcattcctttgatggttactgcacagttttcatctatttgtagttttgtttattttcaagaaacacgcactgtatcactgttaattttagctctgcctgccgcttagctttaagaagaacaacagctaacacttttgtagcactaactgtgtgcctggctgcgttctcatcactttacaggtgctgactcatttgattctcacacaattctggagggaggtggcatcattatccatattttatagataaggaaacagaggcatagaaagattaatagcttgcccaaggtcacacaattaatgggagaactgacatttgaacc

SEQ ID NO: 71235 - DNA, 1047 bp, Homo sapiens
aactgcacattgtgtttctgctgattttaagtttctttgccaagcgagtatatccatgttacggttttcttggtcaggtatacccagccttagttgtcattctgccagtgaaactatgtcagactaagatactctttcatcaaaatcatttttagttctgttgacagaggcaagattattttagcctgccaatatttttaagaaatgattggttccatctgttaatgtgaatttgacacctgtaatttatatagttccctgagatactaacccttaatgccctttgagtgtttttaaaagtatcttgagtttctaatgttttatatggcttgccagtaaaaaatcaaattctgtatattgaaactgtttccccttttatcttggtcttgacagttgctgagtcaattatggggtaaccttaaccttattcgctaggtcattgtggggtaaccttaacctcatttgtagtctctatcttacttggcctcctacttggacaagagcaaagttgatattcttcttgtaaaatattgacactggaagcttcacaagaatgtacaccataagagaatatcccccttctgaatcagtttacaagactaaggtaccccaaatccttatgtctttatcccatcagggtattatgcaaagagttgcagacttgcagatatttcagtggctatgcaatgtgctctaattccactaaactttttttttgttaactttaagttctggattacatgtgcagaacgtgcagttttgttacataggtatacacgtgccgtggtggtttgtacacccatcaacccatcacctacattaggtatttctcctaatgttatccctcccctagcctcccaccccaggcaggcctcggtgtgtgatgttcccctccctgtgtccaagtgttctcattgttcaactccgacttatgagtgagaacatgcagtgtttggttttctgatcttgtgatagtttgctgagaatgatggtttccagcttcatccacgtccctgcaaaggacatgaactcatccttttttatggc

SEQ ID NO: 71236 - DNA, 1018 bp, Homo sapiens
tttccagatttcctcttcttttgctgccattcacaatgaaggaggaaaaagcggactcctttgatgtggagagaaaaaaaaagcaatatatcacttccctgaaagaacatttctcagtctctcatgtgaaaaaggattagcacctccaacaaaggtcctgtggatcacagcatcgggcagcaataccaagcagtactcctaaggagaggaaaaactgtatttgagcaagagtgtttgtcctggcaaatagaagctttttaataactgcaaatctgagataatggcatacgctccctaaatccttaaggaccagacagctagtttaaatggagtgaagtcaacttttgttttacaatagaagtctagtcttatcaaaatatagttttttcacttaatggtttagtctgcctatctgtggttgataaggattatgcgtatatggataaaatcgtttggaagattcatcattgaccctctcttatacaagaaaagttccattataaggtcacttgcttccattttgcactaataagttattcaataacctgcagaattaatttattaagattttgattgaatgtttcttagaagaaaagaaaacctgccctgactttccaacacattaaagaatctttttacagtagatataaagaggcttgtgggaagtaagaaaatggtaattcatgtgtgatagaaaagccaaggagaaagtttatctgttaaacaaggtttggttttgctagaccttcatttgttagtccttttttctgtattatgctttctaaaattgagacagtgaaaagaacctgatttaaagtaataataataacaccttgtactcgtgtagtacttgagactgtctaaaatcctctctgcaagtccacagctttaaacagtctggatagctttggctgtctgctttgcttgatcctgcttgaatggaagtttctaagtgggaggggagaaggaggctggtagggctatccgtatgagccccatcataaggtgtatgatgcca

SEQ ID NO: 71237 - DNA, 1029 bp, Homo sapiens
ggctgataagaaaacaacttccccagaaggaagctctgcactaaatattcttaatcagatttcaagcaaaggtattagagattcacatttcagtggaacgagcacttttttcattttaataacataataaagttgaatttgcttaattaaatgtgtcgattaaaactgaaaacacaaaatgtaagtcatctctctccttacccacccccaatataagtatgtcatgcttccttggtcagtttctgcacctcctgcccctctctcccaccttctcttgatggagggtggacaggcagcttcctcctgagcagacgccagcctcctcctgcgaactgctgcttaaggggtgccgagatttctctttggttttgttttttcaggggtatagctgaaccctccatctcctcaccagccaaaattacattctcccccgagctcgtcccagaaccggcccctttagggattgccatttttaacattttgttcactgctgaacaatgttgttgtcggtgcacctagatttacaatttgatctctttcaaagtagatttcccagtagccctagggttttgtcagataatttcagtgtggataagatggatttttggagggaagaaagaaggctcacacactctgcttgattgaaattctaacacattgtagctgaatttgaaataaagtgaactgaatgattgtttctgttcttcatgtaggaaagcatatatttataataaacaataccattttaacccaaaagccaatttaaactaactacatgctctagaattcaactccacaatatccatattgttgtcagctacaataaatcagaatattaataaccagtattacctaggaaaatggcattctttttcttttgactttagctcctggtgattacaacaaatcgcaaactattgaaatagtttgaataattacatagaatcaaattgaatgaaatatttgagagcagtttctttgcaataggggcagatagttaataactttatacacagagaaaaggaattt

SEQ ID NO: 71238 - DNA, 1030 bp, Homo sapiens
gcacaggagggtgggcaggcagcccaacagcaccattgtgtgctatgccggcagcacagtccacaggctgcagtgcctttcgcaaggagagtcgtttttgaactgtttgtcaagcaggattgttgaaaatcacttttgttgctcttgatagaggccatggggaagattttagagcagtggaaatagagatagcagcggggagatcccaattaagtactgtattcttcctttctgccaacttgctttatgtggcatgaaatcttctctcccccaggtgtttgtggcttgatcgtcccccaggaagacatgccattttgtgattctggcatctgtccggacatcatcatgaacccacacggcttcccatcacgaatgacggtcagtgacctgtaggtttttcagaggcattgcctttaaggaagaagcaggcagttagtttagttagagtgagtggaggtgacgaggactctgaagctgttttttcaggtagagctcttctgccccttgccagataaacaggcttccagcccctaacgattctgggccactcccctctacataaagaatgaggagcacatctatacctccctttgagagtggagtcttctgagtgatgaatttacccctcagcaaaagagaatcccttgtcttgaacctaaatggatctccctttcagtgattatttttagtgatcctggctccacctcttaccagctgtgtggccttggacaagttgcttatccttcccatacttcagtttcttcatctgtaaaatgaagaaatataggacctatctcataggggtattgagaggcgtaaaattagatcacacatgtcaagcttaaatactgcttctattaatttattactgttattaatagtggtcgtggggaaatgagctggagataaataagcagagagagtgcttgtgccacagggaggtgctcacttaatttgttcacatcctgcaggtggggaagctcattgagctgctggctggcaaggccggtgtgctggacggcagattcca

SEQ ID NO: 71239 - DNA, 1146 bp, Homo sapiens
tattaaaaatgtggagtgcttttaaaaattgcctattaaaactataataatatggatttcttaggtgtatcatacctgagatgttatagaaaagcacattacaggaaaagactaatggaccatttcagaaatggttcaataaaataattgtgaccatttcagaaaacatagttgtcattgctaaattcattaaccttctcttcacttctccacccagaaataaggcacatttttggccaggtgttgaccagaaagtgcaaaaccataggatcaatttggtggaccttcgtgaacataatttgtactgaaagaattggatgggttatatcctgcttgccgtagacaatggttagtctatatcccagtccacactgccttcccctatgcccccagccagagttttcctttctttgccatttatttcagtgacaaaatctgagaagcactgtttagttgaaaattcccgagggcatttaaatatatcaccaccagctttcactttttgttcattcttgaacatagataggtaggaggaaaaattgcatatagctttactctgtggatgatggaatagcattgggtaaccgagtgtcataaattctaccatgagcaaccctaccattgaggaatagaatcattcactgttagagcaggaaagaatcttgttctgaccgccttcttgtacaactaagaacactcagctagagaggtcatgtaattactttactatgtgacaaaaccaagacaaggacagggtctcttaataccctctccattgtgccttccactccactctgtgtcttccaagaaccaggttgtgctgaagtcagcagaatggcctgatgaccacaaaagccttggctcaggatgctgagagtgtgatcagggacaccgagcaaacagtggccaagcttttcctttgcctctctgctgtgtctgttgtttcctttactttttctacttttacatcatgctgtaccccagagtttacttgttccaaatcagaccagtgttgcagggagagccctggatttgaaccctcactgcaccactcaccagttcttatctgacctgtcgggcgctctgtgtccatttcttcatcttcaaaatagaggtgacagttcttcctccctggatcgttgtgtg

SEQ ID NO: 71240 - DNA, 1127 bp, Homo sapiens
ctggcagcagctactggaggatccaggtttcccccacagtctattctgcttagtttttctgcttttaaataatagaatactgagactctttgaaaatacttaaagacattgtttcctgatttgaaaactctgctgtcctaataataatgatagtgatggtaatagtaatggtgttttctgtgattatatattaatatgttattacatcatatgatattatgcaattatatattcatttaaccataacaaccatcaatattacatcttttctcaattgaggctctttgggataggtgtgcttatgcacttttacaaatgaggctaagcagcgtgtccaaggtccctgtccagttattgatttggatccagatgagccctgctccaaagcctcgtgctctctgccagcatgtgatgctacctctttgtttgtttaacagaataataacacatttgtctaataacttgtttcaaaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtaagtggataccatatgtctcccataccacaccccttgcctcttaaatcacagctcaagaattgaccctggatcctatccgcatattctccagcctctgtctgtgatcactaacataccctccctcatgcatgtattcctgtcattggggatactctgtgtacatgtctcatttgtctacatcatgatctacttcctacacaactagaggctaagctcccaaggagtacaaactttacctccttttaaatattctctcaggtactttttataacactatttgcctgtgaaaatcctacagatgcattgtcgggtgttagaatcgcagtgtgttaaagaaactctttagggaagattacatcgaatgctttcatttgtaacttcagacccaaagagccagggatgctgccccaggtcttatagcaaattggtgacagagccaagagccaagaccaagacgacctggtaccctgccccctt

SEQ ID NO: 71241 - DNA, 1903 bp, Homo sapiens
aagccacagcctcccctttttgctacctttgccctaaaaaagccgttcattttattgttgttcacgtcaagtttctacctttgcaaattgttcagatacaaggtaaggtaaggttttatacacacacatgcacgttggaacattttaaatgatggagaagtatttaataatagagaagattaaagggctttctggaatatgaatcagtacatatggaaatttaaaatagattagcttggatcggagtcattgggtaatgtactagtcaggagaagaagcgaaaggtacccccgttaaatgcatttccccaatttaatgaaagcatgaacatgattcctagataaattacatcaacccaagcacattaaaaacgtaatttttgaactcgaatgcattaaataggtctttagataatcttttaagaaaaagtaactcaccaagtttgtatttgtactgttaacggatcaaatacaggttaagcaccctgcgtcccctcatcataacatcaactgtgcatttgtgagggttagtcttctcccattctcctcctcaggaaactctgtctgcatagttaccaccaccacgtgcacattctcagcctcagttcttgcttttcttttctaaaataatacaagctttattttactgattgcaaaaatgatccctgctcattgtaaaacattcaaaagttaccacaaatataaagtgagtcacattaattcccaccacccagagatgaccactattaacattttggtgactctttcaagattctgataagggcagaaaaatacaaatatacacacaaaaaacttaaaattttacgtatgattttgggggctccatacacttacaaaacttgtttgagggcccccttgggaccatgctgatcaacaaactgcttttttcacctcacagtttgtcctatacaccttccatttcaataaatgtgtgtccacaacagcaggtctaatggcttcacagtcttcttctatctaaatgtcccagtggacatttgcatattctcaccttatgctgttataaatagtgtggctgtcagcattcttgtgcacatacctttgccacttttgggattacaaaatcaaagaatatgcacatttacagtttttacacacactgtcttactgccctccagaatggccaatcctttgttcactaaggaatcccccttcaattcctggtcagcacccgatcttccaagcctcagttgctattcttcttggactcattttcctcctcgttaactgtgaggacctagttttctacctgttaagagtcaggatttgtactggatacctactgtcctagctgctgcagacccttgaggtgtagggtaaggttgtattttggtctgaaacctgaaagaataattcactttctccccagggacccttctacagttgtagccattgattaagaactaagttcagtttaccagctcttccggaaagaagagaaattaaagtcctaattggaatatgaggcaaagtggttaggaacatggactgttgttgctagggttaagtgggaacatatgtgcacatgcacacatacacacatttcttagttttgcacaagggacaacatgttgtaagtatagtacctccaacactcatagaaatcaccaagcctgaagagcactagacaagttaccatttgattgaataccactgtcctattcaaaagtcttgtcttttccatcagactttacgtatctcagtgacagaaatcaagttataattgttgagcgccttgcctagaataatatactgctagtatagttgatgcttatcaaatacatggagattgattgaattggtttaaaactctttaaacaatgaaaaaaatttaaatctgagtaaatttcccaatggttcagatt

SEQ ID NO: 71242 - DNA, 1135 bp, Homo sapiens
taatagggcccaaccccctcgtttaatagatgactcatcaactatgatgataaccagagacgtggcttggtggccctgcaggccacctggacatatgactaccccatacatagcaaattccagcagcattccagttttgaagtatggcaagtttttggccaaatgaaaggtatttaagatacagacagataggtaggtctctagtagtagtcctcttaggagaagaaaacaagactgctggcagtgaggtcttcattcatgtgctagaagaacctgattcatagaaacctgatattgggacagttctataaatatagcctctacatttgaatagagtatgtaaatatccaggaccatgtaagaggactttttgttttctactttggaagttgggctctgactctttgatttcactctgtgggttcttgcagagaagcatgtttagtgggctgttcctttgttatactttgttcttatgtccagattatgttatataatttgtttctaatttttagttgtagaagcaatctgtgttcatgaaacagcacaacatacaccacgcaattaggtttattcccttgtagtagtgctgtttgagtgtatctttagaaatctatgaaattattcctagctctctaataggtcaatatttggccagatgccacaccataggttattcaacaataacagtagtggccattgaacactactgtgtgcaaggtgccatgcttataaaaaataaggaaaatttgataggtagtaaagttgaataacttgaccaagtttacacttttagtaaacagtaagactggactcaaactcaaggttgtctgactcctgatcctgagctttttagagcttattcatggagtatgaaacctgtagtgagagtcctcataatagtctggtgtgtcactgagctgttagcttgcttgatctctaaattgaacaatggtttaactctttttttttaaatggggttttatcgtgttgccctggctggtctcaaactcctggtctcaagccatctgtccacctcagccccccaaagtgttaggattacaggtgtgagccaccatgcccggccaatttaactctttatatttgattttttgctcctgtttctctggaaatt

SEQ ID NO: 71243 - DNA, 1744 bp, Homo sapiens
atatgaaccaattcttgagacgttaatctttatttctgggaagggaacagctatgattcaaactgattgtcttccatcctgatggtgaccttatatttcagtttctaacattccgtgatttaaaaaataataaaaaccttttctctctggatttttaactgttgttaagtacattggcagagaaacattctgtgttaagtcatttgagccaaataatgatttttgcatactcgttcttgtttttcagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagaggtaaggtagagaaggctatttttgtctacctggaatttaattggtctgggacatccctagagtttcctgcaagagaagaatacaagttgggaaatggaaaaagttcccacttctcccattaagcaattgtattacccaggatatacttcttaaccattgtaagtcttattctttccatttgtgtgataacacctatcagaataggtgtaaaaatggactactattttgtaagatgccaaatatagttttctgagttgcattattctctctttttaagagtgccgctttcaggaataaggtttaaattataagatttgaggggaaacaaaacaatgtagttgataaagctataggcattttcagtggctgccatcttaaagaaaagttaagacagatcaagccaattgaagttgatcaatcagaattggtgtctgctcaggagagtagaagatgctctgtgtatgcctgttgtcccagtctctgggaggtttctctgtagtgttagataactatcagaggcataggaccacaactagatatctgtgctcatatataagttctagaaaacaagctgattataccagagtgtgggaaaggttattttaaaccacttgacttatttctaaacaaagatctttcttcactgtggcttggacccttcagcaacccaaagtgacgcagatttgatagtttacatttgagtacccacaagaacaatatgctaaataggaaacttagtttaaggaagtcaacaaattaagtgaagtagacataagcttttttccctccttctagaagcataacatgtcacatttattctctttttagctttaaataactgttgaaattcaccccctcctgtaaaaagaaagagatttttggttccag

SEQ ID NO: 71244 - DNA, 1113 bp, Homo sapiens
cttgattaaaaaatgtaattgtttttctgtagctacaaatcaaacattcctttagttttcttaagacagtacctttaaaaaaagtcagattaactgcaataaatcatatcctaacaagattttattaaacattttgacccactgtaatttttttcgtaattaagagacactagaaatttagaccctaaaactaaaagaaaatgctcttataagcccaagagtaaattgattttttttaagaagtcagatatcacaagttaaataatcatacaaggatgtgaaaggaaggcactttgaccaaaattgctatactagtcacaaatacattgccaaagatttctccgaataatgaatttaatatcttgacgcagcacccagtatttgttgaaagagagcaaaactatgtaatagaggtttttaaaataaaatttttttaaagaagtcgtatttattttccttagtgatgctagcttttttccttaaatttgcttttgtcttaaaagttattttgataaaaacctatcggcttcactgtaaataaggagcatgcctagagccacagacaggatttatgagtatttctcagaggctttcctgggagattgaggttgctgctgacttaacagtttatctggaatggccttgcatgttcctttaatcagaattagagtgattagtatcattttgagcagtaatgactccaggctaatccatttaaattcaatgaaaatggcactaacctcaaagtgctattttaggaagcttctgtagtgatcctgaaaacaatttttctctgtgtgtgtgttttaagcataaaaatttttttaaaggatttcaaagtaacatctcaaattccatttttgaaagttattttctaagtttgtttttgcttttttttggacactttgatttgctttaaagaaaagtttaatgaaataggtaaccctgggtagcacagtgtatggttgtgcgttatcatcaaacccaaagagttgtgatggtgattaaatgagaggttcataaagcacctcttccctggcaatgagaaaatactcagtaaatggcacttgctgccgctgctgccaccactgccactgtgccactgatgtgcta

SEQ ID NO: 71245 - DNA, 1081 bp, Homo sapiens
ctccactccattaccatgtcctgccagtcttaaagcactcaaccctagatctgtcagcccaccttctttctccacaggctgctgagccctaagggaaagttttacctaacctgacagatggctccatcttctccactgcacacagaggtgtttttcaaaaagcggatttctactttaagtcctttcgtggctcttctctgtcttaaggattaagagaaaaaaaatttttttaatcactttgcatgtgtttatgatatgcagtcttatgtagaaaatctgtttcccctggtcagttcccactttcatcctatgtatatgattctaccaaacctttgcaactctctaaaggccttctgcacccccttgtcctcagaagataacatgtttttacttagtttttattatggatatttggggtggcctggcaacatggtgtaggggttgtgagattatgagagagcttaaagccttcaaatacatcttagcatggccattgaagcctgacatctggattaaatctaaaccctttcaacaagacttcagggcagaatatcatgctatcatgctaaagtgtcagagtctctgcctaataaattgggcaaaatgctgttatcatggcaatatgccagtaacttctgaatgagggaaaccatctctggttgcgttgtattggatgaatccatggaattggatctgaggcattggccttcaccttgggaactctctgccccgagagcatccgtctttctgttatcaagcaacacatttgcatggcatggagccacttcctccctttgcctccaggagcctaccattccacaatctgcatgactttgtattcaagctactctgctcttctttctcttccttagacatagattccttattagggcctttacacttgctctgtctactgcgtggaatccttttcccagatctttaagaggctgagtccttcttgacactgagaactcagctcaaatgtcacttcctcagttaggccttccctgactgcctaatttagattaagaactccctcccagccccctgccaccacacacacacatatcttgtcactatc

SEQ ID NO: 71246 - DNA, 1087 bp, Homo sapiens
gctgcttattttcagtgtttctcaaatgctttatgttgtaatctaaggaataataaaacaccagtggatccacaaaaggatttaaaatcccagggaagaaatgcaaagctagcattgttgccataataaaattaaggagctggcattaaagctcactaattcctattttagcatttcagaaagtgacatgacatcatgtgattgtgtctgtctattcaacatttgttttttttctaatttgtacaacatatatttgaaacagttttttatttcctatctcatagtaagtgtcaagtgtccataatggctcatttttggaaaagaaatattttaattgactcttaaaagtcacttttgaacttcttattatgtttgcattttaaaggactattcaatcaagttaaaatattgtatttttttaattgcttttcagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaaggtaaggctgataaaatggaagccctgggaagatgcttccaaagaatgtaaatgtgccatacatacagacacacatcacagagcatgatttttaaatctaagctttttttctgactgatgtgctgcataattgtttttactttggaaagcagtttattacaatatatgataaattgctgaagccatgttaatttatttgtttaatgctgaaaattatgttcatgcaacaccaaaattatgactagtgcttgaaaacaaaggaaaaagtaattactgttccattttgttactttgtgagtcctagaaataaaaaatatccccccaaaaacttgctaaatactcttcataatacctaaaagacatcttcccaaaaaaaagaaaaaagaagaccttgtcaatttcccatttgttgtgagctgtttatac

SEQ ID NO: 71247 - DNA, 1334 bp, Homo sapiens
gggagactccctctcccaaaaaaaaaaaaaaaaaaaaagtccccacctcaaaaacaaattgatatcctcagttacatgaaggaaagtaatactgttagaaacaaaactaacgtatttcaaaaacatatggtttttttttttatagggaagcagctatagagagggtctaactccagttctcagcttattaaccgaatgttcccgagcccatcgaaacatccgaaaatttctcaaagatcaggtaactgcttaatgcatattacattgcaaagttagtctttttatgtgcattttaaacatagaattaattgaattttctcacaatgattttgtttcagataatcagaaactcagtcttaatctttgaaatcttcttaatcaagaagtgtgtattttttgagtcattcattcagcaaatgctaccgagatctgctgtgtgtgctgtgttttgggcattgaacaacagatgaagtctttccccttgggaagtttattttgtagagagggggacaaaaagtaaacaaatttaaaatataatggcaggtggtgataagcattctgaagaaaggtaaagcattttaagagagaggagacactttaagggaacaagggaggacctctctgagatgacatttgaacagaaaggtggaaaagtaagagtatctctgagaatgattggaaaggaatgtccctgagagaacaagttcacaatccctgagacaagaggatgctttggtacacttaaggaaaagcaagaaggcctgtgtgactaggccacaatatgcaagggggagagtggtagataaagagaggtaacaagagccagatacagcaggcggtgtaggactttccattctcttctaagtgagatgagaagatattggagtgttttaagaggggaagtgatgtgaccttatttatgcttaaagatatcctggctactatttgtaagattgacatagtggagcacaaatggatgcaaggagacaagtccaaaagataactgatgttgcatgtttggagtaggatggtagtggttagagttcatacttggggatatgttttaaatattttaatatgtcttaaaagtagctcacagaacttgctgatagattggagtatgggttgaaaaagaaaaaataagggtgatttttaaactttcagattatatcttagactacaagtgtaagactttgattgtaacaatacctgaaactagcctcctctaaaatcccaatttcaagcaccttctcttatttagtaccctcaatccaacattctttcttcctcggaggattgtcagtctgtcattttttcccactgttcttcactca

SEQ ID NO: 71248 - DNA, 1036 bp, Homo sapiens
aacaccttcccttatcccacttctcaagctgcctttctatttctatgctcctctttatgcagtgtcctcagaagagttctctgtactcactctctctattctttttactcgtttttgactcctaaaccctctgtaggctacatgccttccgccccactgcaaaggtgtttatcagagtcaccaactcaactttgccaaagctaatagttctcaagtctctttttttaaattctccaatagaatttgatgtaagtattccctcctccttgaaatactttcttcacttggtttctaggacacaatagagaacctctttgttgatcttcctcgttttcctaaccctaaatgtttgagtgccccgaggcaatactatcttgtctctatctctgctgccatggtgatctcattcaagagtcatggttttgaaaatcatccatatatgctgatgactctcaaatttatatctccagccctgacctgtcacctaagctctagacttatacagtgaactgccgactcatctcctcctcttggatgtatagtaggtatctcaagtttaacatacctcaaactaatatcttgattttcatccctccaacctatttcttccccttctttccacatttcaatacgtggtaccaccattcacccaattgttcatttatcactacatagaatctcccctaataaatgaaccagattcattttttccctctgtatttatggtcaagatttagtaagcaccttactgtatctagaaacactaataggtagtgctgataaggagagattagaaaatagagaccatctttgaggaatttacagtctgttgaaagaagagaaatacccagaaagcatgaataatgatttaggcaagattaattaattaattaaggtcatttccacatttgattattttaagacattctcccttgactaggaggagttggtgaagcacagtaaatgaaaatactttttttctgcattttcgcttttttccacaagggatccaggtacacctaaactgtttagattt

SEQ ID NO: 71249 - DNA, 1019 bp, Homo sapiens
aatttctaaattctaacctttatacctgtttctttaatgcctctgagaatggaggtcccttgactgtaaaggtgatataactggctggtatggtttatacattattctagacatcaactgaaagatgtgtgtctaatgacatttggctccttttagatgagtggctttcacagggtgcataggcatctagaggcccaaagaggtatctttaaaaggctgctttgtggagggataggaggaacagatggtcaaaagtgagcagaaccctagggagcctccttgcacacttaacacaccacaccagttcataatcagatcgaaaagcttaaaaccattgtactaataaactcaggggtgtttccttcttgaccatatttttctcagctgtagctatgccaccagctgtataaacagtttcttcagcacaaggcaagatactttttcttttatttgtcaagattttgctatgctgcttcagtcaagtctttttatagttgtctcattatattgggctttataaatttatttatttttaatattaaatatttattgaagtaagtgacccagaaaccaggacatgaagatttttctctttgcccaatttgggctgtgatgatgtatttatgtaaaatagcatttctgggaactagaacctgttactgtaagcagtcataaaacgtatctaaattcagagttctaaaagaccagaggtaaaagaggccagtatattagcttaactacagtactgagttttgctccagtgtttatttgctatggattcacaatcgtcagttttctatatcctttatgtcaaggttattactcttaatcaaacggcctgacatgggaaacatttaaaaagcactataatttaaaaaggcattttgaggtcttttttgttttattgcctagatgcaatttggtattcctgtatgtatatatattcagtatgtataaatttatgtggctaatacatggtagatacatagtaaatatcagataagtaaatgaaagaatga

SEQ ID NO: 71250 - DNA, 1166 bp, Homo sapiens
tgttgatgttggccaaaggtagcaaaaatttgaagaaagagcaaaagacttgaaatacagttcaggttttatacctgtgttcatttgtccatacctttttagtgtgtcttaatccttttgtctccaggcccatagctgttgtcagttcatataatagtcttatacaaaatttatgatgaaataccacagataagaatttagacacttcttgtcacctaattggaagtcacaagattggagtgctacaaaatgggacagaggagcagagacaaggtggaggagatcatgataaatataattacccaataaaatgtccaccacaattagtgttcttaaagcatcttaagactccaagttttggaatgaaataaaactaactccagaatttcatagcgttaagattgaaacctggactgtggcgtctcagactgtactatttgaggttgaaaggtgtcaggtatttgttccaccaaaagtaatctattttatgaaatctcacgtctttgttgtcacaatggctattatttgttttctcttcctttctgggtagggaaactacatgagactctggtttgaagtggggagcgggagaagagacagtgttcatctgccttctgccacagcacactggcatttttcccataagagagtgctacgctatacttcagtgccctaacttgtgttttctgtggcttttgtttacattcttccgaatatccaggggaaaaatgtctttttaaaggaaaaaatgaaacccaaatccctagactgactttggagggttggaatgttttactctatggcaaaaaatgagttcttactctgtaagaatgaatttctgccttctgcttttatactcagatagcaagaattgtgttactttagtagctaatttcagagcaaaccattatatcattttagcagccaggggacttgaggttaccttatgtaaaacagacttaatttccaccaagctcttaagagaaccaagaaaaccatcaaactgtgtcctaatctgggaattcatatagtgactttgtatgctgtggtgcccacaataagcccacagcttaccagtgtgtcctcctgatttcatttttttccctgaagcatgtgatcatgtgtgcaaatgtcattatatcctaaaagtgcctacaggcctgatt

SEQ ID NO: 71251 - DNA, 1943 bp, Homo sapiens
cctgataaaagaggaaatagcacacaatgagtgtctaaagcaggcactctagacacacacacacacacacacacacacacacacacacacacacacacacagatttattagttggtctaaggtgaggcccaagcttttttttttttttttttttttttgagacggagtctcgctctgtcacccaagcttttttcaaagtttctcaagtgattctaatgtacagccaaggctagaaataaatgacaaggctatgggttttcaggttgccccagaacctttgaaagtaccttaagagaaaacaagtgggtaggggacaaataaagggactctacgcccctatctacttggctattcccatccccttcttgcctgagcagttcacttttgtctattttatatattgggtttctaatgggggaaaagttttaaacatgactctagatgtaggtcttacgcaagaatggcaagataggttttgaatcaggttttcgaggatggtgagcactgagtccttccataagaattggtatgtcatgcagcctctgaggaaggtagaaaagaaaagtaaatctaatagtaatagataacagtacgtagtaagcaagcctttaccccagatgagaaaagccctagtcagtaaagaacttgcccaaccgaaagtctcaaagacgggttgcaagctggctaccagaagatttaattaatcactgtgtctttgtcttggccagtatctttttttttttttaatttaaactgggcaccgttttccagttgatctcaatctcccaacactccacattgtgtatatttgaccctctcactcacttgcttatcttaaaggcgtggcttctgaaagcgtttatgttcatagaccctagaaagcaatttattagcaattgctatttgcagggatatttaatttgatcattaaaaacaaactatctgctaggcgccatggcttatggctctaatcccagcacttcaggagctgaggcaggaggaacacttgagctcaggagtttgagaccagccaggccaacatggtgaaaccccgtctctactaaaaatacaaaaattagccaggcgtggtgacacgtgcctgtaatcccagccaccctggaggttgaggcaggagaatcacttgaacccaggaagcagaggttgcagtgagccgagattgtgcgactgcactccaacgtgggtgacagagcgagactccgtcaaaacaaacaaacaaaaacaaaaaaacagtatgtacttggctggtacaagatactgtgatctcttgtctgcttctccagaaaaatgtttgttgtggatatttaggagccattgaaagagttatcttttatttcctgtcctcaaaaaaaaaaaaaaaagtatggcttttctctaagagaatagtttgtttggtattataacctcatacaaagtttatgcaaagtattcattttaagtactgtattaaatctatttccagatagccaggatgatatacctgtctcttggtaggctagatttcatccctttttttgtctaggccagatcaaacctaattaaaattgttcttctgctttatcttttattatttaaacactcattgccctctgtggtctcactaatggactaatttcctgagattataaattggcatgctttcatttccagattgtagcctctctgtcatcatttttccaattttttttgatgtttgttttatgctgtatcacaaaatggatttcctcatttcttcttccctgaaatcatgtgtccccttagaattaatggataagctgtgcatccacggatatcctaacggcactaatcaaattttgtatttttaaaaagcaaccatgcctctaaaaaaaaaaaaagttggcaagacagttttcgttttttaaaaaaagtatagcccatttcccaaagcaaattagtggaaaagt

SEQ ID NO: 71252 - DNA, 1026 bp, Homo sapiens
atagggtggcccaggcagcagtagttcagatagctcttggctaccatggtttttctacatgtgccgcttctggatgtgcattcctaaacatttaaactctcaaagctaagatagtaactaccagagcactgtaataattaaccaactaacctccctgtcttcaaaaagatgctgtgagttagattcagtgattttgctgctgcttgtatttttgttttagcctgttttagtttttgtttcaaatcatgatgcttttattttttcatttttgatgtgtaagtttgcaattacgcctttttgggttgctgctgaaaccaagaattctaaaatgtcatgcacccaataagaaaaagtgaaaagaaatagctcacatgaaggattttctgaaaacagggacttgtattaattaggagttctaaaaaaaaaaaaaaaaaaaaaaaaaaaccaaaaaactccccttcccctcttgcttctcacctccttccccttcaaaaataaccagttttgaaataattaaatcaagtatatactaatcagcaactagtcatcttggaggagttattagaaaataattcctttcatacttggctgagtcactctattttctagtcatacattgagtcactatcttctttaagccatcttgaatgaatgcttctgtgtgttggtggcagctgccacttaaagatgcatttcttctggccatcccctttttcacagtaactgtgtaaaggctagtatccctcagtcaaaagaaggagccattggaatggaaaagccagagagccaaccatgaaagggaaaggtggaacacagaaacgagcagagattaagggcacagcagaggcttaggggtagaaatggacaagaacaagagactgacatggggagtgtgacaagtatggatatttatccacgctgcagagtatgatgctggtagtgtggtagaagttgtttaggagtaaatagcttaattatctacaaagctaataagactagaactcagtaacttccagctagcccttt

SEQ ID NO: 71253 - DNA, 1656 bp, Homo sapiens
acgtcaagtctgaaataccccagcttccacctgatttaaactatgcctcaaagaagatgcctacttatccggaagtacccagcagatgcccaactgaaggtgacactgatttttgcatgtttaaagcagagcaaatatgtcttatgttggctttgatggtatcaattttgccattaaagttgaagcaaaaggcaaccttgagaatagttcaaatcatacagaatttttgcatgacgtgtgttgggcgttttacattgtctgcctttgtgtgctttctaacatttgctctcactaaatacaatcaatgacaaaactgtataaagatcagcagtgggcattccaaagcagtaatgcaaagaatgaagtcattctttatgcgtcttacatgtcttttgtgctgtgttcctcattagtcttaagtttcttctctctttccacttttttttgaggtaaaaaaagatgccataaagccaaaatagactaaactcagtacaattcagggaacatttactaagcagctactctgtgcaaggcatcgtgctaggaacctgaggaagattcagaggagaatgtgacagtctctgcctttggaaaactcacattctagtggaagaaatgactgtaatctagtctagaatacaaggtagaaggaaataatgacaaaatgagttctatgttgaaatgtaagcatgcaggaaaaggagtagttcattctgtctggatgattcagggactgtttcacaggaaagctagcatttgtgctgatcctagaattttgatgtatttaatagaaaaatggaaaaatgaccattcattccaggtggagagaaatttaatcttgttaataagtcttggatagtcacatactacttatttcttctaaagagctcaggttgttttatcattatttgattagtacgttatcagatttatcattgggggaagcaagtaccaaagaattgcccaaagcatttccaagctaatgactgatgataattcatttccttttaacagtttataaaacactttcacatacatcctctttctagtttcattttaaaaagtgagactagaccttcattttccagaactcaagacgtttgctctgtccactgtactacggtgtctgtctgttatagtaagtgtttgccagaacacttcctcatcaccctgtcagcattgtactattggttagttccctccctttcactctaggacgttctgcattcaaccaagtcgttattgtgctaagagtgtaccatagctttgtctgattaactttccttctcaaaaatgaaatggttttctcctgcacctgaattgaaaggcatgtgagtaaaggatagggttggaggtgatgtggccaatgaatggacactagacacttccttttttccatccataggagagcagatgtgaaggacctgcaccaggatggtggttagcaacagtggcccgtgccaaagcacttaccaaagtgatgatgactaaggttggtcatgccaagtactgttactgagcctggtgtagggtatagatgttattcactaccaaaattgtaaaaccaccaatgtaaaagttaaaattacatttctattttgcctccatgctggacatagccgctgcctcaaggagctcatcaccttagcagctttc

SEQ ID NO: 71254 - DNA, 1955 bp, Homo sapiens
ttaaaaaaggcttccctatgggactatttaccaaagttgctcaacccgcagcccaggacgcttttgaatgcggcccaacacaagttaataaactttcttgaaacattatgagatgtttttgcaattttttttaagctcaccagccatcattagtgttaagtgtattttatgtgacgcaagacaattcttcttccagtgtggcccaggaaagccaaacaattggacatccctggtttagacaattcccaattacctttataaagtggaaagacatggtgatgtggggactgtacaccatatcaatttgtcttgggtaacaatatttttatgttgcatattttactttcccaattgtacccaatcccaaagcacaatgatgagggctgagggaaggatctcagaatcctttcaaagatgtagcctagacctcaaatttgctatggaaaagctaccataccactcattcctaccaagttagtggcttaatgaaagatcggtgtaaccagtcagctctaggaagtcattagatgaaagatgaaggatcagggttcaagcctaaaggacactttcacagtatctaactgaacatgtttaccagtccaaaggttataatattattgctgtgagaaaaaaagaggtgaaaacatttataagaatatcacaagttattgggaaacccgttatacttcagtggattatgaactatccatgatactgaaatcttgatataagatgcacgcccagactttaaaagaactacagagcttccttctcagggctatcacaggctccatccattttaacaggcattttttgaaaagctctatgttaattaaaatgctttatttatatactaatttctcatcccatctttcaaatgtgaaaaggaattaaatatgaaatggctaatttaaactgtcaggattcttttttccaagtcaaccttacattaagagcaggaatcctgtgcttaagaaatggttcccaattatcctgtcttgggttttgttatacattgtacagaagtcaacaaaacaagtatgtaacagaacctgcctaaatagcagccgccctcattaaaaacagagaattaatcagggggtgattgaaggaagcaatgcctcatgttcccccccccttttcttcttttctaatcatagaacaaaatatgttacataaaaggatcggaactattatgcagtactcaattagagggaggtgaataggtctctaacatgctgttttatcaaaagagcagactggtgtttgcatgactgttgtttcattacagaccctgtcattaattccatgtgtcaatactgccctgtagtacacagagcagacaagaaagaagagcccttgaaaacaagggaatgatttttgagtcgttatcaagctaagtggcaagcgggaagctgaaactcgtataggtaaattcgaagggactcttgggagatctgcaagtgggaaacaagaatgcattttaccaactgcttaattatgtcctgtttttcaacaagtacacttgaattgaatgttttgtttgtattgcacaaaaacatgtgctgtgggcaagagtattctcttgctttcaggtcaagtaaagtgttttatacacatacacgtctgacctattctatattgtgcgattgggtatgttagtatctgaaccccaattttgcactgtcatttttgggggaaagagtcatataggaaccagaagccctaaaaagcagaaccttctctaaggtgctgagaagtcatataagcccaggcatcctagagtataccatacttacaggcaaacggtggctcaggaaaatgttaaaatatatctggaaaaaaaaaacagaccagaatattttaaatatggtgtaaattccgtatctcccatccctagctctttaagaaattatttttttggtttccattagcagtcccaagggttaggctgg

SEQ ID NO: 71255 - DNA, 1994 bp, Homo sapiens
acttctgctgaactgtcagaatgtctgatgatattaattcatcaggaaaataattacagttaaaataacatgagaatgattcctgacaaatggtctcccatttatgccacgtttactgagcacctgctgtgtgctgtgttctatactagatactggcaaatcacagcctgagaagacatggactctgccctcaagttgctcacagtctagtacagaacaagaaatctctggaaagcattatacagaatttcctgtggaatgttaatcctgtttctaaccctgtaaatcttcgtgatgaaagtgaatgtgtacccagagatttagcttttctcttcatggtttagtcattaggagtcccattagacaccataccttttctcttcaggaaaatgaaagataatatcaagtacaactaaatttaattcacaaacacttattgaggatctgctatctgcaaggcactgtgctagacacatagggatatgaaaattgagtaaagcatagacattctctttttaaaatatcagagcagtagtatttcatagctctcaaactttgtaatgacagttatttttaatatccttagaagttgggggtggggggtatgctcctgaaatagaaaacaagaatacctttgtactcaagtccagacttgtcagcctaggattcaaggtctccattcaaatcctcttttataccgcatctcttttgagttgtttttttttttttcctttatctcagccgagccagcctgcttgccagtccctgcacacaactaactcttgcttctgtgcctctgcttgactaattcttctgcttctgggatgcctttctccctgtgaatccatgtccatcactgccattacagtctggcccctgagtccacctactgcaaggagcctgtggtcagcatccctgtctcctcctgtgtccctctcacatgtgcatagccatacgactggtgaaggaatatttctgtggtgttcattaaagcttcccattctctgtccacatcttgctgatctagatacaacagattgcaaatgaaatagtcccagattataaatgagacagtccaatataaccaggtcatttaccaagccttttaggagtgagtctctgtaccaaatatttcattttgatatttgtgggccactagttgaaggatagaggaagaagatgagaaaagttaggatgggggtatgagaaataagcctggggtcaattagaacaaacagtcacacatctgtaaatgatcctctccttctactcccagacaggacaagaaatctcctttaaaccaacttcaaatacagtaagggtgtattgacaaattttaaagcttaaagaaagcagggctctctgcctgttaatcatctcaagcttgttgatctgctgttctgtaactctttcaatattgtttaatgtgtgtgtgttttctgaactgactaaaagcttcttgaggacagggaccatgtcttttatttgcctctgcatattcttcccccacttaatccctaactagcatgggaaaaccttctgtaagcacttaagggacaggaacgacaatttgtgggttctaactacattccagcctaatgttatactatacactttgtatgtatagtagccttttgccctcatcacaacttagtgtgaggtatgtgttcctgtcctaattctacagagaaggaaattggaattcagtgagttcatgttcttacagctagtgactggtcgatccagaattagagcacaggtccgtctgactccaaaacctatatgtgcttttcactataccacaataacaacgaatatttgttctgtacaattcacaactctttggtctaccttattattattattattattactaccactacttacatcttcactagtcagtaggtacagccaagattatcacgacccccatttcactggtagggaaactgagactcggaagcttgcccaagatcacacagctggtaagtgga

SEQ ID NO: 71256 - DNA, 5001 bp, Homo sapiens
agtattcaggagcctcaatttagcctgtcagacgttcacatttcccaagcaaagctttcaaacacttcgaagttgtctactgagctagccagagctcttcattaggctcctgttggcttatccattgaccactgagctgttctcactcctccccaggagatttcactgtgtctgtaacaccattacactactgtgtggctgccccttcccaggagggagcccttctttctgttggcctaagggacaactgtgaggagggagtcatttcccctccatccaaatcccaccaacattatagctgctgccatgtgggtttttgcttatggacatgtttttggggggtgatgcccatttctgtgataaataagttttaagcagttcatggggctcttcaaggccactcttaagtacactgctgacctttctagggatgggaggactggagttagcaactcaacaggtacattcaccataatctccatgtaataaataagagcctatgaaaagattaaataaatctttcctaatgctttttgactggcttaatcaataattaatcatctttagatgaggctgtaacttgtggagtagatataattggattagctgaaaagcggcagttgcggagctttgaagagattaaaatggctgtcaatcccataattaaactgccacaaacaaaagcaatggtgttttttagaaaggaggaggaggaggaaagaaagagtgaaagagagagagagaaggaaagaaaagtcggggagagagttggggaaggccaactaatttgaaatgaatcaacatgtacttacatatcactagagactgaggcaaaatcaaaaccgacagatttattccattgaatgaagtgtatgcatatcaaatcagccatttaattgtatgctccaaccactggggcaggtgaaattttggcagcttcaacttgtctaaaacaaaaccaatccaccaaaaaaaaaaaaaaaggttaattattcaaaacagaagagacctgctccttgtcctgagcccatttagaccttgacttttcatacttttaattggcttagtaggtttggcctgtgtgaatgaagtcttttatctccctcttccctctttttctttccatgcccctttcatctttcctattacaaacacacagagaaagctcaagggaaaatactttggtttttaaagacttttctttttaaaaggttgtggatttgggtgggggggaggggtgtgtgtgtgatgctggtgaatacttttttttctctctcttttatctctttttctagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttactgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatggcaaagaaagaggctgctagattgaaggcaggcatactgaaagaagaaaaaggccaactgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagtagctgtgctcttctgctttcagtgagttctgtttcattttgcatttctctgcactgggcactaagctttgtttttgaaaagagagtttgcggggaagaagatgagagtgtcttcatctggcacacagaaagagaactaatatctgttaagtgcttactacatgctgggcttttgatgtatgttatctcatgtaacctcaccttatcgcatatgaaagatcctctccagaaagcttatgaaagttaccccacgtcacagcaaggaagagtccaactctggtggcctgactcccagcaccactccttccttttccccacagcacacctgggcccacactgtgcctccttagggctctgaaatgctgggaacagagtggtgtgaggagggtggtcattctcaggccattttaagcaataactatttcaacagaactagtttaaagaggtttttaagcagggaagtgacctgaagtggaagtatgagtgggaaacttgcatggtcagcactggatttccaatgaagacctggaatccgttaggataggccagggaccaaggctgcaggctggcctctctgcccacaactctcctgaccttggaagcagggtacggaggcgtgtgtcctaaaataaagcatttgagctgctgctacagaggaacaatcaccagatattgtgaccctttcagatgcccagtagtcctgggaggcaggcagggcaggtgttattatcccttctttataaatgaggacacagaatgaggcagtacaagtgactctaaacacccccttagtgccacatcagtctcgccacctcccaggactaggtgtcacctgtattgacctcttcccctctgattataaaagtaatatatgttcattgtggaaagtttggaaaatgcagaaaataaaattaataatttaccccaaatcccaccatcctgagatcatcactgttaatgttttagtgtatttccttcctgtattttttctatgcatatataatttattttactacaagattgggatcatgctgtatttacagatttgtatcctgctttctttaacatattgtgagcattttcccatgtcaataaatattcttcaaaaagtaatggctatatgatattccattatgtgaattgtggcagacactgctagtttccttcccaatattctttctaacagaagacatcatgaccaccacgcccataaaaaaaaaaaaaaatttaaaaaggtggtgcctgctgcctttctagaaggcagcatgagttgttagtgctgaagagcagcaggaactaggggtggcaccaggaggagcaggcttgctctgccacacagcaacagtctcacagaagcctcggcagcacaagtcagaacagctagagtaagtgccccgataactata

SEQ ID NO: 71257 - DNA, 1100 bp, Homo sapiens
gcttgttgagtaacacacgtggaccacatagcaacagctcccaacactatgcaaaagtgttagatgcaaagtactaactaccctagactgtgctattccagattggaagcagaatttgcaaattactgggcagtgcggaggaggagggcaggaagctggcagtggagaccggatcccccatgctgaccctaaaggccagtgatggttgagaaaaataactcctgaaagtgccgcttgctctgcctaaaaccgactgcctgttatttcatggccacaaatcctcaaagaactggccccaaagattaaggggattccgccactttgctctttacttttggttcaaatatctcaagacaattcctttggggttggtgtcacacagaccacctagagggaccttctaattgtatttacagtaatttaattatggcagggagagcttcagaaggcaggatttaccaagattgatactatgggtgccactggcagagttttgatctgttaaatcaacagagaaatggtaaaaaaaaaaaaataataataataataataataataaaataaaataaagccactccagagtttggaaaactactttatagactttttcttctttttttttagtggaggctgggaaggtgaaggagacattttcctggggccacggctttcacgcttttgttcatattattttgtatttcatatatgcattatatccatctgatctcacacacacacacacacacacagagtttagatattatgaatgcaccatagccaagtgtgtgtatgcgtatgcagttgtgtgtgtgtacttaattaaatatatctctgaatagttattcaaaaacttggtagcaagttcctcctccggggaggagatctaaggtggggtgggagagagatttacttttaacctcattttccattcttttgtttgcttttttctttttgttttccaaaacaattttatacaaaaacatttaaaatagtttttgagtgtatccataaagaaacttttcatgcaaatattaaatcataaaagtcagcaacctgtatataattcagccaattgtaggttgtttggctaactagttacc

SEQ ID NO: 71258 - DNA, 1012 bp, Homo sapiens
tttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagc

SEQ ID NO: 71259 - DNA, 1168 bp, Homo sapiens
tggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagggtgatcttaccatttttagttactttgcagttcagaaagtgctgtagccagtttaaaattttttttatagtaatgtacaaacatatctttggatatgtattttgatgctgacacaaccatgaaatacaaatatattttaagcaactctaataataaagattaagagtgtagatttctaggttttaccccaacttgccaaatctctgcaaggtggggcccaggactgcattttaacaacctctctgggtaattcttgagtacaacaagagtactttcaaacaaagtttgaaaactgatggattataaagcagggagcacttctgtctgttccaagtagctgtggaaccaactgagacatctcactggaaagaaatgactgactaaaaggggtggggaggagtgtagaaaattgatatttactgggcatctgcttacctgccag

SEQ ID NO: 71260 - DNA, 2187 bp, Homo sapiens
tgtatttacaaagtataagatatcgaagttgtggagaagtgtattacaattcaattaattatttaggaggttttttttttttaagagtttcactcttgttgccccgtctggagtgcaatgctacaatctcagctcactgcaacctcgggcttctgggttcaagcaatccttatttaggaagatttttaaaaatattccacatgagcagttttcttgtctaatttaaatccactttatttccagacttcaacagctcaaatttgtaagtgtatgtgttctgaaagtcaacacccttatactaaaaacctttattttctttttttcagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactgactgttgttgcttctttctagcagtgcagggtgaaactaactagcaaagacaaaaattcaggcagtttgtagacaccagtaattttaagaacctgcttagcttctgtgttgtatttaagttatctctaaatagataaattctgactcatgtgccatattataaaatataaatcatatttattttaataaggttggtaacttttaccttgaaccattatttcaaaaactcatatactattaaatggcatatcagtgtgatactttataagtgaatcacttctaagaaatggacaagtgcttccttaattcaaggtatggatacatttatattcatacaccacatttcatgttaggaagcaaatccagtctttctcactactagccatgaaacatcactctactgtggtctgaattctgtagcttagtgttatgtgaactattagcaaacttctataccttttttttttttttttggagaaaatttcatcttgtgtttggaataaattactgtctttgagaatcaagtattactcatccaaaaagaagagttggagcctacttgtgtggtcagtttgcttagaattgaccattattataactcttataaaacaccatgtgcattcattactttcctcattt

SEQ ID NO: 71261 - DNA, 1050 bp, Homo sapiens
aaattctagtgtttcctttatagctgtgggagaatttaacaaaataaatgggttttggcttaacaattttagtagccaaactttcatgttggcctcagagccacctacatctagataactctcttggagaattcttaccatttgcttattcttctcaacaggattatgaaaaacattaggtgcagctgtcaaaagtctgctaatgaccacattttttagtcccaactcttgaaagaactgaacattcagcttctggttctcttggtctttaatagtaaagaaagattctggaaactgctctattaacttgattaactcttcctcatttttgcagaccaactgccagagttttctctgggtgttaacagcggttggactacagacaattgcttccgggcagcgttccaaaatactggctacagcagtctcatcggcacctagttcttgtaaaatattcgcaatttcttcaacataggtttcatcctctaaaagtacccatccttttaatctacgaattttcctaatgtcaactgaacatttatagagcttttccactgttcttgtattttctttgctcgactgtttatcagttgtataggtgaagcatgctaagaaaggtctgtattttggaggtgatcgcatctttctgaaagaacacagcctgcaggactgggatctcagcagcagcttccacaacatggctgcaatctactagctagtttccaccgtcctgggacttaaatggactcattctatctgaaaaaaagaaaataaaggtttttagtataagggtgttgactttcagaacacatacacttacaaatttgagctgttgaagtctggaaataaagtggatttaaattagacaagaaaactgctcatgtggaatatttttaaaaatcttcctaaataaggattgcttgaacccagaagcccgaggttgcagtgagctgagattgtagcattgcactccagacggggcaacaagagtgaaactcttaaaaaaaaaaaacctcctaaataattaattgaattgtaatacacttctcc

SEQ ID NO: 71262 - DNA, 1029 bp, Homo sapiens
tttaagacattttactcattcagcaaatacttcttcaattcttattgccaaaaactgtactgacaacttgggaaaattatattgagagaaccagggttttgaatgaactgtacaaagtccttatgtttttcatatttgcttaaaataaataagtaaatttgagatataaaagtctatcagtatttttaatgcatctcttacatactagaaatttcaggatcttctcacaattcaaatgtgtttgtaattttcttgtacataatatgcataattgtaagttcttttccccttttcttcattcaaggttttttttctgattatatggtcctagaaatgcactgtttaaatatttgggctggaaaaaactttgagtagcatttatttaatacagttggcatagctgatttgtcagtttcaagttttgattacaatgcacggggtcatatgtattgtaattccttgcacaattacgtggagccctaatacaagcttccagcaccctggtgcacatttctgctccctccctcctgaccagtgatggcagcttgcagttctaagtcctgagtttacattccttaacttccttttctgtatcctaatttccttttcctaagtgcaaatgacacactttggttagtctggaccccaaatcattttatttcaggaaaaagtgtgcaataaatctatgcataatagagtttttatattcggataactcaggagttgctggacaaacaccccccagctgtacacatgagttgctcagatcattctagaatatcctagagatcagaggtgggtgatcttgaggagccaggattcttgctgctactcagtggagttaaatgcacgtgtgagctcctctcaatatagcctgttgagcctaaactgcatagtgagactagactcaaagatttagttaacatttcctgagttcctactgtgtgcccagcattgttgacagaaaaaataatcagtagcctcaaggaattcactccacagggtgcgagggcagtctgtatgccagtg

SEQ ID NO: 71263 - DNA, 1039 bp, Homo sapiens
ctgtaatatgtttactactgtagcaatatgttttagtttttatttaacttttaggtttttttattgtaaaatatcagttcatcggcattattagtcattagggaaatgcaaattaaaacaactatgggatagtacttcatactcacttagggtgagcaactgccactgattgcctgggattgaagttaattaaaacgaaagtaagtgcacagtcttgttcaggccataaggtgttgacctatccacctgctcgtggataggtccagaatgctcatatttttccataaactggacacactgacagaaatgtttccctaaaacatacttctctgttctagccaacctattctcctataatagtgtttgtttttagaagggttgataggattgcttaggctaggtaactgccacatagtctgtgtcttctgcttgtcgtatgatttgaattgtttaactcatcgggcaggcccttattcccttatcctcaaggaaatatgtttggaggagctctgaaggaaaagcgtgggaaaagggacaagagtgagggaggaatgtctatctcactcttgcccctatgttttaccttcatggtcaagtttcaaattgtcatctagtaaggaaatgttttttagaaaatgatcatcaatgatttttcctttgagctgtcaacacttctgtgagcctaaatttaagttttcctggtttgagcatgtgatttttggttcataggaagattgagatttagtcttaaaagcatataaatgaccttaagtacaagcgctaaaagttggatttgtagacttaataatacatacatcttggatttgattttaagtaattttactgtgttttaaatactaacaggttgctctcaagggagtggtattttacactatgctcatggcgacagtcagcaaactcacctgttgaagcaaggtaagaatgaagcattggagcatactgttctttttccttttcctatcttaaacatacattttttaaatgtgcaggaagaagctccatgggcactggtctcagt

SEQ ID NO: 71264 - DNA, 1012 bp, Homo sapiens
ttacttctgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggtaaatcaagggtgattactactcagtttggaatagttaattcaagaagagcttttcatgtttaatcaatgcttaaagtattccccactcatgatgggcagcagagatgagaagggtaaacagatcatttaaatggtcttgatttgattttggtctgtcatagctagtagttatagtttgcttagagtgcattttattagtaatctttcttttttctcccaaaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtatgttaagaactgtctttgtttctttggcagctgtttatgtacttatctttgaattttatcttgatcataatttaaaagaaaatttttttgtcctttaggtcttctggcatcagtaccttctaatcctaatgggaatggaggcttcatgggatattctgcagaaaatatcccaggttgtagcagcagtggaagtaagtgaaaaggaaatttctgcacttagtaacatgaagaggttattaaacaaatatatttgttattgatcctcactaacatattttataaaaatctgtctttgaaattagcttaatagattctttgtatgcatgcatacatgtgcacccagacacatctcttcactccattgatgacattttagagatggaaaatatcattacgtataatagatactgggtcaagt

SEQ ID NO: 71265 - DNA, 1039 bp, Homo sapiens
gaggcaagagaatcctccacccgggagctggaggttgcagtgagccgagattgagccactgcactccagcctgggtgacagagcgagaccctgtctcaggaaaaaaaaaaaagagagagagattgaaggtgctctcagctttctgttggaaatttgaaggaaatttatttcacatgagtatgtgctgcacaaggacgactgaaacaaaagaatgctcacttttttatcctgtcttattttttattaaaacatgtaatttgtggctaggataagattttattccccaagaactatgtaactttaaaaaaaaaaatctccattctgagtgttcttttaaaatgaaaaagacaattagttaatataattttctctgtgtgttttcaggcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtattctctaaaattagagcttattgtttaatactttaaaaaaaaattctgataatacttctttgctttttaaccataggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtaagtgttctaactgatatagcatgccttattttgaaggaatccttaccttaataaaacaaatcctagaagttgtctgtttatagattcatttatggtgtagtttttcagtggataaaacat

SEQ ID NO: 71266 - DNA, 1036 bp, Homo sapiens
tcaacagttacacaagacacccctactaggtcatttgatcctgtttctaatcttttcaacaaattatacaaggcacataatgagatttgtttgccaaatatagaaaccaaaatatagattaagaaaactgtagttagggccaggcctgatggctcatgcctgtaatcccagcacttggggaggctgaggcaggtggatcacctgaggtcaggagttcaagaccagcctggccaacatggtgaaaccctatctctactaaaaatacaaaaataattagccagggtggtagcacactcctgtaatcccagctgcttgggaggctgaggcgcaagaattgcctgaacctgggaggtggaggctgcagtgagctgagatcgtgccactgcactccagcctggatgacagaacaagactgtgtctcagaaagagagagatggggagaactgacttaatttgaaatccattaggaggaggttttattttatatatatatgtaatatatatatatatattttatatatatatgtaatatatatgtaattatatataatatatatattttatatatatgttatatatataatatgtataatatgaggtaaaattttttcatcctctgaaggacataatgtacctcagaggttcagaagatgtagaagtgactttaagatggaagatttaaggttagtgtgatatgaacttaaagggataggaattgggaaaggtattccaagccaaggaaaggccctggagcacattccaggagattgaatgtgtgctgaaagagaagtttggtttggtgtgagagaaaggggtatgaggtaggaaatcaacctagaaccctaggttagtagccaagcaaaatgatttgttgtgtattgtatagggaatgagtcgttgaaaacctttgtatgggaaggtgtgcctcatgaagatctggaattgcatataaaatgaattagaatggagagagattgttagtaggcagatctattttaaggcattgcagtaaatacaagcaagagataatatgaac

SEQ ID NO: 71267 - DNA, 1183 bp, Homo sapiens
ttggactatttcatagacagaactagaaattctagttatataaagctgttctagcacagactggtaagtaggtcattgtgacggagtatactaaaccgtccactggttgctatagcaatgacctactttaggaaaatatttctgttgattcatgttgaagtcatcttttggaagtggtataaggaagcttactgcatataatttttaaaataacagcaatagatagtgatctctggaggaaaaaaatccttaaaatgtttaaagtgaagaaatatatattttgtcacctaatgcctcttcaatttaaagtggtgtgttcagtattgtaattaaataatatgaggactgtgcttctatgtaggcagtacaattatatgaagggatatagtgagttttactatcatttggcctatttaaaaagcaacctgttgtatgtagttaatagcagtaataacggagccatcaaatgggtgtagttcaagaaaataatatatatgccaaattggagaaggtctgaaagtatgttcctgttaagatgatatcatatgtattttcagtggaatatattaaaaataaatcattcatttcattcaatattgagtgtcccagagcacatgcatttctattacattaaagttgaacttggtgtgttctttggaacacactgaatctgaactctaacagatctaatcctttcccagttaagggtaaaggattgagcattagattttgtatagttttgaagtaacattattcgttcagcattaaagagaaatcacacacatcactgagttgatactttgaacctgggctgttagaggtattatcaaggaaaaattatatgcttagagattagttgagtcttaattgcgttgtaccttgttttataatatttatagtcacattgaccttgctactgggaaaggtttccttcaaatcatagttcaaagtcacattcagatgaagttgtgaattcaaagtaattctgtatacaggtgtaggcatccaactaattcacgttttcttttgtcatgcccaagtatttacatatagaaatgcatggggtgttttctttaaaaaaaaaaaaaaaaaaaaacaggaattattctcaagggaaaataacaacttctgtttgatacatatctaccatgtgctagagactctactaggtgattttatgagg

SEQ ID NO: 71268 - DNA, 1028 bp, Homo sapiens
agggaaatgtattctggatggaaagaacatcctgtgcaaaggtactgaagtaggagcatttctggcatgctcacaggatcccaaggaggacatgtggctggaacagagtgagtgagaaggagagtagtaagaaagatggagtcatagtggtattggttgcccgggttcgttctgtaggacctagaaagccattttaaggacttaaaaaaaaaaaaaaaccaccaactttaaatggactgggaagtcattgcagttggagactttgttcatagagatgacatgaccacttggcatctgggtgaagactggactggatggcagtaaggacaagtatggaagcagtgagatcagatagaaggccagtggaatcatctaggtcagaaatgatgaagaattgaacctgagctgtagaggtaaaggcagtcagaagtaatcagattctggatgtattttgaacatagagctgttaagatttgccatagttttagatgtggactatgaaagaaagagaggtcaaggatgatgtggtagtgttcaccaatatccaattcaccattcgtacctgggctatgcaacatttcaattctcagctctctttgcagtctggcgaggccgtgtgactctttctggccaatgaattgtgtgaggaagtacttggtgaaggcaatgtaaagccctgtatgtttcccagttcttcccctactgtggaggaggccttgtgttgaaattatagaaccacaaggtcataatagctgggacggtaaagtcaccattagaagataactagctggagctgcagtgaactcagcatgagcaagatgaaaacttttgttttgtcaagccactgatttgggaggttgtttgttactgcagcataaccctgttctattctgaccaaccaggtgagtctttgccctgattaacttgaaggatggaattaaatgagattggaagactgtgggaggagatggtctgaggcaatcttcaaagggagatgtttaataaatggaaggatatgaataaatcct

SEQ ID NO: 71269 - DNA, 1032 bp, Homo sapiens
ttgtggtctttttatgtgcttccactgttgatgatttttgtcttctgttttaactttattgaagactgccaaactgttttccaaagtagctataccattttgcattctcactgactatatatgagaccagctgctcctcatccttgtcaacatttggttttgtcaggtttgttctttcccattctaataagtatgtggcggcatctcattgtggttttaatttgcattttgttgttgtctgttttaatgtacttattttccatctatatatctttggtgaagtgtgttactctaatcttttgctaattttttattgggttgattattttcttattactgagttttgagagttctttatgtattctggatattgtctctctttgcctagtttatttcacttagcatagtgtctctacatgcattcacatcacaaatgacagaattttctgctttttaaaggtcgaatagtattccatcccggtcgtaatagaatatttctataattacagaaagttctctcataaccctttttgagtcaatccattcagggaacttaaaaaaaaataagtatactctcagtttctaccccagatctatcaaagaagtaatatccagggtggcgcttaggagatttattttgcaaacccctgtccccccaaccccagtatgaatataatgagccctgattaagaactatgacccagctggacgcagtggctcatgccttaatcccagcactttgggaggctgaggcgggtggatcacatgaggtcagggattcgagaccagcctggccaacatggcaaaaccctgtatctactaaaagtacaaaaattagctgggcgtggtggtgcatgcctgtaatcccagctactctggaggctgaggcaggagaatcacttgaatccaggaggcggaggttgcagtgagccgagatcgcaccactgcactccagcctgggcaacaagagcaagactctgtctcaaaaaacaaacaaaaaaacaaaaactatgacccagctgggttatatat

SEQ ID NO: 71270 - DNA, 1871 bp, Homo sapiens
cagggcgccgacaccatccgctgcgtctacatcctggacccctggttcgccggctcctccaatgtgggcatcaacaggtggcggtgagtcacaagcccgtgggaaatggatttgggtgtttaatgagtctgatgttaatgaattccatgcgatccgccaaatctgtgaatttagacgtgggactgtcttgcttataccgcttacgaattttaggtgccctaagtattaaatagaattgacttaatacttctctggccaaagagtactgacgacctgaaacactcggtcttcatcagtgagttatgtgtctttctgtgctaactggagctcctcccctgaatttgtggagaattcttagtgctggagttaaagaaacacctttcctgtccttagtggccattgtatatggattcccttggcctttttgtggcattcggaaggattgtgatgtttcctgtttacgtttgtgtctaggtaactcatagtatggagaaaaatcattcattcagtacagcaggctccagatccagtgttcttccaccttgaggttactgtgggaaaagcaagggaaacagcattatctggtttctctgctcggttctttttctcaactcctccttgtggttgccgagacaaagcacagtttttctttctaggcaagttgtagtccttctagggatcagagcactgaaagaaatcttagagatgctttatgatcttttcctgaaacaccaggctacatgattgttaggccccctggtggaaataaaagcatagctcaacagatagactcttgatcacttagcatgtgccaggcactgatttaaatgctagggatatagcagtgagtgaaagacagaaagtcatgtcttcaagcagaaagtaaaatatgtagtattttaggtggtgataagtattgtggaaaaaaatagagcagagtaaagggataaagaatacaagggtagggatggggttgcaattttaagtatgatcgggggaaaagtcacagagaaggtgacacttgagcagacctgaaggaggtggtgggatgcagatatctaagggaagaccattccaggcaaagggaagagtaagggaaaaggcagaaatatgcttgacctttggaaggaacagcagaagaatccagtatgtctggagcagaataagtgagggaaaaatagtagacgatgaggtcagagttgacttagggccagattgaagagagccttataagcagttttcaagatttgggtttttacttagtgaaatgggaataactgcaggattatgagcagagaagtaatgtgatctgacataagtttggaaaagaatttttctgcttgtggttctgaattggggagtggaggtggacaagaagcaggaagtccaattaagaagctgttggcattcatccaggtgagagatgataacggcttgaatcatagtaataatcgtggacgtggtgagaaataaacagatgctggttatattctgaaggcaaaatacagggtatttgttggcagattggatatgtagtgagagagaaagaaaaggagttaggctgggcgcggtggctcatccctgtaatcccagcactttgggaggctgaggccaggagttcgagaccagcctggccatcgtggcaaaaccctgtctctattaatactgaaaatataaaaattaggtgagcatggtggcgcatgcctgttatctcagccactcaggaggctgaggcacgagaatcgcatgaacctaggagacggaggttgcagtgagctgagatcgtgccactgcactccagcctgagtgacagagtactctgtcgcaagaaaaaaaaaaaaggacttatagtttggtgctatataaaaagc

SEQ ID NO: 71271 - DNA, 2605 bp, Homo sapiens
tgaaaccctacctccaccaaaaagcacagaggggcttaatttccttcctggtggctcccatgacaatcatcttttactctttgctgcccctgactcccagctccttacccaccttctgggcctggaacctcttcttttttctccctcagtatttcctttggaaggctctagtgtggaaatctggtcaccctgccctacttctgcctttgccattatcctgaagttgtgagtttggacaagtcactttacatctttgggcctcagttgcctcatctgtaaaatagggggctagatatgtaatacacccccaggtcctcttgtagctctgtggtagttgcttctatattttttcaaataggttttacttttatgaaccttaacaacttttaaaaacagtttttgtgtttaccctttttggaggaagtataatttaaggaaggagaagaccacagagttggttttgggcagggtgagtgtgtgacggttggggtttgctgccatcacaacctctcccacaccacagcgcttaactcttgggtttcggggccccttcagcctcctctgggtatgagatatactatgatttcattgtgatctcttcatgccttttctttgggcttgtttaaaatggcaggttgaatatgcagaagagttaaagaatgagtgattaattccttaggtattggaatcatacattaaacatcaaacctatttcttaaactattttgtacggagtctttctgatctgcaagccttattaaggacaacataccttacataatagattttccctcctttaacttggtagcatcatttatttattcatttgtgaattcatttgtttatcgaaacttattacagttgccgaattctagggtctgagcaagtgctgggtaagaggtaataacagctaacatgtatccagcagggctctgtatattgacccatttgatccccagtacccattatatacaggaagaaactgaggcatagggaacttaagtatcttgcttatttaaatgcagatagcctggctccagagtccgtactcttaactcctgtctgtatgactctttagtgacagatgagttccctgccttcaggcatcccacctgccctttattacccacacaggtgaacagagacccttcctgtcatataattcctgaattatatactttttgttcctatcaaatggaactgggcagaactggatttttcatgtttttctatcccctgctaagcctaagagaggccctagtacacagttggagcttattagatacctttttgagttgagcaagctattgtactgtattatacaatgatgtcctgaaagaagctattgctttttgagtttcttgaatcatctttgcaagtttttctactttgttgttattgttgttctaaagaaggggtctcactatgttgcccaggctggccttgaactcctgagctcaagaaatcctcccacctcagccgagtagctgggactacaggcaggcactggctccaagttcttcttccttggttgccccttcttactgccatttctgtacctgtccacctttctaatttgctgctgctaaactgcccaggctaaggaattgtgaaactagtcacatgggactggattcagaaaaaaaagataattggctctaaagcaaaagaaggcttaggggctctcgaaaatcacatccatgggtttgctgtgggcatgaactttgtggttatgtaaaaacttttcagaactggagttttgtgttgattttcagctgttttgaagagccggggaaacagctaagggaccccattgatgtttctgtggagttttaaaaatttgacttgattgagctaaataaggagggggcagaagtacttcactgtgcctttgtatgtgctagtcattgtaccttaaactcctttagagctggccagttcctactcatccttgaagacttggcttcaagaatgagttggtcttcctggcttccttgtgagggcttccttgatgcaaccccttctccattcttattcatctctgtgtctccttccatatcactcagcacagtgcctggcactttgtataacagatactctctactgcttgttaaacgaatataaccagctcattcaattttaggcatttaaaatttgcctatcacctgtaaaggcagttgttaagagaatggcctctggtgttggacctctaggatttgaatttcaaggctgccattttctagctgtgtgttcttaggtatgcgacccaacctctctgtcctccagtttcctcagctgtaaaacagaggtaataattacaaggattaaatgagattatgtgtctaagcctattataatctggtgctgacacatggtaggtgctaaaatgatgatgatagttgtgataatccaggcacaatggtatctcatctctatcacatccagattaattcattcccacatgcttagggtggatggagccaacaaggcacagaattttaactggatcctcctttttattatagcaccaagtaactcagtacacccacctcaaggattgatgccatgggcacagccctgtggccagggtcacaaaaagattgtt

SEQ ID NO: 71272 - DNA, 1915 bp, Homo sapiens
cagtaggtagagggagacagtgagtgtggaggagcttaagaaaggtggtacaggctaagcctggagggacttaacgttgcttgtgttcacatatcattgaccagatgtatcattggctctctgaccaccaatacatgtgtgcctccttcttcctatgcacaaaacacattctcttttccctaagggaggaacccacattttttctgatccctgcttccaacttaaagttcagagtcatggatagtcctatccatgaagctgagtgtggcacctcaccatggtccagggacccatgaggcaaaacaaacatattatctgccactctgcattcatatcccacatctgagcagggtgggataaccatcatgaaactcccatttggaaaagataatcatggaaggtacatacacagcagtcactggtcctcagtagtgatgaaatcttgccaaacaagcattgtggggttgtatcctagcagtgggtgaagttcctggattaggtcctgattcttctcctgatgggaatttactagttcattgttctccaccctctcagctgtgctggtgggaggattttctttgttatttttcgtggccacacctgaagttggtcgtgggcagtatggccttcttgggggctctaaatcttttgtgacctagttctttcccttgaacctttgggggcccaaggattgttttaatgcagtaacagtaaaagactattaaaattaaggtttatagattttgcaatgcaattccctcaacaatttagtaagactttcatctatgatgtctaatatgccagtagccacacccagagttatttcctagacttaattctgaagcccggattattacttccttttccccacacctgtctttctctctaaatttaatggcagctaccttgaggtcatcaggcttaggtgggaagcttatattcttaatatgatacttatttcacttaaatgtcttcttactcttttgtcttattgtttggggtttagacatagttgtctgtttttacctctccactattcctttctaaaattactttcaaactggttaatttaggcctgagttcttctctttccctagtaccttacttaactcagccaggaacagttagcaaactttattaccattattttttccagtctctttctatagagcatacaggcttagtaggcatgagctctgactgccaagttatcatagatgacagtttaatgagacattttacttctgtatcacatgggtctccagttttccaggctctagtataacctgctacctgacttctaagccaatgtcacatgttttaagcagcccacttctggaactaagttctatattagttagggtaatgctagctgatgtgtcacatgaatcctaacgtcttagtggctgaacataatgaaagctgctttctcattcatgtagagtccacctgatggcaggggagagaggtgctctgtctgtggaagttgatgaaagctctgccatcttggacgcataactcccggagatgtctctgattgaggatgatagagaatgtggaggattataatacagtcctgggtgtgggtgtgtcaattccttccgcattccaatgaccagcactcagtcacatggcctccactagatgtaaggggactgaaaattatggtctctggtagggcagccacccacagccacaagtctacactatcagaggggcataagcatttaatagagctagccacctcaacaaccttacaaagcaggcgctattattatccccattttacagattaagaagttgaggaacagaaggtttaatgaatttgcttaaggtgacatggcttgcaagtggctggccagatttgaattaggcatttggcagactgccttatagaatacttgtgaggagcaaa

SEQ ID NO: 71273 - DNA, 1033 bp, Homo sapiens
gagaactcaatttaaaaacagaatttaagtctgagggacttcaaatttgaccttcctctcaccataccatgcctcattccaagggagtatctggtttaacgctcacattttacagatgtggaaactgaggcccagagtgggctactgtcttgtccaagatcacacagcagagctggaaccggtatcccaggtttctggatttttagagcccatctcccatccacagtgatgtattgtctcctctaaaccagatcactcgtgggaagcatagtgggatgaaagcctgcattgttgacagcagtttggagattaatttacgatcctgctgtaatatctccggttttgctatacatctcacagtaaaataaatgctagtctggaagcatgtggaggtccccattacatcgtggctgaaccactgaaagcaattactgtgaagatcaggtgtgctaaatgcagaatcaaattaacagttcccctgtgcattcatatctaaaagcaaatcagagaggaagctttgaggaggggtaagtgaaatcttaaagtacagtgcctgcctctgaggttgaggctgcatggattaactgattttctctgggtggtatgtgtcattgttccttcctaatcccagctcaggttaccacccagagagtcatgaggtgcacaagaagcacaccagacttaaattacctttctttctctggatgcttctgagcatttcaagtactgggaacgtggcacagcctttttctctctctgactcctccctcagcccctttcagccttctctatactgactttgaggtttaggggctgggctcaccctcgtgagcaaagccacaggtgcttcccgccctcatggagcttgcaggcttgaggcgggtttagtttactcacagatagtcacacagatgtcaaactgcacccatgacagttgctccgcgggagaggttcacggggacaggagtgtttgatggggacaaagcctccttagactgcggggtgaggtccagggcggtgcctgcaaggaggg

SEQ ID NO: 71274 - DNA, 1034 bp, Homo sapiens
ttttgtgtttttactctgctaaaagatttccactgaaagattgtcacaatcaaaatctttatgtattctgctcacagggcctctgttatggatcttaatcagtcatcatgttttccttaaaatgagttttctatgaaaggagaagtgggaggttattgattgtacatcgtatatcaaaggaagcttcagtgtgttttcatttgggttaagcaatgggaagtatttgttgctatagtagtgcccgagaaacagggagcttgtgtgtgtgcatgcacgtgtgtgtgtgtgtgtgtgtgtgtatgttgcatgtgcatgtgcctatatcaactcagcagaattatcagaaattggacgcctgccatagcttctgagtgtgggttgagttttgataactaatttgccaactgtcatgtaggcaattctaacatcttcatagactccagccttcttatctatggaggccccatcccatgtcacactcaaacacaaaccattacctttatattcctggctagaaaaaaatttgtaatgattttgcttttgtggaatggtttttgctgtgttgatatcatatttattttatgagggctctgatttatctgctattattttatatcctcaggaattcttccaaaatgagaaacatctaaccagactttttttttttgccccccaacgaaattgttgtgaatactgaagtcaacaattaattatgctgacttcacattaagcatgttagccatttacatagttattaatcatggctttgcagttttcttttcatgtgttggagttgataatttttgaagtgttggatattttcttgcgctcaagaaggcccaagaactgagttgcttagtggagaaaaaatggtcttgtgcttttgacataaagaaacccagctgagactggcctcagaaaggtaactctgagagtttcattctctgactgaggcatctcacacattctcaaatgcatacacactcacactgtgcagggctatgcagttgttaacaataaatagaatctagtac

SEQ ID NO: 71275 - DNA, 1025 bp, Homo sapiens
tttcctcctttgaacccccgtaggctttgcttgctgtctgtaatacagcttgggcaatgggtcatgtatgtccttttgctgttgaaagtgttttgctgtggctatgacctgcccctccattggactgtaagctcttctagggcagggtttgaatctttcagttcttttatttaaaaatttttatttttagagacaggatctcattctgtcacccaggctggagtgcaggggcacgatcatggctcactgcagcctcgaccccccaggcctaagggatctgcccatctcagcctcccaagtagctgggaccacaagtgcacaccaccacacctggctgtttttttggttttttatagaaatagggtctccctatgttgcccaggccagtctcgaactcctgggctcagcaatcctcctgtcttggcctcctaaagtgttgggattacagacatgagccaccatgtctgacctcttccagttcttttgtatctctttcctgctctctgctcaatgaagatgcctcttggtcaatactccctcagttagagcacaaatgcatgtattcacttatagagtgttctgattgctaaaggtggctggaggtgaatgtgccatatttgaccaataataactttgatttgaaagtattggccaatccgatgccacaatgtgtttgactgctagtgtcagagaccaaactaacagtggcttaaacaaggtagggagttggttttctcttttacaacagtccaaggcaggtaggcagtccaaagctgggatggttattatattagtccattttcacaccactataaagaaatgcctgagactgagacatatataaaggaaagaggtttaattgacttatagttctgcatggctcgggaggcctcaggaacttatagtcatggcagaagacgaaggggaagcaggcaccgtcttcacaggcagcaggaaggagagagaagtgtgagcgcaggaaaaagtgccacttttaaaaccatcagattttgtgagaattcact

SEQ ID NO: 71276 - DNA, 1153 bp, Homo sapiens
gggactgaattccccaaaggaaaacaaggaaacctagggagacaaaaaaaaatgcccattctgcaatgtatttttccccaaaatttgaactgactgtgggcaggtgttggcagtagggcttggtgggtggggaggtgggacaaagcctgggatcttaagaggaaacagtgggtagaaggaaatgaatgacgagctagagaagctacttggacgtaaggagatggctgctcttttcgttcaatagttactggattccaaaagttttacaagacattatctcaattaatcttcataatggtctcatgaggtatgaactcattttagccttgttgcaccagtgaggaagcagacccaggaaggtccatggatttgtccaaggtctctttgtcattaagtagcacaatcagggctcacacctggggctgttgagagtggcgtggagcggagcttgtgctcattcccatccagctgccctgcacactggaaggaatctggtagtgaaaacagcatgctcctgattagggattcttttgggggctgctgaaataggtagtcctcaagtccctgttgcttctgagtttgtgatgtgggggaagatggaaagtctagattgggatgggggctaaactgagaatactttctggaagcacccccattgaaggaagttagggggcatctaggaggagaagcatccagggccaggaaatggccccttgtgatggtccagagaaggcatcctctagctatagctcttcgttacaagaaataccatcacataacaggaagcccttcaaattgattctgctcttaattttttttttcagatagaggcttgctctgtgaccgaggctggagtgcagtggtgtgatcttggcttactgcaacctctgcctcccgggttcaagcaattcttctgcctcagcctcccaagtagctgggactacaggtgtgtggcaccacgcctggctaattttctgtatttttagtagagatgggttttcactgtgttagccaggatgatctcaatctcctgaccttgtgatctgcccgcctcagcctcccaaagtgctgggattacaggcgtgagccaccatgcccggtgagtctgctcttaattttttgtcaataaaaagtacaatttttactggagaca

SEQ ID NO: 71277 - DNA, 1073 bp, Homo sapiens
taattgtgtgcatcaggaacccaggaagggctcagctggcagttcatctgtgatgcatgtggctcccaagatggcttcttactcatacacttggtgccttgatgcgtttcgacccccctctttctacattgcgtcttgtcttctaaggtctctccacagggcctgggcttcttacagcatggaggtatcagggtaatggctgtttttacatgatggctggcttccaagagtcaggagttagaaactcccaagtcagttaagggctacgttcaaaactgacagtgtcactttcatcattggtcaaggcagtcacagggttgcctactttcaagagagtgggaagaatcccaccccttgatgggagagtcacaaggtcaccctgccaaaaagcatgtgcaaagggatcaattgtttacttctttggaaaatgcagttggccacaaaggacatccagatgtgcagtttagtaaagtataatgcagggtggtaaccacaacaatgaaataccagcaagctgaaggaggagcccagagatggaggaacaggcttgccagtgggctggggtggggagaaggtacagaaggcttcaaaagaaagagcaaccaggggttgaaagatgggttttgaaagatgaatagtttgtgcactttagggagagagaattgcaggtgggaaggcgtggtggtggggtcctcatgaaggccttactcagaaagtctccccatacttcactacttttatttatatgtactaatatgtgcatgcgtgtgtgtatatatgatgtgggtatctatgcatatgtatgtatttacatatgtatatagaaatatatatatacacacatatacatatatgtatatactcatatctacacacacacacgcacacacacacacatacatattttaacagagacttccattcagtctttcattcagtaaatgtgtcctgaccacctaatgtatatgccagacagtattctaggtgctgaggatgtggtggtgaagaaaacagaagcagtcagaagagacctgttcacgcctggtgcagtggctcatgcctccaatcccagg

SEQ ID NO: 71278 - DNA, 1020 bp, Homo sapiens
tctcctgtctcatcagggagccccagaagctccttggacggataaacaaagtcattttcttgttcccttatctcttttcatcttttcatggcaggtttgcagcttggggctttgagcactgccaccctcatcccccaccctgccacccttgaatgctccaattttccaactttctattacaggctcagggagaatatgatgtaaagatataaaataataatgaaattgcatctaacaggtttattatatatatcagaacccatgaaacagacataataactttatgcaagaagaaatcaaggtcataggtggttaaatcatttgtttagttatactgctggtatgcagcagccctgttgaactacactgctgttgagtatcagcagtgcaactttaaacaaattatttaaccatgtgtaactttgaacccaccgtctgtgctttcatctactaccagtgtgccctaaacctcagttattggtgtaacaccttcataagtcacttctacctcttgtgctattatttagctaatgttttttattaaaatcatctttaatatttcttgctcagcaaaaacatgtcccattttaaaaaggctgtagcacagagggtttgatgtgctagttttatttttttgtactacaccttcaaatgaataaacacataactcacaataaaaatgttcatccatataccacctaagaccagctttgcccaacaacgatagctggtccacacttgggggtaggaaatggcgtgatatacggggatttgcttatgggttcgtcataggtaggctgtgtctgtgttttattcatcttagtatccttaccaccaggtaccataagagatccattatgggcacttggtaaatgatgaatgaattgatgacagaatgaacggagttatcaaggggaagatgaagaatgaatgcacttccccttccttatggagaagatcggaaggaatcctctttaatacgatgaggaggctggctgggagctggggcccagcaccgca

SEQ ID NO: 71279 - DNA, 1050 bp, Homo sapiens
tcctttctccttctgttcttctctctctttctcctgcaaatattaaattgcctacaatgaaccagacagtactctggggtccaggagtaaatagcacagacaaaatcttctgccctcagtggaatccacattctagtggtggagggggaaagacacaaataaatgcaatctgttatataaaatatatagcttgttaggtggggataagtgctacagagaaaaatgaaccagggaatgaggatatatgcattgggagactgtgatttttgctggggtggcaggagaaagtggcatgttagtagaccttcaaagaagttagggaattagctccacagatacctggagaagggctttctaagcagcaggtacagcatgtgcaaaagcactgaagtaggaatgtgtctggtgtgtttgtagaagagtgaggaggcctgctggagtgcattgcggaggggaaagtggaggatataagttcagacaggtaatggggtggagtttaaaatcctgtctcaagtaatgattctcaaactgtggtccctaaaccaccccaaacccagtgaatcagaaactctgggggtggggtccaccatctatttgttttttttttcccaagacagcgtttcactctgtcacccaggctgcagtgcagtggcaccatcttggctcaccacaacctccgcctcccaggttcaagtgagtctcctgcctcagcctcctgaatagctgggattacaggtgcacaccaccacacacagctaagttttgtatttttagtagagatggagtttcaccatgttgaccgggctggtcttgatccaccctccggtgattcaccctcctcgccttcccaatgtgttgggattacaggcatgaaccactgctcggcctccaccgtctattttaaggaggcctcctaggattctgaaacccactaaaatgtgggagccatctctctgcagcatccaggccaggcctgactacccccgaagagtctgctgtcccatcttatgttctggcaggttgcgggcagcagcaggtgtggcatgggac

SEQ ID NO: 71280 - DNA, 1110 bp, Homo sapiens
tagaacatggctgctatcgattggaggtttgtgtcccaccccgccacctcaacttgtatgttgaattttcctccatgtgagagtattaggaggtgcggcctttgggaggtaattaggtcatgagggtggcatcctcatgaatgggattagtgcccttataaaaaagggaccccagaaagctcacttgccccttccaacatgttaggacatagtgagaataccaccatctatgaatcagaaaagaagccctcattagacattgaatctgctggcaccttgatcttggactatcccagcctccagaactgtgaaaaagaaatgtttgtcgtttgagctactcagtctatgatattttgctacagcaacccaaacagactaagagtggcttagtggtgtagccacagttggcttcctgatactgaatgctacaatgaagcagatgtaagtacctactcatgagctgtgctaggaaactgcagacctcaacctggaactatggtaatgctggagatcagcagaatgcttgcttcctgctagtagctggctcccaaggaggatgcgtggatgagctcagctatgcctgccagcttctcttcccaaactcattaatgagatgaggccttccatctccccagggaagacgtaaggggctaatgccaggaatgtcatacaaatggatgtccctccacgtggcaggaaacatcagtagaggggaatactgttctctaataataacaataaaaatggtagaccaggtgtagtggctcacacctgtaatcccagcactttgggaggccaaggtgcgggggttgcttgaggtcaggagtttgagaccagcctgggcaacatagtgagacccagtctttaaaaaatatttaaaaattagtctggcaggttggcacatgcctgtagtcacagctacttgggagtctgaggtgggaggattgcttgagccgaggagcttgaggctgcagtgaactatgatcatgccactgctctccagcctgggtgacagaacaaaccctgtctaaaaaaaaaaaaagatagctaatttgtactgagcactacgctagacatttttcatgcatcttttcttttgattcttctaac

SEQ ID NO: 71281 - DNA, 1255 bp, Homo sapiens
tccagagatcactcagccattataaagctgcctccccgtatcagcatcaccagacttttgaaagggtgataacccttaaacttagaggaagatccagctaaaaggccagacttccagcttgtcattgtccccgggttgaaatggcatgcccctcactgcgttggggcaggccttctgcccagccttgttcccatgaaattcattaattgcttttgaaagaaccacttcaccatgtgttttaaattaccatgagcagcaattatgatggactgcacacaacagagaggacttgacaagtgtccttgcttcttagagaactaagagagacacacttgagttcacaaagtgaggtttctgatgattccattttgacttaaggattgcagtgcctcattaaggatctgctttaatttagggagaaaacaatgaatctgttaaagaaataatttttgattagaaagaaaacatataatttgggaggggaggatgagaacactaattaaacttttaattgtgtctgttgccctttagggtgtaaactaagaaactgagtaaagcaagagaaacagagtttttctttaagcggttttccattgttctaggcaattccccacagagcagccacctctgttgtaacccatttttagttgtaattgccatataagctgaaactaggctgttttttcttctattttttaaagcaagaaattttggcattttaaaaattacatgtcgtgataattttcttattctttaaagattggctaaggtatactaagaaattggaagacctacatatttatgcattagtatatctgattggtaaaagtgtgagtgaggaaatacaggatactgattaagagtgtggattctggagtcctaactcttgaggctcacagttggctgtaccctctagctatatgatcttaggcaagttacccaactcttctttgctttagtttcttttctgcaaagtggggttaacaacagcacccctgtcatagagttattgtgaggattttgttacgataagctgggttatgctgaagtaacagacaaatcccaaatctcagaggttgaatgcaaccaatgtgtacttgtcactcatgcagattcctttgaagggccagtgaccccagacagttgccctccatgtgttggcttgacatattccctgctgtgtcaattttacagccccttcatatcaacatgcttccattcttgctgcaaaaggaaaatagattatggagaatta

SEQ ID NO: 71282 - DNA, 1046 bp, Homo sapiens
taggccttgagtatatatttgatgaatggatgaatgaatgaatttgcatttatgctgcaaactccttgctccatgtctctggatcaggttgatttatctgggctcaagttccttaactgaacaatgggcttatattcaccctaacacctcacagtgttgtgtctggctgcagttcagaaggaaagcagacctgcagccatctatccaccttccagcggaacagattctcaggccccttgcagccctggcattgcgcgatgctgtgattcgtctgtgacccttaaaagacctgcccttaactcccggggtgcaatacagcagtagaggttctcagcaccgagaaacaagtactactgctgtggcccagagcaaacagttttctccttcattctgagttatgtaataatgatcagagctgccttttattgagtgattactatatgccaggtacacatgctgttttattcaaccctacaaccctcgcgctgaatgtgcaaggtgctctcagcagccctgttgttcaggtgaggggcccagaggtataaggggcagattctccatttgagcccaggcccgtctgagtccagagtccaacatctcaccactgctgtgtgtttttctgcttttcaatgaagaaaaagcgtcagtggctactacctggactgtcttggacatggagatgcactgctcagataccccttcaggactgaagggcctcccccacagctgaggggagtgctgctggcgcagctctcagctttctgtctgctttggaagttgaccttgtttgagagagcttctgggccaaagtctcacccctctccctaggcagcccatgtccagggactgattgatgtaggggtataaaagcccagcccccatgcaccaatttaggacagcgctgaagcatcatcctagcttgctaacacccaccagaatggcctgaggcctctgttgagactgcatcacagtctaacttctccctctgtccggttttgcttctcacccttccctgccactggggttgagcccaagaacacttcctt

SEQ ID NO: 71283 - DNA, 1054 bp, Homo sapiens
cccctcgtagtttccagaaggaccacaacacacacttgacgctcaagaagggtgggaagaagataagtgaatcatctggtagggaagtaaaagggaaccatgcaaagcgaaaaagtggggaacataatctcattatggacttcgggagaccaagccatgtgtaaatttcacaaacaccagtggagtgcttcctttgtgcaaagccaatgccaacggctggaatattagatgattcagctgtggtccctgtccagaaaacacttgtgactcaaccttgggcatgtcccttaaccactttctttggcttggctataggcagacatggtctcttaacctcaagtcacttaaatattgggggatgatgggattgcttcctcctggcatcttccctgctcatccccttactttgcacatcatttggcaatgactgcaccactgccaccacaaattgctattaattattgagcactcaccatatgccaggacctgcgcttaaagcaatttatgtacactatggtatttcatccttataacaactctataaggcagatactgtcctattttatacatgaggatctgaggctctgggagcataggtaatttgtccaaggtcttatagcaagtaagtaggggagctagggctgtccaacaatgcaccccatcctcttagtcccctccacctggagaagcccaccagttcatgtttttggctctcaccttgtccccttacggccctcattccccttgagctgtctagttctgcctccacacactggctcgccttccctgtttcccttgtcacaacgcatcctgactgttcatgcccaaacctacaactgtgctggctccctctgtctttgggactaagaatggatcttctgtcacttgtgaaaacgtcccctgatgggtctttggctgcatgccatgccctgtggacaagcattggggttccctaagaggctgtaaaataggagtcactgggattctgcctgcatctgatgtgagagccacccctgcttttgtagcacagagtaacagatggtgccagaaggaa

SEQ ID NO: 71284 - DNA, 1050 bp, Homo sapiens
catttgtgtctgtttgcatgcatgtggccattcgcttgaatttcgccttttctagcccgagtctccttacctgtacaatgggaattgtaataggatctacttcctgccatgtgtgaacattcagtgagatgaagtactcagagcatggtgtctgggatgtggtaagtggtcagtgttaccattgttattggttatggctgttatttagggacacgcaaagtatacaaagagagacttacacccccccgcaagagtgctacctgagtgaagtgacctttacccagttcactgctgagctatgctcaagctaatctcccttcgctggtttgtacaagcagatccggtgcccagaggaaaatggactggcagtgaattgattacttcctgcctccctaagcagcctggtttcgaaaggccctggtcaaattaaaatgcattaactgagtttgtcgaggagcgatcagccatctgagaagggccggtccctacctcctacccacatgtgccaggctgatgaccatgtccacattcacatgcaggaccacgtagtaccaagacttgtctcctggccgcatctcagctctcatggaaacctggggtttggttctgagcctggagacaaatgaggtggctgtctgtaccatgtttcccaatgggttccttttcatgtgcaatattttctctgcctattgtagaggctcagcctcagaaagcaaaagcacaaaaaggccaaaccaagaactagaccaaccaaaggaagccaaggggaggtgattacgtaaccccagcagccaggctgtctgcaagccgtatgacttatttagctgtctgtcttttcggatgtcagactccatcctttccagctggctctccgctttggtgattatattaacactcagtaattataggaaatggacacctctccagtcaccagcattcccaagtggcgggatgggggatattcaataccaggaacaccccatcacagggggtcagtcactgcccaaggtttcagtagtctggcaaaaagagacagaaataatggcacag

SEQ ID NO: 71285 - DNA, 1096 bp, Homo sapiens
ctcttctggacactgagctacagcagtgaacaagagacagagtccttggcctgagggaacttatactctagtggggaagacaaagtacaaagaaaaaaatatataatgtaatgtcaggtaatagaaaatgctatagagaaaagaaaggctgggaggtagataggtttggggagctactttcaatgggatagtcaaggaggggtctcgaggaggtaaaatttgagcaaagagagggatccaggaagatactgggggagaggaatctagatggaggaaggaacaagcgtgaagttcctaacatgagaatggacatgatataagcaaggccagcatggccagggctgagtgagcgaggacaagagtgatggaagatgggtcagagagggagatgggtcagagagggagatgggccagatctgcaaggccttacaggccatgatgaggccctacaggttgcagaaagtctttggattttatccaaaatggaatgggagcccactttgaatgcatggttccaagcagaagagtgacatggtctgcattaggctttaaaggaataattctgccagtctgctaagtggagaataggctgtagaaagataagagggaaacagtgagaccaagaggagactttcacagttgtttaggtgagagatcttgatggcttggaccttgatggcagcagtggaggtgatgagaagttggcaagatttgggatctattttgcaggcagatctgccaagatttgctaacagattgaatgaggagataacttcttatgcctcttttgtgcaaagcactatactaggttgtattaattaggactcttgcttataagagcagaaacccaactcacactggctcctgtaactgaacagtcaagccatagatgagtttcaggcatagttggttccaggattgcaaattatatcttcagaatttagccttctctcttatcttggttccatttctcacatgtagcccccagcagctctaagctgacacaaagcttatggatatcaattgccatggggaaagaatatttcttcctctatagtttcaacagaactgatggttcatctaccttatgttacct

SEQ ID NO: 71286 - DNA, 1038 bp, Homo sapiens
cagagcttgacaagcaaggtggccctgggaacagaagaaccactgaggaaggagcagcccccatgggaagggaagtggatttgctgagtgccactctgcgtgtgtcaggtatgttctcctctctgcatcctcacaacagccttcagcagggtaggccattgtcttaggttggttttgccccagaagcagaatctaagcaaagatgtaagctctagaattatgtgggaggtgatggtagaggagtggggaagtgagtcaagaaaactaagatagccaataaaggggtgctagcaagccagctgtcttactctgttctggccgctataacaaagtaccattgactaggtggcttataaacaacagaaacctgtgttacacagtaatggaggctggaagtccaagatcagggatcagtcgggttctagccagggccctcttctaggtttcagcctgccaacttcttgtcctgccctcacatggtggaagagctaaagagctctctggggtccattttatggggacactcatctcattcatgagggctccatcctcatgacctgatcatctgctaaaggctccatctcctcacaccatcacattgtgggttagaatttcaacctgtggaatttgcaggacacaggcatatttgaacactgaccaccatgggtgactgaagcttattctcacgagggaaactggtagccagtgtagaacacatgtctcagagttatcccacctgtagggcaagacagctgggatatgtatacaccagcttccatcagtctatggttgggagctgcccctagcaggcacacaaagtgggctctggtggcacaagaaggctgataggtaaagaaatgcaggtgctggcagtaggaggtcagctggcatgcactgaagtggtaagtcaagggcatgtgggcgagacacccacagcgtctgctacagcctttctctgtgagcccttgagggaggacttttgtcttgttctttacattcatagcaatcatcacatactcagatgctccatcgaaatag

SEQ ID NO: 71287 - DNA, 1035 bp, Homo sapiens
ctatacttcagcctaggtgacagagttagaccctgtctcagagaaaagaaaaaggaaaaaggaaaaaaaaagtgtcatctggtatctggggtatgtgcttagaatgcagaattctgatttcattcccagagacgcgattttagtaagtctggcacgcagccctggaatcaatgttttttaaacaccctaggtctacactgtgagaaacactttcattttcttattcttcagggcagcgacgagtctctgcatttccggggcctagcacagggtgcatggctggcactcagtaaacgttagctaaatgtatagatgagtgagtgagtggatgaatgtttttactttggatctttttttcaattaagcaagaagttttcagagtaattcgggtcctattagaattttaatagagtataggctcaaataactttcctcctttcaaggatataacctaatttgtgtctgacaagtagagaagattgtagatttcgtttccttttttgcctgttggaaaccgaacattttttcgtttgtttaattgtgtaccacaaaatgtggaagattgatgtctctggataacatttatttggcagaatatcttgacatcggatggcttttcctcaccaggctccaaaatgttaggaaacagagatgtaagtaaagaggcttgtggggctctttcctttcctccatttttcctttctttcccttccagttagtaatggttccaggattagtggtaagggacttctgaaaagcttaaagcatgaaaatcctgttagataattgtgcttcctggaggcccagggggactcttaagtaaggagcttcgaggaggaaagggggttgtggggagacttggcctgcttgcctcctggaatcttctttcccagacttggtgtgctccattcccagggcagctgtcttagtccactcagactgctgtaacaaaatagcataaactgggtggcttagaaacaatgtttatttctcacaattctgaagtccaggatcaaggcaccagcagattcagtg

SEQ ID NO: 71288 - DNA, 1061 bp, Homo sapiens
agtactttcagtttatggaagaggacagtggggtcagagagcccaagcatgtggcctgaggtcacacagctagagagaggcagaggatttgaatcccgtctctctgattctagagctgtggcatggtgccacattggtggggataaatctgcaccacttaactgtatgatcttaggcaagttttctaaagaaatactttaacatctgcatttgtctccaagcccaaagggggttcaggtccatggttctttcatatctctgtgctgtcgcccatgctggtctttctgcctggtgtgttctttctgtctctcagtgggggatcttacaagatctggttgtgatgggatttttttttttttggtgttgtttcccctacagatagtgagctcctgaaggttgtgagcagtgtctcactcaccactgcttcctccatgcctattccagttctcagtagagagtaggtcctgtgtcagttagctgttgctgcatagcaaaccaccccaaaactcaaaatgacttaaacaataagcatttattagtagtattcacaagtccaggggatagctctatggttcttctgttctcagctgggcttttgcatgtatcttctaggtcagctgtaggacggggagtcagctctgctttctggactgggctctctcacaggttagggtcagctggctgcaggctggtctaggacggcctctgatggtacagctgggctttcctccactgtctctaatcctatagcaggctaacccaggcctattcgcatggccatgctagggcacccagagagggagcagaattgaacaagttttctttaggtctgggcatagcattcaatcttgttatagcaccatcacatccactgcactgtcttggccaaatgaagccacaaagtccagctcagagtcaaggtgcaagggcgcttgcaaagaatgtggacaacagaagcatgagaaatggaatacaaatgtatcataaatgtttattaactaaataaatgtacatttaacatgtgccaataactaccgtaagctttttccatattaacacgt

SEQ ID NO: 71289 - DNA, 1053 bp, Homo sapiens
aattgttcacgaattgaatctcacctattgactctaggcagaagccacttcgagacccgcttaggaaacacctggattctgcgttactccacagccactgacacatgtatgtgcatgcactcatacacacacacacaaacacacattcacacacacatgccaacacacatcaagacccagctatatcatgatccactcagggatccagagaaaccagcttcttgaagcaaagttcattttttcctgcctatctctgtcagagacagggactttagggaaaagaccaggagaaaatgcttctgtttacatcaaaggtccctccttttgtttactaagaactgtttcccacacgttttctctgaccgctattaaacaaacaacagaggcttgcctggcttcagagggctcaagatgtggccaccaactgatccctccagatgtgatccgcttccatttagagaccagaagaggcccccctctccccatgtgcaggaagaagaaaaggaggcacctgcagagacccctcgtcattgccttggcttgaaagattcttagactttgctgaaatgcatccatggttttcacaaccgagaaacgccagtcatcctctgctccctgattttagctcacgagctgaggtcagctgaattaagggcaaaatgtgcctcccagaaggctgggcagcagggaattggtgttgtattaatcaagcaaaaaaggggaaaatctgaagaccaagcactccctggcaagagtgcaggtgagctggagccagccggctggggtgtttatttttcacttctgtgggcctggcaggaggtaggcactcttttccctcttatgctgggagagagggaagctgaccagtcagtggccttgtgagtataaagagtttaaaggcgctccagcttctagcaggagaccaccagggccacaggaagttgcagatagccagggacctgcgtgtgagtagcttgctgctgggagctgccagctgggcacgggagactttgagggtgaccttgaaaacaaacaatgctgcttcaaagatcc

SEQ ID NO: 71290 - DNA, 1041 bp, Homo sapiens
acttgggtcactggttgtggtcctctgtgcaaaccaacggcacagagctggagggacctgagaggccctcttgtcccctccctacctatagctcacccccatatttagagaagaaggcatggaagcccagggaggtgaaatgacttgcccatggctgtggttgtgtatccatgaggactcttccagcaagtggaagaaaatcctactccaactagattgagccaactgttttcattcagtaaccaaaacatccaggtttcacctttgacacagctggatccagggactcggttgatgtcactgggtcttgtctctggccacttcttcactctgttctctccctgggacattctgagctgtcttggaagcgagatgatggttggactttcaggtttcaacttcacagctttaatcaagggagaaatcaagagtctctctctctctctctctctctctctctctctctctctctctctttctttctccctctcagtggtccctgtgaatgcacctgtgggctctgagttagggaatatgtccatccctgatccagcccctgttgtttcgaggaagtgatgccctgaatgaccagcccaaagcagaaaggagggtccacaatgcctgtgcagggagtggagaggggtggtcctccagagaaaattggggatgctattaccagaagaagggggagtagacactggatgggccaaaataacgcatgtcaccccctccagctgatgagtggctgggctcagcataggtgtcctgctatctagcctgttcctccagctctgacacaagctgcctaaggcagaacagctacctccaaaggatctacccatggttttgactcctggcctggagaacaagaggtgaaggagatagggagaggatagtccagggctaagacctgagacctgggagccagccaccccagtggagttcaagatctcactttgctctcttcatggccgggatttggggcactggcttggagtgtgggaagggaataggagcaggtgacttggatttggacagtga

SEQ ID NO: 71291 - DNA, 1034 bp, Homo sapiens
catgcatgtaagaaccataagctgatagattacattatctacccattttagagatgaagaaactgagcattttaggggtaaataatgggccaaagctcacaggatgcatatgtggcaaaacagaattcaaacctcaacccctatgattccaaattcattgcttctttcctctccgtcttgttgattcctcagtttttcaggagattaaaaaaactaatggaaaattgttaaccagtgaaagttgtcattgtcctcctgagctaagaaaagagaacccctgcctgcacctcaggacccctatccttcccttgttcctgctgtgtcctaggcagtttgggttgtaagtgacaatcacatgggtactacctcatgcagatattcttactttaattccttcttcttctgactcttggccctttgcttcttgagatggaagctttttttgtgactctgggtctgtttgtgtgtgtctctctgtatgtgtttacacagtgaaggctcaagcaatgaaaatagcagaaggcttgaccttctgaaatgaataaccccaaccttgtaaataaatcaaccactctaccagaccaaaaaagataatacctgtagggcaataaatgggatcattgttttttgatttcttcttttttatgttctcttgacacacaacataactttctcttttgaaagcaatgttctaagattgcaacaaactgtagttgaaattattttagtgaaagaaaataatgtcttagggtcatctaaagaaatgacttcatatatctattttactctcttaaatgtttctcccagtcatgctgaagtggcaaagatttttctgattccaagttcctgctaacgaaatacattaactgtagagagcagagatatctgagtctagtgcaagcaaaacaaactggttaggagagctgtacagataaagataaacaagattcttggattcccaataatgtgcttgaccttattatttggtgctgtggtttggatggtgaaaactcatggtgaaatttggtccccag

SEQ ID NO: 71292 - DNA, 1066 bp, Homo sapiens
tcgttggctacaaggatcaataaatgacaagggtggcaccagtccgagtttggactggcagtcgctggtcacatgtcttcatataagttgtgtgtgtgtgtgtgtgtgtgtgtgtgtgtgtgtgtgtgtataaggttaccatggccttcgtgcaaggctgtgatttttgcagaggtgttctgtgatagttcttgttatcaggcatttgtgcatggaaatcttcccttcatggcctttgctgactctcttcatcagggattttaacacaaatgattccattttaattctgacagctttcacaagagggtttgccaaggtgcctggcacatggtaaatactctataaatggctggccactgttgatttccacaatgagatccacttaaagcatatatcagatcacatctctcctctgttcagagtcctccactggctctggttcagtggttccccatctgacccacaggaaaagccaaagccccagaattacttccatgtccccccaccccctaccctccccagacatcctcctccaccccacctctgtcccctgcttgttccttgagcacaagaggtttaccacaggacctttgcacttactcttccctctgcctgaactgttcttcctccaggtatccccatggctcactccctcactaccttcccatttcacccaaatgttaccttctcaatgaagctttctatgaccattgtatttaaaatcataatactctgaggacccttgtcttagtcaacttgggccactataatgaaataccatatacagtgtggcttaaaacacagacatttattcctcatggttctaggggctgggaagtccaagatcaaggtggcagacaattcagttcctggtgaggtctctcttcctggcttgcagatgggtaccttctccctgtgttctcgcagggtggtggggtgggggaaggtattcctcttcttataagtcctctaaccccatcatgacgatccgccctcatggactcatctaaccctaataatttgccaaaggccctgtctccaaatactgtcacattgagggggcagg

SEQ ID NO: 71293 - DNA, 1029 bp, Homo sapiens
tctacattttaatacgtactcggggcgttcagaggcagaaggtccaagcagcactcttggagagacattgctgtaagacgaactgccacacatatgggacttcaatgttttccaggacatgctcatgaccctagaaatgtaggatctggctaccgagttgggacatagctttgtgggacaaccccagaagaggccctcacaccatgtggcccacacacactgtccctaaggtctcaaagctttgtcctgggatgtctcaaagtcctcccccagcctccagcacctggactggggccctgcgtaattctggtgctctcttcgaagaaaggatttgctaaacaaatctgctcttcacctaagaggcagcctgcaggagctgcttgccacataaattgtttttaaggacaatttgctctgtaaattaaatgctgtcctcattgaatgttgacttttgcatgtgagttgttggcacacaaatgggtgttgctaattgcgaatgggttttgtacattcattaagtcagccccatagaatgtgtgcacaaggaagcactttgataagtcacgtcggctgctgaaaggaataaaattgccttttttctgatctgactgtaatttagattggcttgctttgtggtctgaatcaatacagccttgctctctgtgtacatagagagctgttcttcatattcaaaggttgctcagccaatgtggaaaccactgtttttccaaaaaaggtgagatggagtttgttctcagtcattcctgctcttgttgaaacagggacacgtctggccagggtcaagagtggagccctattttagtagctaataacaataataacggcagcagctgatgtttaatgagccagggaactatgataagtgtttacaggagttacttccaatatgttattattgtcctcattcgatgatatgggaatggaagcaagaggaggttaaacaacttatccaagatcaaccacacctgtgaattgaatggctcaaaattgaatccaagcttctcaagg

SEQ ID NO: 71294 - DNA, 1048 bp, Homo sapiens
cagagtgtagttggagtggctggaagtcaaaaaggaccttctaatgcttccaaaccttctgggacaagttttaaagaggcacgagcagggaaggagagcaaagagaacatgtcccagaatttgtcagagccatttatctcattctttccatgcctctttggttgaattttcaagagtcagcacaaaacacaaagtggaacttagagttttccagattctgttcagtgtgatcctctgggaagcatgtggattggaagtcatatagtcctttaaatttgaatcccagctcggcttcttgtagctctgttatttcacctctttgaacttccatttgtccttcgtaaggtgagaacacaaccatcctcatgagactgatgtgagcaatgaattagacattgtagctaagacatccagtgccatgcctggcacaaggggagcccccttcctccctaaagcagtcactcatattatactttttgggctctaaaatgctgttttcattgtccttaaagaaacctgcctgtgattctttctagagggatcgttatttcttccggctccctgatggaacaggttttagtgtttagcactggaaaacacatgtggaagaacttcagaggcaagggggcctctgttttcagtcaagtgtttattcacaccagctctgtaccaaagcctccaaaagagaatttccaatagaagttaggactctaatttggagttatttctttctctcctctctcctgtgttctttttatcctgcaattctatcaaacaggatcatctccttgactatcattattctgacaaagtcaggtagggccatgatgcttatatggttttcctctagactataagctcttcaagaacaggggctgaatattatttgttttcatctgtgcccaacagacggcctgggaaatattggtgaaatatggattattttatgcctcaaaccatcctttcttgtcagaacagcctttcttggctgaggtatttggaagtaggcctgcatgcaccattttaccatttcatgtgggcacagctt

SEQ ID NO: 71295 - DNA, 1006 bp, Homo sapiens
taatttttttcatggttgattctatttattattaagcttttatcagccagtcgttcatttagtcaatccataagcatgcattaagtgccagctataagcacaataatagtgagagataatattcatcaaattatttgtgtgccaggcaccattctaagtactttacatgaattaactcatttatcccccatgataactccatgaggtatgtattattattgtcatccccgttttacagatagacaaagtgaggctgaggatagctaatttgcccaagatcacagggactggaagtggtagcacagggattcaggcccagcaggctggctccagaacttgcttcctttgccaccatacttttgctgctgtgtgtccagccctttgccagggaggggggactccgggaggcctcacatgactcccgttcagcacagccagaatggagaaagagtgcagtgtcagaagggaactgctgggaatgggacagatcagggaaggtggtatttgaatcggactttgaaagatgaataggactttgaaagatgaataaaaccagccatttgaggattggaaattgggaaggtgttctaggtgagaggagcagctgtcaaaggttccaggtaggaaatccagagatagtgggggacgcatagaccaactgagacagactggcttgggggctggactgcccatcagctcgtttgcagaggtgcagctgtttaaccagttattaaaatgctgaaatgcttctctctatgggttagtaaaaagccactgcctcaagtgctcccaaagccacgatgtccctgccatccagcaacaacagcttggcatctggccctgcaggtgctccaggatgccctgtctgcgctgaggctgtaggagttgatcggtgcctgagccttaacagtagttaaatatttagaatatcatcctgagttgagagtgtcggggagaagatttttgtctgcaggtgtcatgggggcctttgatcctttgacagcag

SEQ ID NO: 71296 - DNA, 1078 bp, Homo sapiens
tgggaagtagccccggcagtaaatttggtcatttgcccagtagacatggtatctgagttgaatgtgtattcttcaaagtctgacttcacaaacaaaccctctacaggtatacagttccctggatttttattgatttaattacattttccccatccctccattttgctctcctcacagactacatctttttatacctacaataaaaggtgctatgaattcaatttttttttttactgaaaagttatatatgcttgttttttaaattttggaaactacaggaaaatataaggaagaaaattaaaattatttataattctgctaccctgaggtagccaaaatcattatttagtttattgtcttatctttttttaatataaatagggaaggttttgaacatagttacactgtgtatatataattttgtgtcttatttttatttcacttaatagcataccataagcatattcctggtagtactatagaacattcataaacattcttaatgactgcagaatattccatcatgtgactgtaccgtaatttgcctaatggctccagggttcgtggccatttgagttgtttccagtgtgcgaattactgttcttttaaaactacccacagtggtgtgactaaaacatcaatggagaggaaatggttatgaagagagtagtcagcttgtagtagagcaactgaggggttaattcacaggccctctgttggcctgtaggaggaagaaactacaaaaggagaaccctgggagggagcctcacccaccccaatcccagctgttgctttttttccaggaagcaaggccttatgggaagtgtagggaacaatggcatctgcctggcctgcaagctttctagagcaacagtaatgatcagaatctcttggagtgagcacttccatactcaggatctccctctattctcacagcaaaaccggaaactgggaagatcgcttttcacatctccagagactgactctaaaaaagtcatgagatttgccccaagttatgcagtgagtggccaaactgaaaccagagggctgctctagggattgccggtaatctcctccc

SEQ ID NO: 71297 - DNA, 1530 bp, Homo sapiens
tgaggcttaaagacccagtctaatctctaatttggtgcagcttcgcattatttaaaagcagctgaaatttcctgagcatctctgtgagctaggcatgcctgcagggcacgtatcaccccatttccagattggaaccttgggttcattggccatgtgacttgctgaaatttggtcattgacccaattatttggcagcactaggatcaaaacccaaagctctctagctccagagcctgcactcttggaaacaactatcaatttaacccaacaaacatttatttagcactgactgatgcgaaatctcctgtcctgggtattaaagaacgggatggaaccagtaaggagcaagcatggttactgtattccagggattcccactctagagatttagacagtggagtccacactcaagcattataataatgtctatttggctttgcttgcagtctgggctattccagaagaggaaagtaatttctgtttagcccattgcacaggccttgtttcctacttgttacactggggcaagccccatgcaggagccatctccacagagtccatacccaggaaaaatgatctgtatgctggaaggatacaggagggggatgtacctggaaaggtgcaaggcatgtgactggtgtatataactagatttgagcaaagcaaaacttcaacttggacacatcccagagatgagcaaagaggaagatatagcaagaccgagagaggctgggaagctggaaacaggagaacaggtgcaaagaactgatgggaaagccttcagaaccaagcctgtgcactgagcacgtatgcaggagctcccctgttaggcactttgtggtattgctgtgctacagctgtggctgcaggacttgaaggaaatgggcccaaccctgacattgttggcatctttgttcgctgattttttttttctgaatctaatgttgtgtttgtcttcatctaatgtttaaatttgtgacaattctgactatatgtgctgtatgccagacgtagatgaagattcctgaatgtaaatcttccatataattgtacttccacccctgctatttcatttcccctctgttattctcactctttaggggagagaagcaccaaagggttaggagacatctgtgccttctccatgcaccttgcaccagttcccattcagagccagctgccataccccagccaaatccaaacactcccccactttccagcctgcacccctccatctcctgacctcacaaggcctccatctcttggtgagatctgctttggttcttccttggtcgtgagctttacactcaccccctcgttggtagttgctctgccaccctacagccggccccagaaatcaacccctttccttggagggagggacttcaggattctcctgagaaggaattagacaagtaggcaggcaggggcacacgtggtcccctttccatctcaccagatactcagccctgaatattttgccagtgtccacggagtgagaggccctgaagtcctgacctgttcaaagag

SEQ ID NO: 71298 - DNA, 1489 bp, Homo sapiens
ctcaagcttcttttgggttttagtcacttcaaacaacttcagaataaaggagacaaccagtggaacattgttctcttaaaaaaaaaaagtataaagagaatgcaagattttttcttcagcattctccaccctctccttgactcagagccctcgaattctttcccatctccaattcctccaaagaaaacatacaaataatgctattttttcccctctgagtagacaagataagaagatttttaaatgagttactggcaaagaattcatgagcttatatactattaaggtcagagtgacaagaagaaggcaatgttgaaaggagagaataggtacatagaaaattccaggagaggctggaatcctgaggttcaaggtgtcttattctggagcttgccagctgtcttggtaaaggtgttatttttgaaggcagcagagcctttttctttcttcttctttttttttttttttttttttttttttttttgctattctttggcattcaccaggcattggccgtgtgccctgggcctcgcttggcatctaacatgaaaggcagcagcccaagggcagttctgtgatggagatgcagccccccagggactcagggttgtggactgtgctctggggccactgagcaaaggaatgatgaggggaggcgcctctgaaacttaacccagagagttctctgagcatttggggctggtttccaacaataatggagacactgtgacaaaaataagttctgctcacctgagacagtagaatccaattcaatttcaagtcagcgtgtgtttattgagtgcctgattcagtttaggtgatggagagaatgggagaatgagggagacagcctaagaagcaggctgattcaggcagaaaatccttgggactctgccccacagataggtccacaggtccagaaactcaattttatcagtttcacccagtaagaaattggtaaatcttagtctgtgtcatgagcaaatatttattaagtgcctacagtgtgccaggcaccatcctggagctgcggcgggagccgtgatccaagaagtccccattccctgccctggtggagtttacattctaatggggcatttgcagaggcagcgggtaaggccagaggagtcctctggggtgaggcccacaatgcgagggattcaagtgaggtaaagtcaggaggaacgtctagggagaaatgggatttagcctgtggtttgaaggttaagagggatgtggatttttaaagggcttgaagccttacagacaggaggctcagctgcatgaacaggaatcagcccattgcatgccagcaagagtccatgacctgatcagctcccctggggtgacaggtgcatgctgggtaacagagtgcatgctacgaagttggacaagagaatgtcaatatcacatggggtttctctacacatgctatatagtcaagtaacttgggtctgactcccagctcttgctagtcttgtggtccagg

SEQ ID NO: 71299 - DNA, 1041 bp, Homo sapiens
cacattatccccaggctacagatgaggaaactgaggcccaaggattccagagagcctgccccggggtcaccggtgcggtccggatgtctccaaaggctctcccactactctggaattcagaggcagggtctccagggaaagcggggtgtgggctggggagtcgggagatggggggatccccgcgagcagggggtggggccaagccggcagcccctgcctccggggaggccctaacgcgcgtctccgggtccctcctcccaccgcaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcaggtaggcgcgggggcgggcggggggcggcaggggagggagggctccggcctcgcagcctccacccctccaatcagagccccgctgggcggcctgagccccgcacacctcggcggcgctggggtggaggctccctggttgaagtggcagacgcgggctgaacaataagcaggtccctggagttgcagggttgaaagaacgcggcgaggcccgtggaggacggtccgattcttagattacagatgtcggtgtggtttctctctggctgttctctctgcgcctagcttctccctctctttctctctcctcccccagtaaaatccggtcttcctgtagttttttaaccaaaccttacagagtgaaatttctggctgggtcagagagcgcctctgcgttttcacttgcgtgaggatggagtggtcttctctgcattcctcaggcctgtatccagggctctcctctgtcaaggtgggaattacccatgggccactcaggggcccccatgcgtgggtgctcattttgagccaaagcaagagaaataaaagaactcactcaggtgagtcataatctggctttaaatgcaaaaaaacacagaaacccagtggggcgtgtgtgtgtgcgtgcg

SEQ ID NO: 71300 - DNA, 1049 bp, Homo sapiens
ttctgctctctcaccctagacctagacaagccctctcagaggacactatcttctggatggctctgtcccttttcacaattttgcagactgaacatgagcctcaggggccactgtccatctctgcgccccccctcctcagcacagagctctttctgcatggtctagcgaccaagtgtgtgtcattctgacagtcacaccaaggatttcaatttcagcatctgtccagtttgaagcctcagccctggcattcaggatgtgaatgtgatgtgcacgcaggccagaatgcacagaggagcagaggaagtcggttcctctgagtccctgggctctttttaatcatttatctcttcattcttgactcatttgtctcctgaatgatgatttgtgtacagaaaatatactaattgattgttcgagctaaattttcattcgatttggaaatcatcttcaaagagaaaactgaaatattcagttagcttacctaaatagtaagtgaaggatttacaagttctattagctacaaaaaattcaggacatgaaaggataaaccatttcttttaaaaagaatacttatttttcagactagtcaacatacagatacatctacacgtatattttctaatctcatttaatgtgacatgaagtaggaattactgtctccattttgcaggtaacaggatcaaagaagttttgttcattcaagacacccaagcgttagataccagggacccaccctgttccttacacttacagtccgtgtggtgtgtacatagctgtccccaacaactgtgcaagacagcctttattatcccattttacagatgagaaggctgaggcccattgaggttatgggacttatccgaggtcacacagctgctgtgaggcagagcaggtctagaatggaggacttggcaaataatgtaaaaatacagtctccttgcttccctgccctcccagacattcattttagaagttgctgggtgggcttctagttctgagtcggtcagagctgagctccttctttctaaataaacagccctagaaagggg

SEQ ID NO: 71301 - DNA, 1055 bp, Homo sapiens
cagaggaatatgaaaggctggcgacttggtccttaattactattttgagttagtgttgtgctttcatttctccccgctaggtaccttcattttcaattatgtcgttacctgtgtagccaaacagctcacttaacttccttttccacgacagccttgtgaggctggggcccctctctgactcacttgctgttgtattaccgcacctaatccagtgcctggccgatactggagcccaataaatatgcatgtgtgaattattatgtgccaattaaaaataataataaaagccaaaaaaaaaagtctgtatgaatgaatgagtgatggtatttccctgagactctgaggttctccagagcagaaatcacatcctattggcctctttggatccccagtgtgtggcacagagtagatattcagtaatgttgaattctgcggaatgggctgggatggagtatgggcattcacccacaaacacaggtcttacttgagcctggactttggaatgagacagatctgggttgaaattgaagtctaaggagctgagtgactgtagggccagatatgtaactcctctgagtctctgtttcctcatctataaaacagggacatgaaagcttaccttttggggttcctgagggtttaagcaagatacaggtgtgagctgaggagtcaggatgcctgggttgagtgccagctccatcacctacaagctgtgcgaccttgagcaaccgatacgcaacctcgatgccgcaatttttcttctgtaaaatgagcacaacagtccacagtttatgagattattttgaagatttaagtgagctattatatgtgaaatacttaacaaatgaaaagctgtctataaatgccagtcatgattatgatattaactatagtgtgttgggaaagctgtttgtaaatgtttactgtgcctttggttattgttattatctttgctctcttccaagacaactaatctgactgctggatggagccatagtgtaacccaaaccacaattcccaggggcccacacagcagaacggggctgcatcctctc

SEQ ID NO: 71302 - DNA, 1072 bp, Homo sapiens
cggaggccatcattttaattggagcctaggaacaggcaatttacatgaaaagcaaatgcaatgtcccagggtgcttcctgcggagtttgctcctgtgcccctctgggaagccgctgtacccgcatgatgtctcttcccttccttagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacaggtacagggtccgagggtctgaacaggctccccacctcctccatgtgcatcacccctggcaagacagagacagccggtgaatcccctctgcaggcgctgggcagaggctccccctactgacggcttagattgcttgcttgcttgtgtttttcttcagtttttaaaatatcttataaaaatactgtggttcatctttatagaagtagcacatgatcattgcagctgaaatggaaaagagaggaaaaacaggcccattccagaaaggaaataatgccatcaccgtgtaaccatcatttatatttagtatctgtccttcaagtccttcttccatcgtggttaaaattagttctctgcttgtctgtctgttcctgcacaggacaagcccagacagacttcatcaaacttttaggatatgtttaagatacacaaaagtcattctggggaccctaggaggcgactcagagataggcagctatcccccctaactcctgaaactgaggtacagtgagagacatgtgggcccagcagtcagggagataccttgtgtggtgaaccgtcatggacagagaaaacaaacagcagttataaatgcaagtctcacatggaaagtcacaagggacagatggggctgcttctcacatggcagctcatgcagtgagttccagagagggaatgacagggactatttatttaactacagctataataattttattgagcaacaccaaggagctctaatacacacacacacaaacacagac

SEQ ID NO: 71303 - DNA, 1405 bp, Homo sapiens
gctggctcttccttgggtaagctagcccagagccatctcctccatgtgtctggggaacaaggctagcctagccttcaccagcgtagtggctttcgctctgccatggaagtggccagacctagccatgggtccctaaacacagggtgtggcagattaaggcaggctgaggactgaggagaagcctcctaatgctgttctggaaatgacctctctccagggaaggtggggaggggttagtctgtggaacgtttgtgccattgccctgggagcctattttgcatgatgatgaagctcgagattccgaatgggctacttgttataaacagtagcaagacacgtcctcctctgtctgtgcctctgcatgagaggcgagaggcaaattacagcagtcagctgctgaagaggtccctgttaaaggaggaagacctgatgaagtacctgcagatggaaatgttgttttgcacagaggagcagcaggaatatcctcccatgtcttcttattcgggtataaatatctgtcttagccagagctgtaaatggtgaagtccaccaatgggtttcaccaactctaagctctcatctgggcacggatgtgttccagatccttgggcacatccactctttaatcctgggcaagactcttctcccccctgagcttctttccccagtaagtagaggggatggagcctatgcactcagaatcccgaagtatggaatatgcataagtagcgtgcgtaataattccaatatgctacacgatgattacatcttgtgaaatgcagcctctaataatatgagcagcatacagagatggacacccatagctgagggaattgaattatgacctttaatttcaacttttgcaggtcttggggaaaagcctacactggttctgttcgttgaaagtcaatcccttggtctcgtcatttagtaatgtcctggggaaaagccaacttccagataaaaactcgcctgctcctctggttgttttccacctttcccctctctctccccctcccctgccaccttccctggctcctctccccgctccaggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaaggtatgtggggtttgaggttgttgtggtcatcggcagagaacaaagctggaggttcccagatctgaacggtcttttagcctgctgttcccctttgagtgggatcactacggtcatagcgaccagtggcgaatgtagcccagcagacgaaagctacctgtgcactcatttgtggg

SEQ ID NO: 71304 - DNA, 1070 bp, Homo sapiens
ccggcaagggccggacgcagctgaggctgcacctggaagtgggggcctccgcgaagctgtgggtgccatttgaatccctgcttcatgcaggttggcagctgccaagaaaaacaactccacaaacaggcccattagcctaataagcgtttgtttcacccccttgcagaaaggcttgtgccggcagagtttgaaggaggcctaggccagcccaatttaaattccattagccccgggatctcagtccactaaggagcagcgtttcaagtcagcagccccacctggaatataggagaccacgtgctagagaaatgctttataaatgttcagggcggtcattcttaaggctcttattgttatttgtttagcctttgtaaatgaaaactgctaggagaataaattgattttaataaggcccaatcccaacatttgctgacttgatattttaaatgcttatgacccatcagggtgggagaggggagggtaaacaatgctgtgttattgcacaaattctcagacgccaccaccatctctgcgacaagcagatggtcacaagagcccaaagccggtatgtgggagactcaaacacagacaggcgaggattcgtgtttatgggtagggtgtacacactgcagtctgtttgcttgctgtgtgccaagccctgggatacagcggtgggcaagaccttgttgtgccctctgactctagtgagaaacaacactgcagtggaggatgatgcacgattgcctgatgtgacctgtggtggggtggagatctgaggaggcgccccactgcagatgaccgctgactagatccagaaggagcgggcggagctcagtggacagaagaaggggagggcatcctagcagagggaacagtgtgggcaaaagcacaggactagaagagagggtgggaggttctgatgcaggcaagcggttgagtggtccgagcataaaaggcaacttttggccaggcatggtggctcacacttgtaatcccagtgctttggaaggcccaagggaggaagatcacttgagctcaagagttcaagaccagcctgggcaacatagcga

SEQ ID NO: 71305 - DNA, 1050 bp, Homo sapiens
ctggtgtgctgtgactctgaggagtgagacagggcaaggaggaaaggaggacagatgggatagagggaggctcctctgaggaagtgacatttgagtggagacctggacaacagagtgagacaccttgatatccatcttgctgataataccctgattttcacccttatttctggacataacaattttgggcattttgggttgaccgcctgctgtgatgggtatgaattgagtttgcttggtcctcccctccccctcccgctcccccgtcttcccccacagtggaatcctatctttgtccttttcctctagtgttacctttgtgcatcatttcccgtcccctacctgtgacactgctgtggaaggtgaagatgaggactgtctcaccactatagttccttattgttacctcctttccatccacctcccagcctctaacagactctttttgtgatttttagcttctgtctgctgctaagtttttccagctggaggctttgcagcgacactgtgagattatctgtgcgaaaagcatcaataccgacaactgtgtggatatttacaaccatgccaaggtaatcaatctcattctcgcgcagtgcgcacacaggagcgctgaagccggggaggcttttccttggcaaacacagaggcagggcagagagtgggtgctgggccagttctctcagggctaagccgctggcctctgccaaggtcttgcttcctgccttagaaaagatgccttccacctcccctccagaacaaggaaagtaggagcccagaagtttcaaaggcagagttctcaaacagtgcttcttagactctcatgtgcatatgactcacatcacagactccaattccacaggctgggatgggccctgtttggcttttctaacaagctcccaggtgatgtctctgctgctggtctaaggtacaccttctaaggttctagaacagtggctgtccaatccagcaacatcagggaacttgtcggaaaggtacattttcaggctgtaccccagacctactgaatcagaaacttgaggggggacc

SEQ ID NO: 71306 - DNA, 1011 bp, Homo sapiens
tccgtgaaacgacaaattcattttggagaaagctttttaaaaaacgcaaaccacaaacctctgccatttgtcagcttgaagtctacggaactgcaagcaaaataaagattggtgaaactttgcttctgactgacccctacagtcccaaatattttcttggcctttacaaagcccgcaggcatcgtcacatgcagtcctgaaaagccttttctctatacttcacacagcccagaccagcccacgtggattcctcgcccggctgcttccgcttccattttgtcccctcctatttctcattcggcgcctcagaatgacgtctgaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtgaggcctggtcgctgggagacaaggggagcagcgtctttacggcactgggggtccgcccagctgggggaacgtggacccggaactcggggcgttggctggtgcgactggctggggtgagggcggctttgcccggattgtcgcgactagagctgcagttcagaaggtctggttcgcctgagcctggagagtcaagggccgcgccttctcactgttcccaccctcaagcccaaccccactcccaaattcgcacgcacatggacttagcgggccggaaaggggtgggctgctgtttttggtgggtaataccccaaaaggctttttgacaacaccactagcttcactagcacccaagtgcattttcaagcataactgggaagagagcatgaaaactccactttccactcttgtgctccgtgtctgaaggagtgaggatgaatgtggtgtagaaaaactggtgtgga

SEQ ID NO: 71307 - DNA, 1038 bp, Homo sapiens
aatgagcatgatttttgaagtttcaggtagcgagagatcttatttgtaagaatctataaaatctatattttttaatatagagtctggattgatgtttgattcttatcttgatgacattgcttggcgttacattttacatttgtttgcaaactactttttaattcaaataatttgatgatttccttacacatattgtaatgaaatctttgctctcttacaggtagagctgagtaaagaagaagtaaaacgcctcattgctgaggcaaaggagaaattgcagtaagtttaggaccagatgaaatctatatcttaaatgatgatgaccatgtggtcttgttattagaaggtagcatttgggtgattctctttttctttctgtgctcatagagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccaggttagtttatccacttctgatggtttgtaattacaagctcaatatgttggatcatgtttgtggtgttccaaagctttactcttagattttattgttcttgacatcagtaagataatctggttgaagacttgggcagacagcatgattcctaaactagtttagaagataaactctaacccactaagatacaaatctaggatctaaaaaaaaaagtactgtgtattttattgcatatatcaggtttaataatctgtaacccacttgtgagtttttgtatgcagttataatgctatggtgtgcttgaacttatatccatataccttttcctcaactgcagtcagtcttctcacaatacagtagtccccccttatccacggttttgctttcttcggtttcagttagccacagtcaactgcagtctgaaaataagtgagtaaagtacagtactttgggagagatgact

SEQ ID NO: 71308 - DNA, 5114 bp, Homo sapiens
tgcatcttttctatagatacagtccagcagaggatagttttttctattggactctgggttatgggctccaaccttgttagggacagagtgccatagaaatacagagaaacaaataacccagcctggagagatggcattcagaatcagctctttctcgtgtagcagaaattgctttctctgttgcatatcagatgtttaagacctatcagtcctgcctccttaaagtggcttcctctaacaattcagtgtatcttccttttcctgagttatcctttgttaccatcgtagatgtgccataaaagaataatttaagttcagtggaaaaagcatactgcatttcttttttcatatgccaataaggcatattagcatatcagaacacgtgcagtagagcaacctggttaattttttgaaacctgtcatttctcaattttatttgaccaggcaacccttatttattatgttgatttcagtgtttcagggtcattttatttccaggtcctcaaggctgcctctccgtatcaccttcaatcatgaatgcagggagctagctagagaatctcaagagagttctcatattttctaaaagggtctaattccctgatacagttctttcattggaagattgtgaattccaagactgtctgaaatccattccaaaggtcaaatacaaaaatggcttttaaattcctgctgctgcttacgtagtttcctttcccaactctagatgatccagagttagttataaaatagatgattgcatctaagtccaagaatggatgtcataggaaatatgtttttgtcaagatgactattttattattgtagtttgtcaatttttcttacagatgctgagactcttggtgaatctctcttgggtcttacggtctacgggagtaatgatcaagatccttacgttactctgaaagatacagtaagtatttacatcttttttctaattatgctcttaagtgttcaaaaaaccttactggctctctgcttctagtcaatgacatttttttcctctcacttaggaacaatatgaacgtgaagatttcttgattaagcccagtgataatcttatagtttgtggccgagctgaacaggaccagtgcaatttagaggtgcatggtaagtgataaatcccttattaaaagattttctaagtgatggtaaaataataagtgaaatagttaccatttcatttttaggtgccagatcctattgtatctcatttaagttggttacatagttaacttttacacaggtggccaatttcttggttattgttctgggtatgtgtagtccagtacatcactttggtatctgaattttctatggaaataaatcccctggaaatttttcataggggtgtttttttttgtttttatatataaacagggtctcactgtgttgcccaggctgtctcgaactcctgggctgacgtaatcctgatttggcctcccaaagtgctgggtgctggattacaggtgtgagccaccacacctggcctcatagaggtttttaatcttttatttaaatgtgattgcctgtttttcactcctctcctactcctgctataaaaaacctggaagtaaaattatatataaaaatacaaggctgggtgcggtgtctcacacctgtaatcccagtactttgggaggctgaggtgggaggattgctcgagcccatgagttctaggctacagtgagctgtgattctgtttgctccactgtactccagcctgggtgacaaagaccccatctctaggggagaaaaaaatgtataatcccatttccctgagttaataacttgccaccttggttttttactcaatttttttttctggctactttttctttatgtggattatactggatagacaggtttttctcatgttttttaaatagagttatttcagatatttcccctttgcaaaacattttattttcttcctaataattcaacacaaagggccacgtttcttttttggaaccaaaacatcgtgatcacctttcttacttaaggaatatttgtatcaaagccagaagcggatgctttgcagtaatcagaagtaggcatgaaaataggaatttttaaattgtatttttaaatgttgtttttgatttaatattaattgaatggcttgcctcactttggtgtttttaatgtaaaatctgttttttatatgctaaaagtagacttgcacaatgtctggcgcactctgcctacagattctccgttttgtttttcttgtcccttccactgcgctcatatcctcagacaagtccatccttgcccgatactctcctcccccagcagtcttcagatcgtcttgaaactttgaagattcgaagagattattaggctgataagtccttttgttataggaaacacagttgcacagcttgaaaaaataaaacccttaggcttaatgtttatcgccatcttctaggttgcttcatcatggcttccattgattagcttggatttctgttacctcttcagaatctttaaggctgtccgtgggaagcctatagattaggcccattttatctcatggctcattgtgatctgtttatgcatagcaggcactttaatgtgaaattattctttctaactcttgatatctttgaacttttacatatttcaaatgaaaaccatttgtttactttgcttttaagaccaattctaatttcaaaaaattgagaacctattagagttttttttgtcatcatcgatttttttatgcattcttacctgagaacttaacagtcattcctttgaactcaggatcaaagaggagctgagaaagaagttaaagctgttatatttccatttccttctcagttaggttattatagatatactttattatttgggtttggaaggaatctccaaattgcccagtatgtgtgtgcaagaataacttcaaatttatattctaaaactgatccgaatattgatctcacgtggttaagagtatattttaaagtattattaccagttgctgggcgtagtgactcatgcttgtaatcccagcaatttgggaggccaaggcgggcggatcacgagttcaggagatcgagaccatcctggctaacacggtaaaacccagtctctactaaaaatacaaaaaaaaaaaaaaaaatcagccaggcgtggtggcgggcgcctgtagtcccagctactcgggaggctgaggcaggagaatggcgtgaacctgggaggcagggcttgcagtgggctgagatcgtgtcactgcactccagcctgggcgacagagcaagactccatctcaaaaaaaaaaaagttattaccaattttatgtaaaatgtaagctgagtatatcgaacatggttgaggtttttgtagaaccacagtctaataattttgaacatgaattctcatcacagggatgtgatagagcattacacaaatctgctaatcccaggatctattccagaagcagcaatctgaggaattaaaaataaaatccttaatttattatatatttacctccttcttaatacaaagcatatggggaggggttctgactagtgggttctgttttatcagtgtttcactgtgtaatttttaaaagacttcttactcattgattttacaatgtttttgctgcttaacattacagctgtgaatattaaggagctgttgccatattccaaaagtatgtcctcaggagctttgtttacattgttcatcttcataaaccttttttaaaaatattaagagtaatttttgataagcatttagatttccaaatatgaattatttctctcccatgctatttttggtttgttctttttgacttataatcagctagaccattaaaagataaaataataactacttcttgtagttatgaacattatgaacttatgaacatttgttttctatgaatgacctagaagacaggaccatttatctgacaaggatgcaggtggactatcagatgtcagtgttcattttctcctgtggggtatgccacaagatggcactgtattagacatgcagaatttttgcctagtcatgatattggaatctttttttttttttttttttttgagatagagtctcactatgtcgcccaggctggagtgcagtggtgcgatctcagctcactgcaacctccacctcccaggttcaagctattctcctgcctcagcctccctagtagctgggactacaggcacgtaccaccacacccagctaatttttgtattttgagtagagacgaggtttcattgtgttggccaggctggtctcgaactcctgacctcaagtgatccgcccaccttggcctcccaaagtattgggattacaggcacgagccactgcgcccagcctggaatctctttataatatcagatgtctcactttaaagcacatggctcacgtacatttaatagaatttgtttttttgagcgggatgtgatttttgatgactcattctgatacattaaagtctcttttcccaatcttttcagtttataatcaagaagaagactctttttatgtacaccatgatatactcttgtctgcatatcctctgagtgtggaatggctgaattttgatcctagcccagatgattctactggtaattagaaaacttaaggttgttcaatgatttccagtcttatgtattttctcctagctccataaattatgtattctcttgaatgttttcagaattgttgctgatattttctgaagttactgttattttatgaagttatagagttcttaacacaccatcactttattgtttggggttcataaatccccagacttcaggtaggctaaggaggtagctgctctactacaggctgaaggacagggcctgaagccttttggactgtagaactgtaaaggtcccataaagactcagtataaatggcctgatatgtgagatgttaccagctagagttcagtggcataacctgttttagaaaacataagctaaaaccgaaatgaagaggcttgtcacaagtaattaggttttcatgttagtctttgtaaccacatctgcacactattagttgcccctgtccgtactttttaataaaggtaaacactgtttatactgtcttac

SEQ ID NO: 71309 - DNA, 1531 bp, Homo sapiens
cagcaatttaacaaatacatatcttaaaattgaaagatctttggggaaagctggaaagaaatatagcatggtctcaacaaacagccctctcccccacagttaccagtgtgaataaatccaccgtttgctcaactataaaattctacaaaatccaactttccggaaggggccactcctctcccttcaggggatcctggctgcttatttattactttgaggtagtctggtgcgttctacaaacacagagataatatatatatctccccactgtatgattcctgcatcctccctcccatgcaaaacaaggatcctgagatttttctctgggttattctgatgtgtgtgagtcctaagtccgaaaagttctgtgccggttatgatcagagaaaagtgaaagaaaaaaataggaagcaatcagaagtagaataaggccaggagagggtcacttataaggaatgggacatttgttaccaaggcggatcagataaatccaagacatggcaaagaaagtaaagtacaaaaataaattggaccatttaaaaaaataattcacttcattcagaacattaacttggacttctgagttggttactcactttaccatttataaagtactaagtgcacaattctgcattttagtgtctttttatattctgacttaatttcctgatctgttagtttcttacctgtttatttgtattttagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagtttta

SEQ ID NO: 71310 - DNA, 1011 bp, Homo sapiens
agaccaaacacattgatcaacttcctgattattaagtgcattttcccaggcaccttccaactatggtggggagacctggaaagcagaacatcctaataattggaagtgacagcctccaaggaatctcagttaaaccacgaaggtttctttctctgacatcaaatctcaactccacctacaatccctctacaaagcctttactaccgcattttctaattgttgcaaaaattccattctgatgggccaacacaacttacctgtatgtatcttgaggtgggtccgcaggttgctgggatcactaaaagccttgctacagaaatcacacttgtggggcttcatacccatgtgacccataaagtggacatgaagtttggaaggagagataaaagcttgggggcacattgagcacttccacttcctttctttgctgtgacttggcccatggctgccgctatgtccctgggtaggaagatggttatggatgtggctggtcagatgggctttgaactctgtgtaagaattgcactccttgccacagttacagagatgcacatctgggtgttcaggaacaccttttaaaaaaaaattactcattatctcccaatacttgaatcttaaaacttgttcttgatattaacaatcattgcttccagttctcctttctctccatatttccaatttgcccacttcctataaaactaaaataatgtactaagggcatctaaaataatgtactatgggccaggcacagtggctcaggcctgcaatcttagtgctttgagagcccaaagtggcatgatcatttgaggccaggagtttaagatcagcctgggcaacacagcaagaccccatctccataaaaaaaaaaaacttaaaaatcattggctgggcatggtgatgtacacccatagtcctagctaatcaggagactgaggcaggaaactgcttgagcccaggagttgaaggttatagttggctatgactgcaccactacactccagcctgccagag

SEQ ID NO: 71311 - DNA, 1092 bp, Homo sapiens
aacagactgtagtgtttttgactacaaaaggtcatcagctaatatgttgaagtaagaattctgtttctctacaactgccttctcatagataggacgggaaattacaaaaacattccagaggaaatagtaaatagttctgcctaagctttcatataggattttgcaatgggggaatgttgtacttagtatgcatttcaaaattaatgtgcttgatctattaaatgtgataactcaggaaccgggaagagcagaatttggtggcttatcctcatgatggaaaaatctttttctgcacctcacaagatatccctcctgaaaatgaactgcttttttattatagccgagattatgctcaacagattggtaagttaatatgtgtttataatgaatctggcttagtaaaaataccaaagaccaggattaaagttttggtaatgatttacatgttagctgaagcaaatcatatacctttgtttgtataaatgcaaactattacttgtatttgaggtgttaaaatctgtgagattcttcacaagctgaatgttattgaccaagcaataattcatatgatacggtcttttatggtaggactttggtttggggcattgaagttccttaggctacttttcgagctagcaccattgagatataaattcatgaaggacagcgaagtccctcggtttgatttaacctgcatatgctttctctttgctgtgctgtttcatgatgacagctaatgtttaagagtttgggtatgctataaaacctaaatattttgcttacaaaagaggccttataatccagtatttaccaagtgctttctttgtgcctggtacactattttattttacttatgtatgtgtgtatttagagataaggtctcactctggcaggctggagtgtagtggtgcagtcatagccaactataaccttcaactcctgggctcaagcagtttcctgcctcagtctcctgattagctaggactatgggtgtacatcaccatgcccagccaatgatttttaagttttttttttttatggagatggggtcttgctgtgttgcccaggctgatcttaaactcctggcctcaa

SEQ ID NO: 71312 - DNA, 1055 bp, Homo sapiens
ctctgttttgtgagttaatccaattattttaaccatttaatgcatttgaattacttgtgactgctgaggccacagactttgtttgtatgataaaagtcttactttgtaattaaaacattcctcaaatgtttatcttaggaaataattctggaataagaagctaagattatttttctagttttctttttttttcttccttgagatggagtcttgctctgttgcccaggctggagtgtaatggtacaatcttagcttactgccacctctacctcctgggctcaggtgactctcccacctcagcctcccaagtagctgaatttacaggcacttgccatcatgcccagctaatttttgtatttttgtagagacggggtttccccatgttggccagactggtcttaaactcctgacctcaagtgatctgcccacctcagcctcccaaagtgccgggattacaggtgtgagccaccgcacctggcctatttttctagttttctaatgaggggttagaaatacaacattttcacatagatatctattgggaatgatgcttgcgaaattgaagtaaggagaaaatgggtcttgtgatctttggaaaggtaaggtaccactgtcattgggaactttaaatttggaatgctaggcccaagtgggaaaatcatgacaagggatgatcctctgcccttaatggacattcagtcattcagtgcctactgtgtgataggtgatgaagacaggtggacaggtagactggttttttgtcttttccaggcaaaggttgaataatcaaaaacaaagtcagtctcttcactgagcactaactgtaggtctctgatggtctttatgtattgctggaaatagggagaatgttgaaatgatagcatgttggagaagtaggaatatattttcccactaagaaagctgggacctactgcaaatgagtaaatgaggtgattgctggcctaagtgtaatgtagtgctttattgcatgtcagtgcatttgacatgtgtgcttgctttctgttggcagatataccacaatggtgtcctagaat

SEQ ID NO: 71313 - DNA, 1075 bp, Homo sapiens
cctatccctcggactgtcccgaacatggaccagtgacttttgttcctgacactccaatagagagcagagcaaggctttctctcccaaagcagcttgttctccgtcagtcaattgtgggagcagaagttggtaagaaccttggaactgtaaaacactattacatctcttcttcctttgtagcgtagagttgtaaaagtggatgtgtataatttagtaattatttggaccaaaagtcaatttatggcttaagatttatgcttttatggaatattagtcttgtccactgatgatagcaataaatcaagtcaaaaactttattgggaaatctctcctttgttagaatcagtattgagtaaagcaaaaaatcctagactgagtctttgaagatttaacttttattctcatctgtctcatccactaacaattattctaacaacacatttcttaaaacttagtttcttttatagaaacatggaaaattcaccttatgacacaactttagatcaaatgtttgtaaattatataatgctccttagataaaaggaataaagaatgtagattgccagactttacttacccatatttgaatttagcatggcttctgagttactgcgacatttctttggaaatataaaattaggttcattattcttttagctgcagtttgggtgtgagtcatttcaaagcatcaaacagtttaggtaaaatagagcagtgctttaagcacaaaagattttagaagtctgatttatttctatagtaattgctttatatttttacaatagaataatgttttctgttattttttatttatttatttttaagagactgggtctcactctgttgcccaggctggagtgcactggcctaacatacggagtacagtaactcgagtgcagccttgacctcctgggctcaagcaatcatcctgccgcaaccttccaagtagctgggactacaggcatatgcaatcatgcccagctaattaaaaaaaaaattttttttgtagagacagcatctcactatgttgccgaggctggtttcgaactcctggcctcaagcagtcctgccttgg

SEQ ID NO: 71314 - DNA, 1059 bp, Homo sapiens
acagtatgtgtacatacctttaaggagcttacagtctggtaggaagcataggagactgttacaatataggataataataagtgtgacgatggggtgaagtgcattggtactaaagtagcctgaaggggagcaactagccaggccatggaagggtcggggaagatttaaccaagggaagtaacatacatgttagcacagaccttaaggacaagaaagatgtgggcagttgagagtcaggaagacaggagctggcacctgtaagtgcctagaaccaaaagaatcatgagtgtttcagaattgctgaagcataaaatgagggtgaagagaggggtcatgtggtgagaggagaagtaggagccagaacacaaaggctcttttaagaccggtcaagagttttagggagtgagggttggggtagggctttgctgcaatgtgagaataaatttgttaagaggcaaggaggtgtggaagatatcataatttatgggaaaggtgatgattctcaccaatctagagtagaggtaattaggatgcagaagagtggaggacatttgcagagaacccagttgagcttatcgattggataaagttggaggagggaagcattaaggagaaaaccctggtttctggcttctgaaactaggtagatagaaactaggtaagtagagaaggccatgtgttggctcacacctgtaatcccagcactttgggaggctgaggcagaaagatcatttgagaccaggagttcaagatcagcctgggcagcatagtgaaaccctgtctcaggaaaaaaaaaaaaaaaaaagcaaacagaaactaagtaggtagggtagtagtgaaaggcagaggaggatatgattttgatttttattattttgggaggagtgacgatgagtcaagttttagacatgttgatttcagtgtctgtaagacacccagtagagatgtctaatgaaaagttgtgtgtggacctgagagagatctgtctggaaatatttaagaatcatcaacattaagatgttatttgtggctgtagaagtggaatgaaatcatctagta

SEQ ID NO: 71315 - DNA, 2632 bp, Homo sapiens
gttataggagtattatatgcttattgcggaaaatttagcaaataagggaaggaaccactcagtcccatcatccatctttttggtgtacttccttcctgccatttgttttggtgtataggtttttaccaattttcataattaagaccacggtttcttctcttgctctcttttttcttttcttttttttttttttcttttaatggagacggagtctcaactattttgcccaggctggactggaactcctggactccagtgattctctcacctcagactcttgagtagcttggaatacaggcacatgcctgccttgagaccataccatatttcatttcttttttataaataacttttttaaaaaaagagatggggttttggcatgttgccgaggctggtctcgaactcctgcgctgaagccatccgcccacgtcagcatcccaaagtgccgggattacaggcatgagccactgtgccctgcccaagaccatactttctatacgattgtctgtctttacttttttcactttatctttttctctgctgttacatgggtattttcctttgctgctacgtggttttcataattatcctttttaatgatgcattactttctactgaatgggtatttgatggtttattatctttattgttggacagtttggtttttccagtttttattaccattgtaactaatgctcttatgaacgtctttatgtataatatttacaaaatggatttagagaagagtaccttaagtggaatttcttgtgcaagagggtattaacatttttgaggctcctaatatatatgcttcacaaagaagttttagcagtttacattccctctggcagtttagtaagtatcatttcaccatatcctcccaagcacaagtgttaatttttttttgttttaataaaacaggtacaattgtgacttgtattaaatagtttgtgttatgatagtttaattatattaaattatatttaattaagttttatttttcacatggaagatctgtttttaaatcattttaccttttaataattaggagagcaaattttacaccttaggactcaggaattgcaaccatatgtatattaaaagcagtgttttcgttagtgattcccagttagcttcaaaggaacatagttaacttttttaggattttcgagttttacaggaaaaactcaattacggtatatgtatgttgctatttataaaatagtgtgtatcgattaaattaaagaagcaggagattatttgaacttagttatgtttgtaaggaaatagcgtctagtgcttggaattctttaataatgtactaaaagtctctgatatctcatcttttccttttctcaggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttgtgagtgtgtttagcctttcttttttggaaatatttgtaaaaagggccaccatccctaacaagttaagtcgtaaagtttggcattaagggagtatagaaagcaactagaccttggaacttttctttgccttggtattgtcctttatattaatgtggtgccttttcttcaagtaagccaaatgatatacatacatttagttggttcttagagcatcctcctgaagaaatgaaatgtgaagtagtcatttttgtattttgcagataagcttagcacatgcggtagtgtgtgcctgtagtcccagctattctggaggcagaggcaggaggttgcttgagcccaggagtttcaggctatagtgttctgtgatcccacctgtgaatagtcccagctattctggaggctgaggaagagggttgcttgagcccgggagtttcaggctatagtatgctgcgatcacacctgtgaatagtactgcac

SEQ ID NO: 71316 - DNA, 1353 bp, Homo sapiens
gtccccactcccccaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggtgagtagggaggtgggcttcagcactggtgacatcgttggaaactctggcgagtgagtgtccagggtcagtgccgttgtttttggtgccattgagaaggttacaggtgtgatttgcaaaggaaacaaatccagaaactagtgttgggtggaatgtaatctcatgcatcctaatttactccacatgtggaaagttgttcccagtagccacacgtttattgttggcttgttgacaccttttcctgtgtctttcagttatttgagcgtttaatatatttttccggattccaacgtgtattgttatcttattatgcttcaccttgagttttgctggtatggcagggacgatagtgagggaattaagttcttaattctgcaagcttcatgctgatgtttaagtacagaagcaggccacagaaattgttgcatttggctgttttttcaaggccctttcaaaggccgtatgtttagaataaggaagataaggcacaaattcattgaaattattgaagccccactgcatttttcaaagtggctgcatttcagttagtttattatattttatgcgaagaaaaaggtgtaaaatcagcaactggcagatggttgcataggtcagttagaaacacacacataaactgtagaactgtgtaggaaattattttaccctaaatgagtagggaagatagagcttagtatcttgattcttgccttcttccgggattgcttcttagaatctcataggagaaagaaaatgagaatagaactgcattttagaatgagaaagtcttatgaggatcatattgtacattcccttcatctgccttctctctgtgggatactcattacctttggtttatggctgctgaggtcatcacgttttagtgactcacaacaaagcagaaatctgctgagcctctcgcattaaactctggtttgaactggtttgagaaggcctaggagtcaacctagaaacaccatgctgatttttatcttgaaattaaataaatattcaggaattttcagaatgagagttgaaggtgcagacttgtagttgtacttttaaaaaaatat

SEQ ID NO: 71317 - DNA, 1102 bp, Homo sapiens
agtagatttcttttttatttttaaagtcacagtgccacttcagtttatccaaaacttagatggagagctacacgttggggggcggggggtatgcagagaaaaggaaaatgaagaaaacagtggacaaaacaattgagaggaaaaacaagttttcatacaaatctgggctctcttccaaagagatcattaattctaagatattttactatctgctcaatgctacaaagcttccacgtggccactggatgaaacagtgtgtaccaagccacggattccctggcaccatcattcacacagtcaacaacagcacatgctggcaaattcgttctcaagtaccagcttacagtctccttcacccaaagcaggaggtcaacaattactttccattacattttgaatacaattcccgaaggaaggaatgcaagaaaatgttcctctcatttttaaggactgtttttggctgtttggggttgtttctgttttggtggcggtaaagttcttctttggttaaggtttaatgtttatgtataccatttacccacaccacggaaggtgggaaattccagttgttctcgccctttgagtttttagaataatcgtatttacaatgaggtgctcagaatctgaaacagtttgcattttagaagtataggaaaagagtctccttaataagcacctataagttgcaggcacgtaaccaataagggcaggggagaaattcccaaatgtcaaaacaactcccccatcccccaaaccccagcacccatttctttttcttaagatttaggcctggagaagatgccagattaagaatgcaaaccaccttcgaagaggaccttaggttgagcgcccggctgcgcgctgtgcggcgggcgcgggggtcctggccagttcgggcgctcgctagctgcccccctcctcgggctcgctgctgggcgaaggcgccgaagaggccttggactccccgtcgctgttgcattccgccctgcgctgggggacggcgccggccgcgccctcgagcccccaggcctggcgctccagcagctcctgcaggtgcttgatgtagtcgatggcagcgcggagcgtctccactttgctgagg

SEQ ID NO: 71318 - DNA, 1016 bp, Homo sapiens
cataccaaagagacttctccatatactttagcatttaaaggtcctgagaagtcctgcattaaggaatcctttcacttctgtttaacctacagttaccttgtaacacctaccaatatattcccctgtaatttaccaacacttcagggaatgctaacctagacccacgcattaaagacctttgggtcagagaagttttacagcttggagaaaaagcctttttctctcccacctccacagcccctccctctttttcacttccctccctctgtcatgagtgggcagggccaagcattgttcaccagcttctgcatctggttcagctaagtagaataaactggcaacattaaagcaaaaaagtcatgctgcaggcattttcaaattacctagtctctctggagaaaccaactgggggtgaggcccagaaattggggaaatgtaatgcataataataaccattaaaaaaacagaggaaaatgatttgtaggattattgagtgccagaaccccaaagctataaacaggatgtttgaaacgatttcaagcataaaggtcacaatctgcaatttaaatgtcggtagtttgttgccttttttcttggttatggttgggtgccaccaattagttcaagcgtgtgtgcgtgtgtgtgtgtgtgtgtgtgtgtgtgtgtgtataaaggtttttcagagtacactgggcttctcagtcaggctgagttggttggcagcctggaaacccacacaggagtgggcaaatcctttacagcatgaaagcaaggaggacccttctgctacacagtgaaagtcttcttcctctttctgcaaaaataaaaatataacacaacacaaacactttactcccttcagcagtctgcagttattttaccctgaaaaaaatgaatcattgaaaaatcctggggtgggattgccaccaaacctcaacctagtctggtggtcttattaatgccaatcctatattctgacttggccaatgccttgagagggtatttattagggtgaa

SEQ ID NO: 71319 - DNA, 1025 bp, Homo sapiens
ttgctttcatggtagagtaaggtgtgtgtgtggacacgtgtgtgaatgtgtgcatatgtgtgcattctcatgcaggtgtgggctcatgtgcttgtgtgagcataacttacatgagaaccataagtgtgtgcactcatgagatagtgtcagtgtgagtgtgtacttggtgtctgatggatttatgagtgtgagcgtgcatgtctatggatttgtgagtgtgcgtgtgcatgcctgcaagagaattggtgcatttgtgaatcggtgcaagggtgggtatgtatatacacttgtgaatgttacgcagttgtatatatgtgagtcatgtgtgtctgggctaagcaggtgtatgcctgcacagatccacgtgtgtgctctaggggatctgtgcagaaatatccgtgtttaagaagctatactctctgcctggtgcatgttttcatagctgtgtgtgttatttgcatgtgtatgtgggcatttctcagtgcctgcatacatgtgcatacagccatgtgagtgtgagtttgtgctatgcacttacaggcattatgtatctgcatgttttttaatgtacctttgtgtgtgcctctatgtgcatatgtgtgtgtagcattgcacacctgattgtctctgtatgtgtgtgcatctgtttgttctggtgtaatctctgtgaatgtctctgtgtaaacgtgtgtttctgaacgtgtgtatccgtgaatgttagcatgtgcatttgattgtgtctgtgtatacatgtgtgtttctgtgggtgtgtgactgtgtgtattgcagtgtgaactttttgtggatctctcgacatatacacaggtgtttctgagtgtatgtgcctctgtgtagcattgcacacttgagcgtatctctgtgtgtatgtgtgtgtttgtgagtgtcagtatctgggtgtgtcagttgcagcgtacatttgagtgtgtctgtgtgcacgtgagtgtctctgaaggtgtatttctgtgtgttccagtgtaacttttgtctcacgtatgagtgaattt

SEQ ID NO: 71320 - DNA, 1309 bp, Homo sapiens
gctctatgcagcccctgagcatcacactgtagcaatgagttgcctgattggatcaaaccaaaaggccaaaccagattccatatgggacataaaactgcagcaagcacgtggctaatggccagtagctttctctgggctggaaggtcttctctctgattcaggagactttaaagaccagcttgctgtgtgaggcctcccttctctctggtgggattggcaattgtacatgagattccttcaggaatggtttgatccagacgatcatccaggacttggcaatgagctagccatagaggagaggggaagacccagctccaaggagtgcatgttgcctctggggaggcagtggtgccactaaaatccctctggagccacacagccctaggttgaaattccagctctgccacttatgacctgcgtcaccttgggcaagtcgctggacctatctgagcctcagtttctcatttgtataatggggagaatagcactcgccttctagagtcatggtgaacattagaaattatgcatttcaaatacaaaagaaaaaattagctgggcgtggtggcaggtgcctgtaatcccagctacttgggaggctgaggcaggagaatctcttgaacctgggaagcagaggttgcagtgagctgaggtcactccattgcattccagcctgggtgacagagaaagactccatctcaaaaaaacaaaaaaaaaaaaaaaaagaaaaagaaaagaaaagaaaagaaatcatgtatttcaaggttctggaagcccaacaagtaaaattgggattgattttgcttgaaattaagacagaccccaagattttacaagctaaaaaataagattgtcattttcctgatggcaggggtcatatcatcttcatggatgtattcacagcacctgacatacaataggtactcaataaatatttgttaactgaagatataaaaacatgccgccccccgcagtggagaatatttggctcccactgattagaatagaggtcttttcagccaaggagggagaaattttcctcagagatgatgcatttgtgcagtttgtgcaggatactctcgctgtggatagatcccttggctcaggccaggcccgtgggacaaaccttggcttgccaaatggctgtcactcaatgaatgtttgttgaatgaatggatgagctgtagtttgaatgtcgggggagggagaagtaaataggaaccagaagaaattttaaggtagtttttatttttatgttttactaagcaagagccagaggaacagaaagctcagtccacttgctctaggccac

SEQ ID NO: 71321 - DNA, 1014 bp, Homo sapiens
aaacgaagtgaaatgaggacctagaccttgagatagctaagtccagggcactttccaaaggaaaaatatatgttttaaggcagcttgtagagatagcaacatgttgtcaaatgttaagccttttagagctgtcttaatgcaagaaataggaagctctgtttggtgcttagggagtggccttggcttgggttcctggatgcccagctgtcaccaggtgacctcaagggcttggctgcagcccacagaaggcttcactcctctctattggtctccgctgccctgattagaccaggttctgccaagacaaatgactttcactctctcatttctgcccaaaggaaggacttgacattaaaaggtcaacaaggtcacataaccagagacacattggtgaggcttcctcctgtaacccttgcagctttgtccccagccacctttgacgttttcctttccccaaagccaagtacatcggctgctacctggatgacacccagagtcgggcccttcgaggagtgtccttttttgactacaaaaagatgaccatcttccgttgccaggacaactgtgctgaacggtagggtcccagcatcccagacttgtccatttcaggcccttccttctcagattcccacctgtggtattctttgccctgctatgggagggtgtgttgaagggtgagcacgtgaccacaggaaaggttgacgcaagggtgtgtgtgcattgtgtgtatgtgcataagcacatccacacaactgaggactgctcaagagttggtctatgggagtctgtggttgtgcaactgtgtcatattgtgtctaggaacaattttgtagcatacagggtacagggtcagctagctgtgtttgtgagcttaatgccaatatgcaatgatctttaaataatagtggccgtgtatgcaggagtctttgtgaatatgtgtgcaagggctgagagttgtgcttgtgtgtgtaggtgtctgattgcatttgttgaatgttcaacagtgtgttgaga

SEQ ID NO: 71322 - DNA, 1145 bp, Homo sapiens
ggctgggcgcggtggctcacgcctgtaatcccagcacttcgggaggcagaggcaggtggatcacgaggtcagattgagaccatcctggctaacacggtgaaaccctgtctctactaaaaatacaaaaaattagccaggtgtggtgctgggcacctgtagtcccagctacttgggaggctgaggcaggagaacagcgtgaacccgggaagcagaggttgcagtgagccgagatcacaccactgcactccagcctgggcaacagagtgagactttgtctcaaaacaaaacaaaacaaaaacaaaaaaccacacacacagatttctggagccccactcccagaatttctgattcagtgggttttagcatttccaacaagctcccaagggatgctgatgccactgattcaggaccttaaagcaagggtctcaaactcaagtgtctccaggggccagatggtgaatgcaaaggggaagaatgggctgagtggagactgggggttctgttctttaaggaagtctctctaccagagcccttgcatgcctgggtcaggccttggagggggcacttggagaagatcccttctcccatctcagactcatatgggaccccaggcccccaatatgagatgagtgtggtggatccccttatcccatactccctgcagcctctccgttcagcctgttctgactctttccttagtattggtttagagctcccagctgttttgaataaggaaaaagagtggggcctgtcggtgttggggagggagagcatcaggaagaatagctaatgcatgctgggcttaatatctaggggatgggttgatctgtgcagcaaaccaccacggcacacgtttacctatgtaactaaactgcacatcctgcaaacgtaactcagaacttaaaataaaagttgaaaaaaaatatactgatgtccaggctccacccagtaatagtccagggtgcagcctgggcactggggttttcccactctcctctagggaccgtaaggagcagccagcacagaggcccaccgaggtcactgatctcccaggtcttttccagctttgacaagcagagtctgtgctcttaggacaggctactaccatttgcacatatggatatctcagcctggtgaccagtttt

SEQ ID NO: 71323 - DNA, 1009 bp, Homo sapiens
gaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgttttctcatttaatcattacagcaaccctgagttaggtatggttataacttcccttttacataggaggaatctgaggcttagagaggttaagtaacttgcccaaaggtacccagctagtctctgccggagcttggatttgaacttcagtttgcctggctcaaatgaggctgcagagttgggaaggacttaaaaagtttggagatttttgccataaatattgatttttctgcaaatgaggatgaacatcttaatggcctttaagaaactttgcaaatagttttcaaaaatgatgcaacatggcagagaaaatgcacttggcttccagctccctcaacagccattaacagcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggca

SEQ ID NO: 71324 - DNA, 2354 bp, Homo sapiens
gcattattgcaatgttcccattatttgagggactttttgatgaacaattgtctcccccactaggctctagaggaagacagggccccaagcagacagaaaacatggttgtcaaaaggatagactctgaagcttggattcaaatcacaggtctgccttttcctagctgtaggacttcaggcaaatgacataagctctctgtgactcagtttcctcatttgtaagttgaggctcataacctacctacctcattgagttactgtgaagattaagagagtgtagaatgcaatagtgcctggcatgtaggaggtaccagagaggcatttgttcaataaataaaatagcaaagaaggaaatggttaaatcacaaaactggacttgctcagagtcagggggaacattgttggtcttgctggtattggtcaacctcttaaagccaactctagggttcctctaatggtccctgtcttctcttgcagagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattctcaaaagcattgccatgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaaccctaccttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgcttta

SEQ ID NO: 71325 - DNA, 1095 bp, Homo sapiens
caaggagaactcactgtctctaggctgaggggcaagagggagcagtggttcttggtgcctggagagtatagctgtggccaagtcgacccatggagaccctacagggaaggagctggagggtaaacacccaaccttgctgtcctccagccctgcaatccctgcttaacactgtcatcgatcaaccaaccaggcaggtgtgaggcaagctacttgctcccctgcctcagcttcagacatccccgttggtaaagtgggactgataccagtgaccttgcagggttagggggaggctgcagagagaaaaggtgtgctctcacccacggtgtgctgcatcccagcagccacaccagctctggggcgcagaaggctccacatgtccttggaggatggatgaataaatgaatgatccccgcctccaaaggcttctcctgtaaccgagattggaggcatttcacattcaggctattaaccagaggcagagggacctgggggagaaaattgcaggggacccggagccctgccttgctccgtctgtaaaatgcacaccctgaatcttgccagattgattttctgggggcccttgggaggttccactggggcaaaagccagagttttgtggaatgttccaaggaggcgaagcagtggacagagagtgagcttgtcaattcagcagggtttgggcttgaagcctgtctctgagcattccttcagaatggctaattggacctaccttacttacctgagctctctgtgtgaccttgggcacgttagttaccttctctgtgcctgttttctcattagtagcagtgcttacaacagtggctggactgtagtgaggactgtacgtgtatttgtttaataaaacttaagccaataatgtccattggaggcttttgttctgcatggcaggagaagccagatgtgaccttgaggccctgtccctttcccagcaagggtccggcagcgggggtgtgggcaggacacaactgtctgcctggtgaccatcccacccccagcaggggctgggctcgacgaggaaggactagggcccaggactctttgcacagcctctcctggctgggctgacgttgttac

SEQ ID NO: 71326 - DNA, 1050 bp, Homo sapiens
tgaaacagaggtggaagactccaggctgccactaaatctcactcttgttgctgaagggcctctaagaatctttgtagctccatggggcaggcaggaaactgcaactcctctactccaaggagttaagagaccaaagttctagacatttgttgagcttactgtgtgaccttggcaaggcactcttactctttggccacaataatttcatctgtaaataaggaggtcgaatggtatatcagctagggtagtagctgcagtaacaaataggtccccaaaggcataagggctgaagcaaagcagagctttattataaggcaagtatttctgaatggagggtggtcctcttcctcatggtacttcagtgactcatctggtggtcccactctctcctcagatatcctcattgtctgcagccaggtgcacaagacaaaagaaagtatggaggtggcatatttgcttatctgctttggcctggaagcagcagacatgacttccactcacatgagaactatcatgtggccaatctagttgcaaaggaggccaggacatggagttacaaggatatgaggttcttggcaaagagcagctctttcccagccacagtcgtgtattgtggacagggagaatgaatttttgtggacagctacctgtctctgtcacaaatgtggtgacctcttgggttgcttccattctttgattctaagtctacatttccattagtcaatcttagttaacatggtgatgttggactcacaacatcacctatcctcaaggtaattcccatcaaatatactaagtaaatttccagactccaggcccctaaacatggatttttctgaaacataggcaactgccattctcttttccccctggaaaaaggaaataagaataatggtttgatagaacatgctgcgggttattaagccaaaggtatttatatccattatctacttgaatctccctacaagcctacatggaaaggcctcaggactatcatccccattttataggtgaataaaatgaggctcagagagctaaagggacttgcct

SEQ ID NO: 71327 - DNA, 1030 bp, Homo sapiens
cacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtctctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaagg

SEQ ID NO: 71328 - DNA, 1317 bp, Homo sapiens
actgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatattttt

SEQ ID NO: 71329 - DNA, 1052 bp, Homo sapiens
cgctaccacacctagctaattttttgtatttttttagtagagatggggtttcaccatgttagctaggatggtctcgatctcctgacctcgtgatccacccatctcggcctcccaaagtgctgggattacaggcgtgagccaccgcgcccggccagttttatggatttttttgccttccttttggtgagtaatgattagggtgaggaaattgctaatgtaacagagacatcagatccagaattccaacgaacctgaatgagccctggtgtggaacagccgtgagcctgtccacgtttttctcctgatctctgcttttcattagtaatgaatttccactccttctcccctttcatgacaaatcagtacagtgaatgtaattgccacatccagcgatgcatcatcttcccacttttctaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaaggtaaggagctcttgagaaattgtgttttgaaacgtcttaaagttagagaagttgcgaatacagtatgaagaactttcttccctgaaccgttaccagcttgatacccattaccctttgatcactgttagggtgtatgtcttgcaaacaaggggccctcttctacatgactagaatgcagccatcagagccggggttagcaatgagctatgggttcccatttatcctgataatgtcctttgtagtgaaaggatccggttcaggatgcactattgtgtttagttgtcctgtctcctggatctccttgagtctggagcactcctcagctttttttttttactctgatgacctgcagtcttgtaagggggcaggccagttgctgtgttgtgcccctcagcctgggtgtgtctgatgctccctaagcattggattccactcatgcatctcgggcaggaatagtgcacaagtg

SEQ ID NO: 71330 - DNA, 1033 bp, Homo sapiens
gagtgagccgagatcgtgctattgcactcccacctgggtgacaagagcgagactccctttcaaaaaaaaaaaaaagatctgactctgggtatgaaatttgacactaccctggattcataactctcctgtcagtaggacgccatagtaaaatttccctggggactgtatcaggttacagagagctgttggactcccccgccatgtgccgcacatgtgaatgctgtaaaggcagaatgctggttgcagatcacaatatcaggtacactttccagtagcccctacatggctgagggagagagtgcttcagggaaatacttcgtaggtgactgtagagactctggaaggagaaagcatcatggatagatctgaaagctaaggtcttctcagaagctagagttactgaagagtgagtttctacctgggagaagacggcctctcccttcgagtgccttccactttgtgtcctggtggcagcaactttttgttttctgccttagagctcatggtgacacccagcactgccggaaggctctgcaccgggccgtccagtgcaccagtgactacccagagcacgtctgcgaagtgttactcaccatggagaggacagaaggtgggacccccagctctcttctggcttggagcctaacccatttgctgtttggtctcaagtaggagcatctggttacagtctggggacagactgtgtttatgctgccaccttaggtggtgccctatgattagactgtcacaagtgtcctgaaaatgagtcctcctgcagctcttctcaaattctgcagctacaaggaggactctgtgatgtcactgtagcacagggttctaattctctgtgggggggactgtgcgttatacaatgtttaggggcatccctggcttctagccctgaaatgccagtagcagcttcaccaccacaaccaaacatgacaaccagaaatgtctcttaacattgccaaatgtctcttgatgggcaggatccctcctttgagagtcactgtgctctagtacaacatctatc

SEQ ID NO: 71331 - DNA, 1048 bp, Homo sapiens
gtgggagaacttctaagctatttgtcccaagtgaaaaacagagagcggtgacaaagtcattacatcagtgttccctggggttttctttgggttatggagtgtagtgacaaaaagggctctgagtgagagatgaactggttatatttgtggcttcttagagctttttaacatgctaatattcattgtattttctaagaagttgtagtgttttctccaaacttccttgatctggaacttttcttgcagggcgtcttgtggaagaagttttttctagaacacagtctgtagagtgctgtagcaacttctgtcttcaacattcctgtctagctcatttcattctgttgcatctattagtctttaaagtcatgtagtgttttatagtcagtagaatgtagtgactttctattagtttccatttgaattggtaacaaatcctgacttttctccaactccagtaaccttcgagaaagctttgaatgccggcttcatccaggccactgattatgtggagatttggcaggcataccttgattacctgaggagaagggttgatttcaaacaaggtatttaagcacatgtttttcactttagagctgaacatgttcttaatacaacttttggcgagatgtcccagttccccagatacattgtgattgggcaaatgatgtagactaggtattggtgactttttcccccagaaatcttagcaatttctgtctttaacaagtcatgatgtggattgtaaagcaagagagtaatcgtttatactggctcctgccagcctttttagtcttagctctcatttctcctttcaggtctttttatttatcctaaatacttcttgaaataagtctgctgtgttttagaaaaatctttgtacctctgtgggatcctttgccccttcatgtccccccgaaaacaaccagaaaacccctaacttgtacttgcacactcatgtcagctgtcacctcatacaggtagcctttagccattctcttgtttgcctgtgtcaccccagctgggggagactcccccccacagcaccctg

SEQ ID NO: 71332 - DNA, 1050 bp, Homo sapiens
ggaataagaaacctgaaatagcatcaggcaccaaaattttccagtttggttgtattaactctactcagtagcccaagaacatgacttctggtttggaagggtggttgacagtggtcactggcaaaggtgttgctctttcactcagttcctgattgatgggctacttaattccctgtggtctaggaatggatttagaaaagagtttatggagcctttgtagcgactgccatgaactggcactttggaccagatgagaagactcttgttttgctcaagaagttgtagaggccatagtggagtggttctgagagtgaggatttggcgattcatagttactgtagccagttttgccaaaatttattttatttgcagatgtgttgtgcttcctgccagtaactaaattcaatacaattttcctgtactccagttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagtaagatcactgttctaatttcattttatttttgccaatttagaatctacttaaaatcagtaagagtgccaggagtttgttgcatacggccctactcttgcttttcctccatctgctttttctcctctttgccaactcgtttagaaagttttagtgtttcaagttatttaaaaatggtcactaactgtaagtaaaatgagcatattgtctgtgttgaggacttataacaacttgatatttttcttttaactttttattatggcaaaaatgtaaacatataaaagtagacagatcagtaaaatgaaacttctgtacccctcacccagcttcaacaattagtaacatttatagctttagtttactttgatctgtagtctcacctacttgtcccttctgtgttactttgaagcaaatccagaaatgatatttcgttggtaaatatttcagtatgtgtatataaaatattt

SEQ ID NO: 71333 - DNA, 2240 bp, Homo sapiens
ggaagaggtcgtataaatttttttagcttgaactgaaaatttgttgagatattttttgaagtagaaagaaccagagttggccaagtgcggtggctcatgcttgtaattccagcagtttgggaggctgaggccagaggatcacttgagttcaggagtacaagaccagcctgggcaatgtagtgagtccccatctctacaagaactaaaacattagctgggcatgatggcgtatgcctgtggtcctagctactcaggactctgaggtgggaggattgcatgagcctggagtgtgaggctgtagtgagttgtgatcacaccaccacactccagccagggtgacagcaagaacccttctcaaaagaaaaagaaagaaccacagtttgtcatttactactaatttgcttctttagcccgtagctggcttcctttccccttttgaccgggaacaaacctttgattcacagcttgagaaagtccacagtcttttccggcgacagttggcgatcccactctatggtaagagaaactgacatgtcaacagccagccctctatggtttttaaaatgctttggggaacaacatgtagttagacctttcccaccatcctgtgaggcaggtaaagctggtgttcttactctccttggatattgtctctttggatgaggtccttggtaaaaacatcttgaatgttagtgcttaagagggttgtgagggtcagaggcaggactggaagccagactccctgactcccaggtgagagctcttttctcctttgagacctagttggaagggcagagatagggtctctgaaaggaatagtgaatgacacctgtattttttggggaaacttcattgaacaagagttccattataatcattttctcttcacaagtaacctcttccataacagcaggaattttacatgagtttagatcattcctctatgggagggatttggttcagaagtgcagttgattggaagtactcataagtgagtttcttggggtttggtaaagagtttccttatttggtaaatacattttggcaatctaagcctttgagtctttggagctatgagtgtgtgcgtgctgggaggatttttctgagtatgggaagagtttgtcatggctgttgtgtttgttccctagacacgggcatgtgttgtacatactcagaacctctgggcaactttactggagcccacatgttatttctcttcatggtttattggatttaacaagttataaagtagtcgtctaatcaaatggttgggtatcatgcagaaaacactagagctgagccggcttgcagatttcacctaccagcgtgaaacaacctagcataatgattagagtgcgaacttgagccagactgcttgggttcacagccttgctctaccattaactgtagacgagcaactgaaccctctgcttcagtttcctcaactgcaaaatgaggatcacaatagactaccttgtagagtgggatgactgaatgagttagtggatgtgaagtggtagaacataggtaacactgggtaagtgttgttaaatcgttgccactagtgtcattgactgattaattagctgggagggttgcctgggacattgttttaagacagattctacagacaggtttgggctcagcagaaatcagaatttgatcagtaagagctgccatgccacagatgtgggaggggctagtggcacctgagtctcatggcttaatctgtgtttgggttgataaagcccaatggcaagacccacggggctgaatccatctttcaatagatatggaggccacatttgcagagtatgaagaatggtcagaagacccaataccagagtcagtaattcagaactataacaaagcactacagcagctggagaaatataaaccctatgaagaagcactggtaagtgttggcttcttttatagtaaacgtctctctacaaacctttccctgatggatagttgcgagttaaacagtatctttaaaatgttttattctgaaatatatagagtgtataaatgtatacgtacagtttacatactaataataaagtgaacatccatgtacctaccacccaggttaagaaatagaacattgccagtaccttagaagtctcctatgtgcccctctccgattgcctcctcctccctctcccgagaggtaatcactttcctgacttttgtgatgataattcccttgcttttctttatagttttacaagctatga

SEQ ID NO: 71334 - DNA, 1072 bp, Homo sapiens
tactagctgtgtgaccttaagcaaattatgtaaacattctaagactcagtttttctagcagttaaatgatggcaacagtagtttctgcattgtaatgtatgacggtataggatgagctattctacgtataacacttaacacatgcctggcatgttgtcatccttagatagatgtcattattattagtgttactatcaccaaccttacaggattgtgataaagactgaatgagaaaagtgctttgcaaaatataaaatgcctaacaggtggaggatattatgattttagtgatttgatcttatttggaagcataaaacctcctatgtgcttagttcaggttttaagaagtgaatttctggaaacaacgccaggttgtgtaagatggatgaaacgtttgcatgctgatgtctcttggtaaagtccctgcgcttagcctaccctttggtattaatgcgggaagtatttttgtctcgtagagctctggctggagtggctgcatgacgagatcagcatggcccaggatggcctggacagagagcacgtgtatgacctctttgagaaagccgtgaaggattacatttgtaagttcccgtggactttttttggatatctggcaatgtcatatatatcagtctgctgttgaggactgtattatgagatgttgctacccagaaaagggaacgttagtttcacaattagcaagatttaagttgagttgtcttatcattgtctttggtctttaattgaggaagtttaattttaaaataaaagtggaagaagcacttgtagtaagggaatgaatacactcacactcaggatttattgacagtgagaacttacatggtatttccactgatcttttatacattcaataggtttttagaggttttggacaggatgctttaaaaaaaaagattaaaacattaaaagaaaacctttttattttgaagtaattatagagtcataggaagttgcagaaatagtacagagaagtcttgtgtactcccttcacccagtttcctccaatatcttgtttctgtaatacaaaatcaaaaccaggaaattgaccttg

SEQ ID NO: 71335 - DNA, 1050 bp, Homo sapiens
cctcacatgtgctaaaggacgttatgaaattacctttttattttttagtttttcttaaagaccagtgtaacagtagaaattttttaaatccttggaagacctggtatgagctagaaactagtagtgtcctcattttatagatgaggaaatagagcttaggaaagtaaataacttacctaaggtcacatactttttatttgtttcattagaatgcctcctttatttccaagagaacccaaatgtcttctaacaggaactgtaacagatttgagggagctttatgtttgttacaaaagcctcttttattgttttgtcttctacctgtgggtacgtgctgggttgctgtttcagtggttttctcagatagcacgtttattttgtttgtggcaggtatatgtgtagttaccagtagtgacaaaagctaagttacttgatgacggtgttttaaatttcaacttgtttcttttcctgttagttgtctatcaacgtctatgactacaactgccatgtggacttgatcagactgctcaggctggaaggggagcttaccaaggtgaggatggcccgccagaagatgagtgaaatctttcccttgactgaaggtaagcttcagcagtcaggctgcttttagaaacagaaacaaggcttgcacattttttacaatgttgaaagtgggacatgctccttgtagaaaacctggaacgttcagtgtagtggaaagaagaaaacgcatcagagttagctatttttagtttattgtagttttttgcaaaatgtagttatgatcatataacacggattttgaattctgatttctttattctaacgttgtggtaaacatttgtaatgtaattaaacttggctttcatttctgtatttcccatttcactatttatgtatttaaaccattctcttgaaaccagaaaattgtaaatatatttaaacttttacagacagttttttatgtaaatgtttcatacattaattgttccagaatagttgggcatttaggttatttctacttatttgcttattagaaacataattgca

SEQ ID NO: 71336 - DNA, 1026 bp, Homo sapiens
gttgtgacggaacgcatgccattataatgagtttttatatctggtgggagcttttacagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcaggtgggcccgggggtgggcagcgggcatcttccagtctttcaggtcctcgggtccccatgtcctggcccgcctccctagtcctcggcggcgataaagccgccaaggctgcaaacccgcttttcgtgacagtagctcctgtcggatttgagtgcttactgcctgcccattgccttgcaaacgttatctcattgaatcctcgccacgaccctgtgaaggaagccctgttatctatccccattttactggaggaaactgaggctcgtggaggaaagtttcttgctcaagataacacttcctgcaagtcaggccttgtactttgatcccattccagaactcccactcttaaccacacgtccaacagtagaaataaactcattcgcaagagagtgttattttgttatgtaggaatgacggcgatgatgaaacttgtggtaagaaaaatattgaccgcgatggtgataatagaaatggaaaggtttc

SEQ ID NO: 71337 - DNA, 3574 bp, Homo sapiens
gagggattaaataatcaaaaagacagcaagggtgggggcaaagtgaacaacgaaatcagaacagtgatccaggtggctgatcgcaagccctctaaaggcagagataataaagagctagaacttctttttcatccctttgtctcccaagtgtctttccctggtagctgcagaggtcaaaggtcccaaacacagtgaagagctggactttctaaaatccagttgctgtcaaaacctctcagaaaagccaaccagcaaggcactcatctttgctgccccaagggaccaggttcagggagctgagtcacagaggagcatgcttggaagctggccagctccacagcagagcagtttgccaggccacgtgccacctgcttcctgtggctcacggccttctggctggcaagcccctgtgggccaggaagctcagacctaacctgctgtggcaggaggtagctctgaagtgatttgtcaggaactgtcctcaggtgaagggagaaatgagacaaggcacttttgctcccagaacctggcccttaggggactgtgaattgtgatcagaaaatgggagagaggacatttctttaaccttgagatctcccatctgagtttcaggagcagaacctgaatcaaccaagaagggttagcagaattgggaaactgaatgatagacatagtcaaagagtctggctgttgggaaatctggttttctgtaaggcagtggggcactgttctacatgggcaaggatctgcctgcctcacattatcccccagggctgtcaaccagaccccaggcatcctctttagttgatctggaggagatgctcctataggcaaaggggacaccaaagagagcattcggcctgactcggctgtgccactgccactgtgctacttacctgaaatcttcccaacctctctgatgccattcggcacttctagtcaaaaggatttaggctaacatttggtatgaggacatcggagaagctgatattcacaaaaccagcataggaaatcactaccttttaaggaagagattcctgttacaggccacaagcagatccctaagagacttctcacaggttccactcctgacttagagaagtgtctgggctgtctttgcttacccaagccaggcagtgcagctgtgtatacttcatgcttgagaatcccagctgcagctttgataaagtgggagtcctgagaagacccttagccgtttgagttattaaacagaaatcatccccaccaaccctgagagcctctttggcctcccttttttattggctggccctcacaagataaagtgttgctaaaactgcccatctttccattatgcctctcaggtggaggaagccttgactatcaaaaacacagatatcgccaaggagctctgccttcctcccgtgaaactgcactgctccagtaagtctctgctctccataccagtcagctgggacatttggcagtaatttcaacttggtttgcaacagtccttttagatcatggagcccacgtttgtaaccctcagaattagagctcatgagtctgtccttataacctgcagagggttagagcccccatggtctcacattcatccctaagagaatcatgccagaaggaggtatgcaccagccatcatactgagcacttcatgggcgtaatttctaaacctcacaaatatccttgagtgcacagtagatgtcattacttccctcttatggatgaggaagctaaggcttgggttgagacgcccacatcacatggctaataagtggaagagccagaatttaagctccaatctttgatttcagaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttcttaaccttctcagggaaagaaggaatgagaaacattagccttaatgcatcgatggaggtttactaaccaaattagttaaaaatcagcagagagtcaggcctcttgccaaggtaatactcacagcagaagagccaggtgccggggcagacacactaactcattcttcaggaagcctggtcagacctaagttctttccacttgatctggaattttaagtacccataaagaaaggtcatcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtcaaactctcgatcactagagggtgatgtggcaaatgccatcccatcaacagattgacatgatcttttttccaaagggcatgtcaacttttttatcatgacaagattttgtccaaagctagactttgatgggagcaggcaagaagtaacatttcctgtgtccctactatgtgtcagacatcttctgtaagtccccacactatcctggcaagaaaagcatgattatcccagttctatagaagagaaagtagggtcaaagaggctaaggaactagcctgggatcacagatttttaaccctagtctgtctccaggatcacccgcaggagtaactcagctcaggaagcagctgctgacgtgcccagcaactcctcaccccagctttctggcttggttactccattagtccccaccagcaccacttcctcccagctcttaaagattctattcccaagtccatttctttcacatctagaaacttaggcttctttccttccgttacttccagtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatgatggtgttctctagtaagccttgtctcttgggcccatcattcaccctgaagtg

SEQ ID NO: 71338 - DNA, 1041 bp, Homo sapiens
acctaaggttgtttaaaaaacattcatccagccgggcgcagtggctcacacctgtaatcccagcactttgggaggccaaggcgggtggatcacgaggtcaagagttcaagaccagcctggccaaggtagtgaaaccccatctctactaaaattacaaaaattagccaggcatggcggcacgcacctgtaatcccagctgctcgggaggctgaggcaggagaatcacttgacctgggaagtggaggtagcagtgagccaagatcacaccagtgcactccagcctgggagacagagcaagactccgtctcaaagccaaacaaacaaacattcatccctggcttgggcataagtctaagcacgggccctcctaccctgatgtctccctatttttagctacccatagtcatgcaaatctcaataaaggatgccctatcttctagtgaaaatgggttattgaaatattgactgccatagtctcaaatgttcagcttcaaaagtaagatgtgtttgttttttctggtggtggtttttttgttcaggtataggctggctgcctcttaaatatacctcccttgttttttttgttgttttttgtttttttgttttaatgctctgggttctggtggagggcacagaacttcaaagactgttccttctgtagtctgtgaaggcagccacagaccagggcctttataggaatctcaaattagaaccctgggtagaaccatgtaaaattgtcctgtgtggcatgttctgcaatttaattcacagtccctctagactgagcttgtctctcccttctttattacatgtggcaccaccacaattccccaccacttttctttgtgatttttttaatttaaatgagacatttctgtcccagtgaacatcctcagagttgaacatcaggaggagcttataaacaaagcaatattcccagaagagcccaagtctctaaacgtggttgtactgctaaaacaaatggatattttttaaattcacattaaagacactctttccccaaacaaatctagtttgagc

SEQ ID NO: 71339 - DNA, 1265 bp, Homo sapiens
atgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaatggtgtttgtgtttatttcacgccttggctgtctgtgaggcagcccccacctctctgcctgacatagcttctctgactttggtggacgagcacggtgccatactcctctccgggggtaagtacaggggaagcgcgtgtgggtggctcagttcaagtacaagtgaggtctccaagccagtcaagcactgtgttttggcttccagcagacctgagcctttggatcctgcct

SEQ ID NO: 71340 - DNA, 1007 bp, Homo sapiens
tttcttagcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattg

SEQ ID NO: 71341 - DNA, 1013 bp, Homo sapiens
actactgcactccagcctgggcgacagagggagactcagtctttaaaaaaaaaaaaaagaaaaagaaaacagtaacaaaggagaagggctttctcatcattgtcatgaaatcacgctgatgtatgcgcgcattatgttgtcaaatcagtgaaattttgtgagttggatctcatttagcatccctgttgctgtttccatgtatgagtattgtatgtgcatagttcaaacttctgttattctaggaaaatggctcgcttaattgggatagaagaatatataataaggttataaaaatttatttttaaaaaaatgtatacatacacatatatgtattattattatcttccccccagaaaaatatgcaggaaccaattgctcttcatgagatggacactagcaatggggtgttgctgcctttctatgaccctgacaccagcatcatttacttatgtggaaaggtaaacagtaattttgatgtttggtgttaaatcctgtaagtggaaacatttatccttcagagatttagaggacgggcaatgtgttgtatctgtttaatttttctaatttgtgtgtgtatgttataagccaaggacagataatttggtatttttaggtcttgagactggactgtgtgcagcttgccagttgtgcagtgataacacgccatgttgcatacttttgactgaagcagaggttgggctggggtattggggaaaatgctccaatcagggcgctcttgtgaaaaaaagaagatacactggtgtttcatcttcacctagcagtgctacctgattggtgattttagatttatctgtacttatgtcagggatgggcaaccagttggccacatctaatgctgaaatttgttggataaccctagatgagcatgtgtatacttagtaccacacaccatggacttggaaggagaatggtgctttgtggatgcaaacttttgagggcctcagagactctccagagggttcttgttcctggggttcagtgctagggctctg

SEQ ID NO: 71342 - DNA, 1035 bp, Homo sapiens
aagggaaacttgaagtcacttgggtctaccagcccagttaactctttaaagaaaatagggttctgttttggtgtggttctttgtttttgtttggttgattgtttcatatgaacccaaacttaacaagttgtgtttttactttaacacttttatttcttttatacaaactttttcctttgtcacttcagtttttaacgctgttagtaagtagggcctctggtagggcctctgacaatcagccgcatcttttctctctctctctttctctctctctctctctgcatatacatatgtgtattctcactgtatctgtagttttctgagtgtgttacataggtgtttctaatcttctaatctctgatggttttgcctgttttaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgtgagtattcctaggatgaaaactcagtagttggagcacttgagtgagtgtgagctttctgctttttaaggcaggcagcggtactggtcagtgggaccctgttgtgtgtagacaccaactgtgaataagagaaggcttataaaggcttctgtctccccagttgtgcttctctccagagttgtaaattttccagcttttactcaagtctctcactttgtagccttttttcacaaagaaatagtttgtatcagttcactagagtccttaagagtttataagtcttgatcaattaaaccaattggctgcattcctgattttgcagcttagtattgaatattgatgaatcaattcctcacccttttccaaacacagctgttaaagatgcaacaggtggccgggcatggtggctcacacttgtaatcccagcactttgggaggccgaggtgggtggatcatttgaggtcaggagtttga

SEQ ID NO: 71343 - DNA, 1070 bp, Homo sapiens
tgatgggtgactaaaatagggaagcagtgtctggaaagcagtatttgaaaaataaaactatttaactaattgtactttaaaattagcacgtgagagaaacccaagtgtcttagttttccttttttcttgttgggattgttctcttgagttgtcctttttccatatccaggctttcacatgtgaaaaggatgcccatggtacagtagttctgaacatgtgcttaaagttgtttttttccagaaccacaatgggattttactgatggattcactttttcatgtaggagcccttggaactgaatgtcatttttttggttatatagatgagaggtttctatgttgcacaggctggccttgaacgccgagcctcacttccttatgcaccaggacaacaggcctgagccaccacagctcctctgatttcatttttgtcctttcaaaacaaaacattgccatagtaatgtgttgtccaaacagaaaatgttaggaacacacagcattatttaaattaagaaaataaaataaaaaagaggaagtagggataacttgtactctctgctgcactgagatgcctactctgggtgttttgtgtctgttttcctctgcactcactgcatacagttttgagaaagctggttggtattacagtaccagtctgtagccatagaacaaagaaaagctaacaagcctgcacagagatcagatctgtccttactgtggtaattggcctaggtataaaccagagctttcacacataatgatatcttgggtgtaaattagttagtattaattaattgggtacagtgctgaattaatttgaagacaagactcattctaagaaattctgatgttcagacctagaaatatatatggcgtcatagtggtcatattaacagcaaaaaaagtcatcatgaaaatatggtaggctcttttttttttttgccacgcgctattctaagcctttatgtgcatgataatatttagttattgtatccgcacagtaagccatgagtgtggcctattttacaacttaggaaacaggctcagagagtggcagttttgttaagggtc

SEQ ID NO: 71344 - DNA, 1955 bp, Homo sapiens
ctgcctaccgggttcaagcgatactcctgcctcagcctcccaagtagctgggactacaggcgcacaccaccacgaccagctaatttttgtatttttagtagaggtggggtttcaccttgttggccaggatctcctgacctcatgatccacctgcctcagcctcccaaagtgctgggattataggcgtgagccaccgcgcccggcctttacattttaatagtgccattcatttccagaactggtaatttatatattggaggatattgtcttattgtattaacattttgaataataccaaggtttagggtttttttttttttttttttaagccatggaacatccttttaatttacaatttggctatttagaattgtattttggcaaaaagactttcatattctcttttgctatgtctgctagtgcagttggttacatctttttggttctagggatttggattcttgtaatttgatcgcatgtccttggtagtggctttttctagaagtgaaagttgatattgactatacgatgtcatatctagaaaattgagagttttgggtggaggtaataaatgagaaatgggcctgagaaaatgtataacgtctgtggtgttgatattacataataggtttgtttctctcttctttcagactggtcgaattgacaaatcttaccctacagtatgtggccacacaggaccagtgctggacatagactggtgcccacataacgatcaggtcattgccagcggttcagaggactgcacggtcatggtaagctcccagggtgttgtgtgcacacaggccagtgagactcacctactgctttcaaaagcatgtgtgtgggtgtgtgtgtatgtatagaggcttgaaaagcagaacgttatagcagttttgactgtctgttggattttacaataatttactacgtttaagtttaattacagataatcctttcaagaagcccttaaatcaaaaaggttgtactgcagtgtctgccgtgtctttctttttcttttttttttttgagatggagtcttgctctgtcacccaggctggagtgcagtggcatgatctcggctcactgtaacctccgcctcccgggttcaagtgattctcctgcctcagcctcccgagtaattgggattacaggcatctgctaccacacctggctaatttttgtatttttaatagagacgaggtttcaccatgttggccaggctggtctcgaactcctgacctcaagtgatccgcctgcctcggcctcccaaagtgctgggattacagtcttttctgtgagtgtgtttgtgtatgtgcttattgacagttgacatgttctctgttggaagattttagggaaagtaaagtgacttttcagtaattctgtaatgccatttgaccacatgaatttcccctcgccccaaaaggagagaaaaaactgaaactgctggcacagactgtacaagacagtgacgtaagatgccaaagttatgcagataaaatgggatatgtcacaggtggtaaaagagtttttgcaattgcttgtttccaagctaatggcagaactgtgttctgtccagtggaccctggttaagaaagtccttttcataaagatatacaaacaaaaaacgtgaaaggtgaattaagtactttacattccctcctttagtttccaaaagtaggttatgtgtgaaacaaggctttggaatactttttaatatgatttcttgtccttagttatgatttttaactttaaaatgtgattattggtttggatcagtttttaatgctagcccaaagtaggctgaaaaggttaggcataaacacaaatgggagtacttgctgcccctgaaataagggaagatggtctctaattaatttgtaagcagtctcgcacatgtcaggtagtctcgcacgtgtcagcattggagaaccatgctacttttattttcctct

SEQ ID NO: 71345 - DNA, 1104 bp, Homo sapiens
ttttttgaagtccttttttggtgatgcgttttggaagatccaaactgggttgcaagggaaagtggaggaatgtgaagaaacctaggccttaggtctgtaaacagggccatattcaggcctcaacttagaacttacctttcccagaagaaaacctctccagagactgtgaccccacaaacctgcttgaatgtcttccttctctgttcctatgtggcaccataattggctgtttaaatgtctctctcctctcactgggctccacatttagccaggacaggactgccttgttcacgtctgtatctccagcactcagcacaatgtctggtccataaaagttcacaacacatatttgttaattcttaatgatggagtaaattattgtactagaagaactaataatgtgacagcttttattggatattttattccagatactgtggttaatttttttacttattttacagataattgtaatactgaattgtgatttatctaaaagtgttctctcatttaatccttacggtaattgtgggagttaataagtatcattgttaactattttacagatgacgaatgaggtgaagcttagagagattacatgacttgtctaaagtcacctgtttaatcagtagagcctggatttgaacccttacctgtcttattccagagcctgtggtctttacacgttaacgttctgctttcctggagatttgcacagtcaagtcaaattggagaaatcatagaaatttctgttcttgaaaaattgctaagaagcctgctccagtgttgggatgatttgccatataagagcaaaaacaacaaaaaatagattaagccatacattgcagtggttcctttctgtgcacctgctcttaaagcatacacagcttcagcgtggactggcattaagctattttaaaaaggaaaccactttcatatacccattgttaacaatagcagttgtcttagttgacacaaaattggtctgataaccctggttggtttgctagattcaaatgtgtgacatgagcaaattgtggtagctatttatgaccaacattaagcattttattcttaatcagatgtggaactggctaatgggtg

SEQ ID NO: 71346 - DNA, 1025 bp, Homo sapiens
taagtgcccagctttgtatttttaataacgtatgctgatttggtgaaatatgttgttgtgcttttgttttgatttcattatgagtaagaagatacttagaggtgtaagcccttgaaagcaggatagctgatacttgactgtgtgtttgtgaacatccagcatgccaaataatcagtgtacctttaaaatgccatctacccccatactgtcttcacatttttgttcttttatcactgtcagatatttagtcaattgcttttctcttgtgctacagtagaatactactttctctgttttatttaaggatttatgatgacatcacaaccagaggaagcagctgcttgtagaatatcattttttattaactgtgtttctgatggccaattgccaataatttttaacattacttgtgtgccttttttttacaacccatggcatagtggaaattttctttccctatccaaatctagtatggttggtcagtgatattttagatctttgcttcttgactttctctgtgcctcagtttctttatttggaaaatagggtgataagattcccacatcttaaaggttgtcatgaggacaaagttatcaaggtcttcagacagttcctagcttgtaatttaagtacttaaaaagtgttagccattgttattatttgttttgatagaaaggacagaaatagctggcagttgctctttcagtgacattcaggttccagagaaaatgttgagctctagtactttcaggctgtggatttattggggctgagctgggaatggcagtaatgcttattattattctcagatatcttgactgaagaatactggtgaatagctattaacttttagccagggttatttaattttaacttcaaaaaagaagtcatttagtaagaagcttcttagtatgtaattaagaacaactagtgctagtacttccagattcccctcaaaattgctttgtgtttgaataaaagcgcttcttagcccagattggaaaaaatcatttggtgttcttgga

SEQ ID NO: 71347 - DNA, 1238 bp, Homo sapiens
gtagctgggattacaggtgcccaacaccatgcccggctaattttttttttttttttttctgagacagagtctcattctgtcgcccaggctggagtgtagtggtacgctctcagctcactgcaacctccgtctcccaggctcaagcaattctcctgcctcagccctcccgagtagccgggattacaggcatgtgccaccacaacgggctaatttttgtatttttagtagagacgagatttcaccattttggccaggctggtctcgaactcctgacctatctgcctgccttggtttcccaaagtgctgggattacaagtgtgagccaccgtgcccggcctgtatttttagtagagatgaagtttcaccgtgttggccaggctggtcttgaactcctgacctcagatgatccacctgcctcggcctctcaaagtgctgggattacaggtgtgagccaccgtgcccagcttagattgatccattttaacaccaattggtagtgtcttcaaccacaaaccaatatgtgggtcagaaataattatgtgaggaatcattcttacatgaagaaacagtcattctgaatgatcttttgtaatatgtaggacatattggaagcaaaattcccaatgttgaatttcgagagtttgggaaggtgaacatggctgcggtacatgtgtaatacaccactagctgctttaaaaacacaccccagcacagaactttattgagacgtgtctgtcagaaattttctgtacatgtttgtgtacattaacagttttttttattgtactcagtactgccctcaatatataggatgagtctacttcttaaatgtggattcctttttagaaggagatgtgagatcgataaataagatatactgggctgggcacggtggctcacacctgtaatctcagcactttgggaggctgaggtgggcagatcacctgaggtcaggagtttgagaccagcctggtcaacatagtgaaaaaaaatacaaaaattagctggacgtggtggcgtgtgcctgtaatcccagctactcaggaggctgaggcgggagaatcgcctgtacctgggaggtggaggttgcatgcagtgagctgagattgcaccactgcactccagcctgggtgacagagtgagactccgtctcaaaaaaaaaaaaagggtcagaggggatacattgttaataagtggaagctgttgtgattttccagtaagattgataggaagtgccc

SEQ ID NO: 71348 - DNA, 1533 bp, Homo sapiens
gcctccacctcccaggttcaagcacttctcctgcctcagcctcgtgagtagctgggactacgggtgtgtaccatcatgcccggctaatttttatatttttagtagagacagagtttcactgtgttggccaggctggtctcgaactcctgatcctcttgccttgccctcccaaagtgggattacaggcgtgagccaccacacccggctaggttcttgcttttaagaagcttcaacaactgtgcttgatctctccaggggggtgctttgtgcatgaagtgctttagcactggggtgtgagagatagtttcaccctaggcttagaaggtaaggaagacatcacagagaaggttcggtttgaattcaggtttttttttttcctctgcgtaggagctaaagatgaaacagaagaggagccaacccaacttttaaactgttaagttagtagaggggctctgtccctaggagggcaaagaagtaggtggtaggcacattcctccttcagactccaggatgtctagtttaggtggatttttgtagtattgcagaaatagaatgtttgattggaagataaacaaatcatttatgcatagtgtgaactaacattatgagtcaaaagaagctgaaggatagctttttggtagaaaatcctacatttcttgaccctttctttcactttcagtgtgaatttggcaaaattggtattttccttgattgttatggggaaaagaactagaataagcactgttttatattttagaatcattgttttaactagatcaacatggcgtctttcgtttgtatcatctttaggaaaaagcagtgacttctgtcacgttgatggaaatgagactgcagaatgtcagcagatcgtacgtggatagtccccttcatgaacagtgtctctgttttttcacttggtagggtgggatcattcctctgttctacagttgtagaaattgaaaccaaattgagtggttgtccaagaccgtgaggttgtttgtgaattagaacttaggttgctgagtccttatttgatttgtacatgtatatttttattaattttttttctactgagtgtgaacgaatttttctttaggggggaggatatagaatctgtggtttagccgggcgcggtggctcaagcttgtaattccagcgctttgggaggccgaggcaggtggatcacctgaggtcagcagtttgagaccagcctggccaacatggtgaaaccctgtctctactaaaaatacaaaaattagctgggcatggtggcacacgcctgttatcgcagctaatcgggaggctgagacaggagaatggcttgaacacaggaggcagaggttgcagtgagctgagatagcaccattgcactccagcctgggcgacagagcaagactctgtctcaaaaaaaaaaaaaaaaaaaaagctgtggtctaatggacactgaatcctttgcattctttctctgggattagagagtttaataacaaaaacagtaacttgacagggctttcattctgtcagctcagagaa

SEQ ID NO: 71349 - DNA, 1051 bp, Homo sapiens
ggttttattagggaaagtgggatttttgaagaggtcactgccggaggaatatagaaagtcctcagtcctgaggtgggttgatttagattagcacacgtgattcccactctcttttgtaatgcttccatcaagctgtggcttgccactctgccatgacttttcaaggtgtggcttagtgcatttacttattctttagtccttcagaggatgaataatagcagtcttgctgaacataagttggctttgtggttttggctatgaggaatacttttttttcttgccacaactgcacaagctgccttgtctcaagagcacacaggttttcagccctctgtgtaatctaccacgttggcatgaataagcctttcctttgtggagtagccacactcgtgacgtagatagaactgagacattccctccctattgtgaaccatggagggctcatacacaccagtgtttctggatagatacacatacaacccccccgtcccctccctccccccgacacacttcatatcacaacaagcctgtaaatcctgccttaaacaagtaagagggggaggaatcggtaagaattatatgctcttgatctcttgacattctcttggctggaggatgcgaactagatggctcctgtcttcccaagttgctttctttctcccttccttccttgagtattgtgaaatactgtgaagcaactttggtgaattggaatgatagctgatttcaccctcacagaaactacctgggacaagaatgctgctctggccaggataggatgggtatggccaggtctctgttagctttttgggtcatgatctcttcttctctcccatgggctcctttgttgtagctgtgtggtactttcttatacacaactgtgtttctcccatttattttaggagctgtgtgtgggaatatttgggatcttgctttatttatgtctgtgaacaatttttcaactcattttgcagtttttcatgtagggttttatgaaagaatttagctctacagaaaatcatttgaaagactgtttttttttttttttttt

SEQ ID NO: 71350 - DNA, 1073 bp, Homo sapiens
attaagttgaaaatttattttttatttagatacttttatttctgttcaaaaaattgtcgttcagtggcagataagtacactacactgttataagtgttcttcatctggttttggagtggggatttgaactcaaggccagttgcatttggtctccacattgttttagcttattccttcaccaagagcaaggggcatttggaaacttgacattttactggtaggctttatggcagccaactgagaagacagccatagcttgttagctaaggtcagacactggagcaccatgatttgttttggagttacgagtttttatttccccttttatagactgagggataaatgtaagactttttttttccttcaaagaaatggaacaagccaattaagaagcacaaaatagacataatgaatggctaatcttcctctgaattcagacatttcctttcaactttcacatccacaaaggttctgtgagttcatctttgcttttacagaccatgagaaactgagtttcacttatcccatttgagggagacctgtgtgcagtgccccagctaactgatcttatgatttggtttttccttgcattcagtgacctacacttaatgaatgtgtccttgtatttcattctttaaccagcattatgggaactaggatagaataagttgctttacaaattgtcatgtttagatgaggtgttgctttttagaggagcatcgagggtctttcccaggctataatactgtctgtctagctttgctccttaaatatgagtttgttttagaggaggtgacattggtataagctaagccctgtgacagccattggaaataagatcaatacttgggtttctatagtcgataggttcatgagtactatgtgagatttttgtgtattaaagtgtgtgtatttagctcttagcgtcaatgtggcatagagggaagatcacaaatctgggaattgatgagctgtggagttcagtcctggctcagtcactgacttgtagtgggacgtggatgtgtctctttatccttccgctcctctgtttctctctctgtaacataagcagc

SEQ ID NO: 71351 - DNA, 1035 bp, Homo sapiens
tagtcaggcctctcctggcttctgctggggagagggcaggccagtaccctggttgtgcagccctgggatctgggtgtccagctgctcctaattcaggctttcagtcattttctctgtagtccctctcccacatccctgtctttggagacacacagtttctccttggagtgttctggggattcacagtgggccttgatgtcctttttgtgcgctcctcctgagactcagctgagtagaggacactcacacttcagtcagttacacgtgcatgacagctttccatcttcgaaagtttattgtcacatttgctctcttgtagcctcttttccagtcctcttgtcctttcatgtttttacctgcttttattttttgctttcattttattaggattttaggaaggagtggagataagtgctgtttgtgtttcttttgtaaattcttcatatcctttgtctaattttctgttgggttttaattgtatgaatttgtaagaacgttttatttatgaaggatgttaactctgacatggtgcaatccttttttcttctacattagcttacttttgaaacacttgcttgaagatgctggtagggattgcagcttctataacttgtacagatggttgcagatggttgtgtggggaagtggagcccaagaccagctggctgtacgttggcttttgtatagatgtgctttccttttgcttttcaccacctcatggaagctgtcttatctaactcacgcttgagaagtattcatattgattccaaaatgaaggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaagggtaagagactctggcaaaaataaattcgtctctctgcatttagcagtgggctcaggg

SEQ ID NO: 71352 - DNA, 1390 bp, Homo sapiens
cattctagaatagttgctgttgtattggaaaataggaggagagtgataaattacatcttaaaaagacaagtaaggtttgtatttcccatgttttgtagaggttaaaaactctgttgcattatctcccattgaaagtaagtttattttgaaacttgtaaatattcctttgatttgcttagtgaataacttactgctacatcgtcttcctctttattactgagatgatcttactgttgcaagcaagggaaagcctatgcagttttaagaacttgtacttgaaagacctaatgagcaagcagtttttccaaagttgaaccactctctgacaggacatttaaaatcatacctagtatttccttggaatttgtgcctattgtgttagttcaggattttttcatttactctttttttttcttttttgagaaaattagatccctttataaaatgctttagttttagggggacattttagtcatctaatttatgatttgatcagtttgggacaatatagctgataacagaactcctaagtttggtgatatgccatcttaatttaaaggttaaaactgaacagtttttaaagtggtaaaacactaataccatttgacaatgcagacagctctcttaagaagaggaagtttttgtgtttgggatagttcccaatttttcctttgtttgcagagaaattaaactgcagaaataccgtgctgaaatgggagaacataaaattctgtaaagagtccttgataagtggtgccggttcttttatatgaaaattctacttttagcccataatcagtagggacttgcttaggttttctccctggatagggaaaagctattactgggctcttaaataataattgccaacatttgttagacagtatgtactatgcttcagattctatgctgagtactttatagtttttttaaaaaaacagtttggagatataattcacatactagacaattcactcatttaaagtgtacagttcagcggtttatagtatatatatataatcaaataatctgcaaccatcaacacagtcaattttagaacattttcattaccttaaaagaaacacaccaggcatggtggctaatgcctataatccaagcagtttggaaggctgagatggaaatattccttaaagccagcaattagttagagaccagcctgggcaacatggttagacccccatctctaccaaaaaaaaaattagcctggtgtggtggcgtacgcttgtggtcccagctacttgggaggctgaggtgggaggattgctcgagctcaggagtttcaggctgcaatgagctatgattgaaccactacactgagtgcagagtgagactctgtctctaaaaaaataataaatagaccgagcacggt

SEQ ID NO: 71353 - DNA, 1050 bp, Homo sapiens
gagatggagtttcaccatgttggccaggctggtctcgaattcctgagttcgggcaatccacctgtctcagttgcctaaagtgctaggatttacaggtgtgagccgccctgcccggcctccatcttcttaaaaggaattttttactgttggcattgtcatttaaataactgagtttaggatatttgtctcctcatctgctgtcttacctgcctttttctattgaataacacatcggatctcttctacattaaagtacctgccatacaggtaacagtggcttggaggaaacatggtctttcctctaatgggacattttagagtcttgtggttgccactggctgagggagcattctctgcccactgaacgcttgagtaatcgacgccctggaatggtctcagcaaatgggctgagcaggattttgctactagtaggggttttcctgtatgtgttcctagcaggatgtgtttcctttcatatgaaccatagaagtacatctgctggaatctttaaacagatagcttttcaataaacaggaaaaatgtcaaaattgtcattttttatgagatggaagtagaatagagaaaatgtaacatttactcaggtgttttgagtgtattttatttggtgctgttgcaatataaataccctgtcttgtctgcattttttcctcctaacaccctacatgtttcctatgtagcttataagataagtttttttttttttttttgagacggagttttgctctgtcactcaagctggagtgcagtgacgcgatctcggttcactgcaacctctgcctcccgagttcaagcaattctcctaccttagcctcccgaatagctgggattacaggcatgtaccaccaagcccagctaatttttgtatttttagtagacatggggttttgccatgttggccagtctggtctcgaactcctgacctcaggcgatccacttgtcttggcctcccaaagtgctgggattacaggcgtgagccaccatgcccggcccttttctttcttttgtattttgtgttttgagacatggtct

SEQ ID NO: 71354 - DNA, 1028 bp, Homo sapiens
tctagtgttttatgcatgctctttcaggttgttcctcttttttttttttttttttgagactgactctcgctctgttgccaggctgcaggctggaggagtgcagtggcgcgatcttggctcactgcaacatctgcctcccgggttcaagcaattctcctgcctcagcctcccgagtagctgggactacagttgtgcgccaccacgccctgctaatttttgtatttttagtagagatggggtttcactatgttggccaggatggtttcaatcccttgacttcgtgatccgcccacctcggcctcccaaagtgctgggattataggtgtgagccactgtgcccggcccaggttgttcttttcttggacaactgagcacatagtcctctggctaagctaaggattttcagtgagaagtaagatttgcttccttggtcataacagataccctcttgtttgtctcagtacatttgaatgcctacagctggtttctgtattttgatttttccatttttactcatatttataaagtgtaggcaaagtgcagtttcacatttaaagtgttacacaaactggccaactggactgggggctgtcaaagcagcacccacaggacagagctctaagtgccattgttggctgatgtggagaaactgaattgtatatatgattcgggattgattgttggaaaagtatgacagttcatgggctgaaaagttggaactgctccgtactttgtagttcaaggtcactgcatctttctcagaagttctttatctttggaggagttatacgtcttcaggctgaaacgtgacgggcctggaattgatgagctttggaactctctccaggcctagctctgtgaggcccgagcctggaggcttcttggtagatcttatttgcattttctctttattcttagaaactttaaaaactaaatgatattgagttattgaattgaaacaaaatgcatttttactggtatgcctcattcttggcatcttacctgttacctggattaataatgatggg

SEQ ID NO: 71355 - DNA, 1963 bp, Homo sapiens
cttataatctgagcactagtaagcagtggttttaaagatttgtcttgtatttggaagaccgattattattgcaaaggtgcccttgcattgcatcttgccagaaaaattggcattagtaggccgtctgtatttgaaaacaccaagtttagacaggaacaacacaggcccagtactgaactattaatatatagattgtaacagacataatgaaaaccacttaggattagcaaaggttgattattgtttcacaatgtggttgttctgtctttgggaaaccaagacagactgcaagtctggtcacatggtggtttggtgtaagagactttcttgctccattgtggaactgggtgtgggtccccatgtctcaacaactgctgaggccttcattctggatgaacaaagctgtagatttttcatgagagaccatagtagacacacatgggaaaggaagtgttaggagagtgaagccgtcaggctgtattttctacttttgatatcataggggtgcatgacaaaattcacaagcatcccttccttatgacaaatgtttaatcaccattatttgcttacttcacaggaaagatacttaaattccttttcgtaatggtcaagcattctttcctagttaaagattctaattcctttcattcttaggaacttaaagaattgactgatttattaacataaaaactcaaatgtggctggagtggggactgaggaacacacgtgaaagtgcgctgtcatctctgttaagcagagggatttattaggaaactagtcactttggaagctagatggtgaattaattttgtggttagtagtatctttagcttaacaatgtcatcctagtttttcttggcaagcaagagagaggctggagccaatgagggctggccacagttctttgggggtgatatttaataagatgcacgttgtctgttttagaaatagagtaactgtcctttaggctctctcttctgtgggccactgttgctttacagtgctactgtaggaaaagataagttggaagtcttcttttttctccctaagactgctagtttgatctttttatgcattatgacagtgtcttgagtgcagtggactgaattacttttatcaagtagaacaaataacatatcataccttcaaaggatggttatgaactgtgtgtttctctgaaagtgaatgagcaagagcccagatgaaatttctgttttggaggcaggcagtgtgtacatttggtccccaactcaagactgggttgtgttccagagtctaactcagttatttggaactcagatctactagtagtaatttctatctattgtgttgattcagcattgtaagtggtgggtacgttcccagcctagactgaaggaatctgtttaattcacagcagtttttgaaattgtttatggtgatagtggaattctggatcttgggagctggtagtcatgtgaaagagaagtaaggactcatgccccatgccccaggagcctccctgtgcaggctgtgtggcgtccaggggtctcatgccactgcagccctccaggtctgtgctggccctccttgttcttcatcctccttcatctctctcttaatttgaagcttctacttccctggttaagctcactttctttaaatcatggtagcaaagcacatggttcaaattcatttccctgctagactaccgctgttattcagggttgggatgactacaggctttattcatgtcatttcactcatgttctttaacccttttagaggtgtacaatgttaatatttttaaagaggaggttccttactgataaacagattgtctctttgaaatgtttgcattcagtcattacagcaaggtttcaaggggaaagttgagcagaggcatgtgaagtcaggcagaccccacgtaaggaggctagtcctgatacctggaatcaggaagaaaccatgcctgctttagaaa

SEQ ID NO: 71356 - DNA, 1075 bp, Homo sapiens
atctgtctgaattggaaatgtctattcagacagtcttctctattcaggtctgtgtattcagtctctctgtctgtgtgtctgtctgtccattttaaggaaagttcctggcaaaagatggatttttttaggatttgaaggagattgcactgcagtgcttgagataactcttctggttacagtgtgataaagtgtaacatcctgtgtgggaaaagagcctctatagttttatggtatgttaaattaggcctgtcatttggatcttacattaataacaaaaatacagttcctcccgtttgctgcagtaatgagtaattaatataatgcaaaggtcagagtgagagagactataaatgggagtaggaaggcctatacattgtatgtggaaggcagttatattttttcccctttggtcaggcaatgatctacatttcttcttaaaaatttatgaataatggattatatttggcaccagtatctcaccatcttttaaaggatatattattttgggagatttgggagattattgctcaggtacagaggtcctcattcttgactgccttgtgatgatcatctgtggacctatatgaatccagctgcctgggtgtgagttccctggtgactctgaatcacagccagaacaggaagcactgtgggctggtctattcctcattttacagatgaggagactttggtggcaggagcttgacagatttacccaagatcaggaacttaactgccccttcctttgtgtggtatgaattaatttttatagttagttgtgtgaatttatagtatagtgtggattttttatttaacaatgtgaacctgacatggctttccctttgtagtctttgacccagtgcagcagttccatttgcttagcctttcgtcatgctcttttgccagatctgcaaaccaagcctattcacggagttttcttcagttaatcaccacagttggtagcatgtacctatgttgttgttgttgttgctttttcccacatattcaggttgtgcatgtattaaactgtgaagtttggtccaggtttttaggaggatttttagatgcattttta

SEQ ID NO: 71357 - DNA, 1076 bp, Homo sapiens
ttcctccatgaaaacttcctcatctcacaggcagacatttgtccctgccctcatgtattgtacattcatcaggactgtttgctacaaagaactggacctgaatttgagctaatagtctgaaaggtgcctttccatacaaggcagaatgcaatagagcaattcacatggaaggcagactgagattctcttgttcatggcttggtcattagtgcctactggatattcgctgaatgaatgattgtttattgaagttaactggaaagatcctgaggtcagtgggtttctctgattatcatgaatgtctttattgcctatgttaaaataacatgaatggggtaactcccttttgcccttctggcatccaagtccagctcttaccaaaaagtgctcaaatgtaaaactgagtgtttaaaacatttccccaatggcagaacattctcgtccaggttctttcccccgatgaacagtaatgactggcgcacagtctcctcagtagggtagatggccagcgaacacgatttagtcacaccaaatgcatacaggccgaccctgatagtatttggtcagttagtactggaactacccctgtcacactcatgagaatggttgtaaattggattttaagggtgtgtactttcttttcattctttttttttttttttaatgttttgtagagatggggtctcactatgttgtataggctggtcttgaactcctgggctcaagcaagtctcctaccttagcctccgaaagtgctaggattataggcgtgatgcaccatgcccagcctcttcattcttttgttcatgctctcctctcttggggtgtctgactcaaattagtattctttagttatattttgtgttcttatgttcattttttttttttttgagacagagtctcactctgtcgcccaggctagagtgctggagtgcagtggcacgatctcagctcactgcaagctctgcctcccaggttcacgccgttctcccgcctcagcctcccaagtagctgggactacaggcgcccgccactacacccggctaattttttggtattttttagtagagatggga

SEQ ID NO: 71358 - DNA, 1010 bp, Homo sapiens
cattgtccttatctggcagaacgttctcctgacaccagggcctgctggaatagacagaaacatgattaagtataagcagttgctttgtaccgtctgttcagttgtgaaggcaaatagatacctgtttaatattaattcactttctgcattccctgtaaaactgaagaaatgtgcaaaatctattttggacttggttctatacatttcagatgatttaaggaaactagtatttttggtttggaggtatgtttcacagtcataatgtttggctatgaagcataatagtaaacattggatctgagaaatcgcataaataagtagggaaaaaagtgaaataaaactgagaattgtgttgtaccttaggtcttgaagtgcagtgtttcgtggtggaggttagtcgtgtgtactgaggattggacaaagatttggtataaacgtcaggagcacacatttttgacaaatatagaacctatcttgtccatatttattttgattacttgtggaaggtacattaaagcctgatgaattttaatagatacataccgatgaaacataactgcacacaatattgactttttcatgatcctttgttactttgcctgcagattgtgctaatcagcatttatacttatttatatatagtttaggattagattcggtgtcagtgaatagcatttttttaaacaccgttggattttttgataaaagttttatgtttaacttatctgtcacttctgggatccactccaaccatgaggaagagagtcactctaacgactatgagatggaatgttcaaaaggatgaatatcaattcttagttatataagtgggtatgtcgacgagtctcttctttatgatggcaaaattttaatttctcatattttgatttgtcacaaactggtactttagaaacatattattaattggtctgttttacctttgacctcttttccaggggtggggcaataataaatttgagagctacttgcattttcaaggtacaaatcca

SEQ ID NO: 71359 - DNA, 1130 bp, Homo sapiens
agatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtggga

SEQ ID NO: 71360 - DNA, 1233 bp, Homo sapiens
ttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaa

SEQ ID NO: 71361 - DNA, 2099 bp, Homo sapiens
gaaatgagagcctcccctccaggcctggcccccagtccggcctcgcacccctttccctgcccaccctcatgtttttggtctttggctcatgactgcaccgtctcaccatgctcttgtccccttccttgcaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccag

SEQ ID NO: 71362 - DNA, 1014 bp, Homo sapiens
gagaggatgaatggctctgtcacactgtgctcttacatttacctctctctttttaaccctcgcaagcctgtgatactggtattactttaaggtccttgagggtgacttagttaccttatttcaccgtaaactttttttttatgccttacattttaaaaatgtattacagggcttggtgcagtggctcatgccagtaatcccaacactttgggaggctgaggtaggaggatcgcttgagaccaggagtacaagaccagcttgggcaacatagcaagaccctgtcactacaaaaaaaataatttaaaaattagccagggatggtgtcacatgcctgtagccccacttgggagggtgaagtgggaggactgcttgagcccaggagtttgaggctgctgtgaaccgtgatcacaccactgcactgcctggaccacagagtgagaccctcatctcaaaaaaaaaaaaaaaagggattataaaaacaatgtcatcatagtagaagaaattgtttaaaaactgacctaaacctaaacaaatactttctagttttccaggatcttcccaaatgcattgcagtgcgttatgtgtgtgtatagttgtattatcgtgtatagatctgtacatactccactttgattcccttcatttccctacaatataggtaggagagcgttgttattcttatttgacagagaaatgagagatggagtgtaactgacgtgacaatgaggcatcactaaacacagatacacagattgaagtctagacgcccccgcgttccttccccgttgtcatcagaggcagaaagtcacatcaggcttcctgtgcgagcctggacaacttaggagccagtgctgtttctcatccttgtgtttcttgggaacaaatgaacagagagaggctttacctgaatgagccatggatcgtccctggcgccctgaccttgggcagcccctcactggctcaccgcatactcttcccagcacccccaggcaccatcctcctcccctcaccttc

SEQ ID NO: 71363 - DNA, 1213 bp, Homo sapiens
aaatctaaagaagaaaaaagcattcccgatctcgcaaatccagaggtagtccctgttaacattttggcatatttattttcccatcttctgtttttttgggtttttaaaatgcatatatagcttctttgaaaacgcacaaagaaagaaaggatcatactgtttatgtttatatagtcctgtatcctcctctcttaaaattttttttccttacatggtatttgcctgtgtcattaaatattctgcaaaatttatttgttttaaagactccatcatgaagatccagcctcatttattttactcattttttccctttggacgtttgggtggtttccactggtttattacaaataattataaatatcctcctacctaaatcactgtgtgagttctgattatttcctcaggatagctttttgtaagtggaattactgggtcagagggtgggaactttttcagtattgccaaaatacttcccagaaggtagaacgattcctgctttaattagtggcttgtgaacgtgcccttccctgggtgggaggtcgcaggtcattgcctctgcttacaggacccccccccactggactcttaggaaaggaagtggggagacggagagcaggttttcctggacttgctgtttccctaaggccaaggggccagtgagggccgggacccttccctccctccgtccctccctcccttcctctcatgctctgagtactcactcaggaatctccttgaatatcagccgctggttctctctgttctctgaggccaatggggccatgaaataagacctcaccgccagagctagggcaaaccatgcatcccctgagcagctctgaggctgacatgtgacactcacaggagcttgtgtgatctgtctcccagggctctgaatggaatgcatccaatctggaggaactgcagggctcagggtgagtctcctccccttgtctttccctgtccttccaggcagcttagaaaccctccactctgccatggagggggagaccttggggctgcctgcctgtaattgcctgcaccctggtctctgaagtggctgccaggggttgatgtgcatagctaaacagatgtgcttccaaacaccacgccctgaataattcatggagtttagattgtgccgaagtctcgcgtgatcgtgtggattgaggaaaacttaaaattacactctaattgctgtaggaccgcctgg

SEQ ID NO: 71364 - DNA, 1231 bp, Homo sapiens
ggagaatgctggtcgcccctcccctcggggtcaggaccctgctcccacagtgtggtgttcctccaggacactgcattttgggaagactatggataaaccacagtgtgttcagagggcagagacctgagggatgggaagccacattaggagagggccttgaaatcacggaggaagggtagttgcctttgaatatttgaagattcctcatggggaagaaggattatcctggtctgtgtgtcccctagagttaaaaccagagcagggaaatacccagattttgattctgaggaaaaaggggataatgggatctgctgcagctgggccgggctgcctcagacagtgaggtcctcatgcccacacgtgttcgagcagagactcaagggcccaggggcctggggatgttgcgctgggcatcccagcatcctgccctaagagcgtctgagcaaggagtttccacactgtcctctccccgcttgacctgctccctgctctgttgactcccgtgggagttctagagctgcagcgggttttctgtgcacctctccctgctgcctgagaacatgcacaccaagaagcgtgctctccttgccaagccgtgttctgtttagacccaggagcatctggcattcctgtaacctccgaccacaagctttctacagctccttgctctcctaaacgtcatttctttccaggcccactgaaggggaaaggaccgagcgcctcatcaaagccaagctccgaagcatcatgatgagccaggatctagaaaatgtgacttccaaagaggtaagacaactcctcccttcattgcaggtcagaggtcatgcagcctccatgtgtcctgctcccgaaagtgcagcaaaagcaggcccaacatctggttgtctttacctgtcctctggtatcagcccccggaggcttttttctgcctcgttctacaattgtatcaggcctcggagtcagactccagtttgagtccagatctgccgcttatcggctatgagacattgagtgaatttcttgacctttgtgagcctcacctatatggcctttggggagaagtccatgagatccacagactgcaccgagaagcattgatctgttttaataacacccccttgttctctcttctgctccctattaccttgggttttatggaagagacagcagacttatttctccacaggatgacagcttgacctgcaagtatcaaattctagaataatttctc

SEQ ID NO: 71365 - DNA, 1106 bp, Homo sapiens
cagccgggcatggtggctcacgcctataatcccagtactttgggaggccgaggcgggcagatcacttgaggctaggaattcaagaccagcctgtccaacattgtgaaaccctgtctctcctaaaaatagaaaaattagctgggcgtggtggtgggcgcctgtggtcccagctgctcgggaggctgatgcaggagaattgcttgaacccaggaggcggagattgcattgggccgagaacgtgccactgcactctagcctgggagtgacagagcgagactctgtcccaaaaagaaataatcaaccaatcaatcattgcccttcccttcccgtatttgaacccctttgtcagaggagaaaaccctgcatctcttgtgccttcccaggcctgaccctgtcttctcctcgccccaggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagtaagtgaggtgcctctggtgtgagcgcacccaagcccacaggcacctgcctctcccccacctgccctgtgcccgaccctgaacctgcattgggccacacctcccctggagtcccttgagtgagaaccctagctttctcagaaccagcgtttaaagcaggggtctgtgacacaggcccctgtcccatgcaaaaaaaagaaaaaaaaaaaaaaaattactgatgaatttggtgaatgcatttctggggacggggtccgtaactcccatcagactctcaaaggaatgtgtggccctttgtgtccccaactccttccagagctctgtggtctggccttttctcttcagattaccagagacttaattctcagagcctcccgctctgctctgaggagagttaggaatgtgtcctctgcttccttggatccaaaaacacaactggtgagggcagcctgccttagcagcagccatggtgaaccacatgacctgtgtcgtgtgaccta

SEQ ID NO: 71366 - DNA, 1552 bp, Homo sapiens
ttctgcctgtcggatttgggctccatagggaccctttccttgcctcctcctggggctgacacagccacgtggtccctagagctctgtgaggcccaaaataaattttatttttcagtgctataagagaaatactagttagtccctccagagtgggtaggatggcacggagggacctgagaatttgcccaacccaaaagcctgagtgtcattggccggaagggcttggaacaaccttccccacagatatagaagcatggggttgagaagagtcctgcatggggcagggcgctacctgggaggggagctgggtctgtgatccccagaggccccattcacacgggcacacataaaacatgaccgtggtgttggcagcagcagagatggaagcatgagattcctgaggtccacagagctggctcttggcacggttacagcggcttctcacaagtcgacttttaaatgcctgaagaattttcatcataatctgaggactctccgataagccctttctttccctctgtttttcagtggcgccagtctctgcagtcattcggtctcatttcactggtaggatgggcaaaacaaaaccagattaagcgagattgtaaaaccgcagccacactaaaggcgcaggtgcacaggtctgaaagtgagctccgggaacggtgtgagcacgctccccctgccgccacccaggacaggccaggccgggcttggctgccggtgcttgcctatgtacccccaagtacacatgtggcctccgccagcagagcaccagccctgggcagctgcctccctgctgtagagtgggcgtgcggtcagcccacactgcacccaaaagcctcagctgagcacttacggagttgtgtccacagggccatcccagacctgtgtcttctagaattcatcagtgaacggttcctatgcagacagcctactcccacacgtacgtccaacagcccgtcctggaccaggtggtgagctggaaaggctgtacacgtaggtgggtagacgctgactccacatgtcttctctcccccatcgcagtaaaagctgcaccattgggatggttctccgactgtggagcgacacgaaaatccaccttgatggagatgggtaaggaggtctctttaaaagattctctcactgtatgtagtaggcattgaaaacacgagctggttcaggcatccttggatgatcattagcactgaatgacacgtgtggcgggagtgtcacagcgggagaaatcatattgccctcgagtgagagggcacgagggagggtatgttttggacgtctgattggggagtttagctcatgaagtatcagtgggagtgattacaggagatatgctgctgtgtgaagttcaagacagcggtaaaccgatacccatccgccacctcgatgggttaagtgaactctcaccgcatgccctccatggggcttgtcctgaaagttcacggactaatgtggtgcagcaggaactcaccagctttgggggtacaaggagagacatacaactgacaggcacaacaaggtttcaagcgccacc

SEQ ID NO: 71367 - DNA, 1089 bp, Homo sapiens
ccaagatgcgtgtgaaatgagggtggagtcactcccctgacatcacaagataaatgaatgcctgtgagatcattgcaaaacctggatttgttaaaactagattagattccctttattcatcattcattcatcgactcattcattaagcatatgatttatttgcattctcctgtgtatgaggcaatgggctaggcccaggtaaacaaagaagcaacagtacacacagttcttggcctcagagagcttctaagtgagcatggaagacagtcacaaccagataggagggagagagtgaccgagaggtgctggggttttgtgagaccacaggagggggtgactgttgagagcacctggcaggacctttctggcaggagtgaagcctaagccgactcttaacgggcaagtgggcagtcaggcgagctctagggtggaggcggagcagcaaggtgcatttgaggagcatttgaggcagaatcaacagcagaaaccagtcagggaggccgtgagtgtcacggtaacagtatggtcttgtcttgttcccatgagagcttctgtaagtcacatgctagcgactgagactttgatgcttgttagaaggagatgaataaaaaagggaggacatttcttttatgacatggcccccacccccgcagtacataataaatagcactatgagaaagtttcctgtgacacatgtagaagatggagttggggctggcctctgtggccttggggtggttgggaacctggggctagaagaacctgtagcataggaggtgttcggatgtgagctctgaagagccacttggagactggagggcatggtccattaggatggggtgccaccaggcaggtgctctcagaaatgcccagagccccatctatttggccattatctgtacggttctgaggcatagcggtgtttagtgtttgaccgtcttgcggttgtaattgttcttccagtgactgtctagcttttctgaatctttctgaggcagggacttccctcgcaagtgtggcctgttccaataatgctttctgatcccgaacggaaatcggcctcccatggcctgtgcccaatgtcttgat

SEQ ID NO: 71368 - DNA, 1024 bp, Homo sapiens
accatgtctctactaataatacaataattagctggccatggtggcacatgcctgtaatctcagcttctggggaggctgagacatgagaatcgcttgaacccaggaggcagaggttgcagtgagttgagatcacaccactgtactccagcctggatgacagagtgaaactgcgtctcaaaaaaaaaagaaagaagaaaatgttatatgacagtgagatccctgtccagtattctgcagaaaggggccctggagagcctatgtagaactttgggtgttgtcacagaagcattattttgtcacgaaaattctccagcagcaagcttttagcaaaagcaaggtttgagaaaagtactacgtggaattattataaaagcagtttcatcctatttgcattttacatgccatttgtccacgctaaagctttttcccctgcagtaattctttgtccattttcctgtctgaattccggtctaactgtgctctggtcttatccttcccagcttaagtgagagctttttcatggtgaaaggcgcagccctcttcttacaacagggaagcagccctcaaggccagcggagtcttcagcacccccacaagcatgcaggtgagggctctaagttgatactcttacattggagcttcttttctggacagcagaggaaacttccattgttggtgatgttgctgagtttgaaggccttagacatagtggacgcaggtttgcagtgaccagtgcaggcagaggctcagatgctctctcttgagcagaccacgcacattttccaaccttttatgtcatgtctgtctgcgtcaggagtaaggtcagcagcatcctgctgggatgcaaagatttcctctctgtagtttatcagttaattgcaggctgtaagttacagcctgactttttaacaaatgcaccaaaatgaattatagccagatgtcgtccacttgaaaataaccatctggagtgctgtatacctaatcttgggatggatttctccaagcatttgaaaaacactcattt

SEQ ID NO: 71369 - DNA, 1086 bp, Homo sapiens
tctttgccaaaaattaagttctgcctttgtttgggtgttttgttgatttatggaagattcagccctttgttatattaatatcatgtattccttcataccaaggagccagtcttaaactctgacctcatagttttaaaaaaagtaaataaattttcaggaatattgttctttaaaaaaaaatagtctgttttatctcatgaggggaaggaaaattaattggaaaaggaaatatgtgttcagaaattggggtcaaccattcattaccgacagcagggtgttctggtcaaactcatatgcagaactggtagaaatatgctcagcttttctccgatgtttctgtgtgcttgagtgaagggaggggaaatactcacttttattacggcacacatgatttctaaagattatgtgggtagggaaacactagcctgcaagaatcaaagagattccttatttctgggtcctcgctgggggacttctgctgggtcctcacttttaatgttatgctcaagatacaggacacatttgctccatcaccctggggtttttgattggtcaggtcagggcccacgtcagggttcccaggctagaagcagctggattcccaatgggggcagtcatgggccgagttgcagatcagactgtctgggtggaagcagggaggggtggagtggaagtctggagactgactgtcgaggaggaactgaaagaggggcttgcccacctcacagcggctcctgtgggcgcccagctcccttccccccaaatctcccccagatgcctgcccccaactgccctccccaccagctcctctctccacctgttctcctccccaaaatccccttccccagatccctccctccaggttcccctcccccgactccccatctctcttccccactcccctcccccagatcccctccccaagcttccctcccccaaatcccctccctagatcccatccctaaccatccctccccaatcccctctcccatctcccctccctgaagtcccctctctgagctccccttcccccagctcccctccctaaatcccctccccaagttcccctccctcagctcccttgcc

SEQ ID NO: 71370 - DNA, 1013 bp, Homo sapiens
cactgtgcaagtcttgcctgggttggttttttgaaaatggtgttcatcactcagctgttattgcctggctctgcggaggaagtggattctctttaaacatgaccccctccccttaaaagagaaaaacaggataaggtccagaacaacctcggaaagttgagggctgagggctaaaagaccgtgctgggtaacaacaccagataggaaatgttgagctaacaggactccatcccctggactgcggcaggaatgtgggtcaacatttggaaacctgaaaattcccccacggaaatgactccaagggacagaccgggattggtgaggaaagggcacggctgtttagaagtagctaggtttcctggatatctttatctttttccagtaccggggtagaaaatgtgagactgccgcccgaggcgtgttgacagtggtgcctgtggtgtgatattctctttctttctctgtagttggaggctggcagcgaagaagatcgaaaattaaacctcaggtaagcagactttcaattcttgttcctaagtctttctcccaagcaggtaaggaatgctcttgttcctctcccaaagggaaaacgttcaaaaagaatatgccaattttgggctgggtgcggtgggtcacgcctgtaattccagcactttgggaggctgaggcgggtggatcacaaggtcaggagatcgagaccatcctggccaacatggtgaaaccctgtctctactaaaaaaacagaaaaaattaaccgggcgtggtagtgtgtgcttgtagtcccagctacttggggggctgaggcgggggaatcgcttgaacccgggaggcagagtgagccaagattgcgccactgcactccagcctggcgacagagcaaaactccgtcttaaaaaaaaaaaaaaaagaatatgccaattttttagtgctttagaaattatacctaaaacacataaaactgaagtgctttaaaatccatacatatgtctagccactttaataatattatataa

SEQ ID NO: 71371 - DNA, 1121 bp, Homo sapiens
aattctcctgtctcagcctcccgagtagctgggattacaggtgcccacctgtactttttagtagagacagggtttcaccatgttggccaggctggtctcgaactcctgacctcaagtgatccacccgcctcggcctcccacagtgctgagattacaggtgggagccactgcacccggcctgaatgatgactcttgaggggaaaaagtttactcaggtttgcaggtacaaaatccaaaatccagggctttgggttttgtgcatgggtagacagctgaatgggcagagaaaccagaaggatgctacacccaccatctcatcccatggggatcaggggaccaggattccctgatgcgaagctgctcctctgtccagggacgtcttgatcattacacaaaggcagcccctggagttccattcatggagcctgccgtggagtggagaggggtgggaggactcaggtgtgtgaaatgtatatgttttcaaaggaagcagtgggaggccagttggttttgagttggtctccgcaggcaacatcacttctgggatttggtttactggagccttttttcccatggtgaaggcaggggacatagacaaggagggaggaagctggcagatcccatcaaaggccagagcagacagacctactgcttgaagtaaacattgcaaggaagccaatttgtgcgttcaactcttattaaaacatgtcagtgatggacattgcaagagcctaagtttattcattgtcatcatgtcctagtgacagtccagcctaacggtctgactacctttgttcatcggaattcatctcaatgctttagtgtgataatctcctttccaatgagtggggaaagacataccgttggcagccaacattgtggctgagcttgttggagacaacactttcttctaatggtgtgcaggtcatgatgggggacttcttccagctcaagttctaaatcaactgcaaacaatactgtgtctctaaaatgtgggctgcagccccctccgcccaggcagttgaagaggagatggcttggcagatctctgtctctctctgacaaccacatttccttgaaccacgtgtggctgtagctctaattatttctggacagctgag

SEQ ID NO: 71372 - DNA, 1049 bp, Homo sapiens
agatgtcatctctaaagaaggaaaggaaaggaaggaagggagggagggaagtggggggagggaatggagggagggaggaaagaaggaaagaaggaaggaaggaagggagagagggaaaaagtgtataatacacttagaatatggtatggagcggtcactatctagttcaaaagctattaggtctatcttatctttaagaaggaagtgaaggtgcctggcaggcgctcggactccctctgatgatccttgggcctcctcgacctgtaaatactgtccttcggttgaacgtgttagagaataccacaggccacatttggcccacgagcaccaggctttctaggctacaagttgcaaactggtaacccataggccaaatatggcccccgatgtgttttatttatcctgcacaatgttttataggattttgaatcagttgcctccatttcaaaaatgacatcttgcataaaaataaagttatgtgttttttggaaaatcaggtaatctggaggcctggaacccacattttgtcatggtatcttttggctagagttgaacagaggctgacacgacagggaaagttccctgtaattccaccaggcccccatccttgctgtgttacatgtgcattgtgcatttatgttttctgtcagaggtcacagggagccatcaaaggctctagaggaagggagtggctcattcaaggttggaagttctggctccaactttggcaccacttacggatcttcagcaaattgctcaactacttgggcccttgctatgctaatttgtaaagtagacatgaaaataacaacctttgttcacagggctgctgtgaggacccagtgtaatgttgtgacagtggttaatgaaatgcaaatgaaagttccatgaagtcagagactctggctgtcatgttccttacggtagcccagggcctagcaaacagcaggtgttcaatatatgcatattttatgcatgaatggatgaataatatatatcagtatctttaatgctggctacacagcatgtgttcaacatgtgtttattga

SEQ ID NO: 71373 - DNA, 1035 bp, Homo sapiens
tagccactagctacatgtggctatttaaatttaaacttaaatgaatttaaagtatgcattttgtacatgaaataatttatatagtataataaagaatataaaatgtatatataatatacaatagaaaatatgtggccaggtgcagtgggtcatgcctataatcccagcactttgggagaccgaggtgggtggatcatttgaggtcagcagttcgagacaagcctgaccaacatggtgaaacactgtctctactaaaaatacaaaaaaaattagtcaggcatggtggcacatcccagctacttgggaggctgaggcaggagaatctcttgaacctgggaggcagaggttgcggtgagcaaagattgtgccactgcactccagcctgggcaacacagtgagactctgtctcaaaaaaaatgtgtgtgtatatatataatgtaaaattttaaaaaaatctgtccctcagtcatactaaccacatttcaaatactcaatagctacatgtggctagtggctactatattggacagcatacgtgtaggccagcagtccccaacttttttggctccagggactggtttcttggaagacaatttttccatggatgggggtggttaggtagggggatggggttggggtttcaggataaaaccattccacctcagatcttcaggcattagattctcataaggagcctgcaacttagaccccttgtgtgtcagttcacaatagggttcacgctcctatgagaatctaatgccgctgctgattgacaggaggtggagcttgggcggtaatgctcactcacccaaggctcactgtgcagcccggttcctaacaggccagagaccgttacgggtccttggcccagggattggggacccctggtctaggacatttccataattgcagaaagttctattggacagcactggtttggtaggagggaggacactgaacacatcattgcaaataattatgagaattgtcttaagtgctatcaagaactactgcaagcctggggaatatattgag

SEQ ID NO: 71374 - DNA, 1110 bp, Homo sapiens
gtagagacagggtttccacatgttgcccaggctgatctcaaactctggggttcaaaggatcctcctgccttgacttcccaaagtgctgggattacagggatgagccaccgtgcccagctgacttagattttaaatcctaatgtctaaacatcctgattttcaagatgtaatcctatgactatatgttactttaacttgcaattaggtatttggtgggttattttgacaaaatgttattctgtctatatctgtatatttgccttttgtgtttgtgtgagggaagacagtaaacttgttttcttttttagatataaagtcatgaagaactggggagttataggtggaattgctgctgctcttgcagcaggaatatatgttatttggggtcccattacagaaagaaagaagcgtagaaaaggtaagaatgagaacactgcatcatggtctgtagacttgacccagatccctgttatctgaaaacagtacaaagaaggtggggaggttggtcatatttgttctctgtatctttaaaattaggatttcaggttttcaaacagtacttttaccgttagtcattattttataccatgtagtaaaaagatttctatttcagcccctctccagactggagttggaggcatgctttgtaatgaaaaatgtcaagcggcataattgtctaagaagtgttctcattagtacggcaattgtagttttcagtggtacagactgaccaattacatcatacatttgtgttctctcagactagcttgctagtaactggtaaaaatttcaagttagtgccttcattactaaaaaattattttctttttttttttaatgctcccttttgaaagtgtggctctatgtaacattgattaaaattcagcaaagaaagaaagaagaatgtggtgaaatttgatcattgttaaatctggggacagttataattgaggtttattttacattctccctcctttttttgtgtctttgagaactttgataataaaaagtttttttaaaagattgctagcagaagagagaagtatattagatttcattgatctctgcagaaagactgatcagaattggtatagtggtgtctttcccagt

SEQ ID NO: 71375 - DNA, 1371 bp, Homo sapiens
cccttttccacaactacagctttgctgccttttttggaacttggccaccctcctccccgccagaccgctgttaccaacagcaagtctgaagcagaggccaagagaatgaagttctagagatgaaaaaatctagcccccagtgacatacaggtgcatcctccacagccacacttccaagatggccttgtccagcttcgtgtaggcgttgtctgccgccactatccagagaaatgggaggcggcatcttggacctcccaaaactgtggggccgacgtgaggggcatcgagagacttttggaaagggagctggggaggctttctagcaccccttatttttaaaggtgttctcttgtttttgctttattctgaagccacaggtcactttttagacatggtggtggtatctatactttcttaaaatgtatctcagttaatccaattgtatgttgcaacgtttttctatttagaaaatacttttaaaatcctcctctggtaactggaattatttatctacattttacatttccctaaactgagagaataacttggagatttagtcaccaaggacatcagataacttttttaaggtccgacttctccatcaaggactcacttaggtcccagtcactccttggaagtatttccaacatcttcagcccacagcagtcactgagcccacatcgtgctgtagtctgcaggaaaaagaggtgaacacgtctgtccggtggcctttttctctttgaaggtacccagagcgtctagcatgggccttgcccacatctttattatcagcgatccagtcaatcaggagcagattttccctgattgtcaacccattttctttgtctaaagctagagcttcagaggatgcattgggccaaaggcttgctttgtgcaaattacctgattttattatcacaataaccatgtaaggaattactgttgtccccattttacagatggaaaaacactgaggctcagagaagtggaatgatttgcccagaatcatgcagctatttaaggggcagagccaggatttaagacagtctagtgctacagtgcacattcaagctccccctcctctgcagtgctgtccctttccttaaggcctagttgttacatggctgacccacggtttaggttatagatccacctccatcctttctcggatctgcttcaagcctgggcccagatgcctggtgtgtgagggctccttgagcctcccaggaagtgctgattctcctccaggttccctgcttcctgttcatctgtacagggctgcacctctggtgtgccgttggctaatagctaggctgccacacctcccctggattgtgagtccctcaggggctagagccttgccttatttat

SEQ ID NO: 71376 - DNA, 1688 bp, Homo sapiens
gatacatggttggttgaaccctctcttaactttcatatggtggcatgattatgggagagaggaaaatgaatcgtttttcttttgctccagaaattttggctttttgaatacacacgcacgcatgcgcgcacacacacacacacacacacacacacacacacacacacagacattaacctcagattgaaagatacctaaaacagcgtggaagtccacaagttcgtgcagttacatcctcatgctctagaatctgtccgtagtagcagtctagggtgctttgagccccatgtttgtccaggaaacatccagttgtgactataaaactttattgcctgcatacatcaaaataaagctctggtcttcacactgccatctgctaacagtttcagtatagctgtcctttgaattgtagtaattttcttcttctcatgctgtagggtcacccattgaccctggaccactgccttcaccacttcatctcatcagaatcagtgcgggatgttgtgtgtgacaactgtacaaaggtatgcattgaaccccaaatgtcatcgccagctggcctgtgtgtgctgatgtagcgcctctcacaccagtgaccctgagctcttctgactgtatccagtgggtcttttcagccacttctacttctccctaatttggtttggacattggcagctcatggaccaaatctctttcccagatgagttttgtttcatgcacagtgtttaaagaataaactgtcacgctgagatgagaaatgccctctccagtttgctgcagttgcctccaatcccatttgttttacacccttccttttaacctgtgctacctgcctgactcccctaagtaacttgagttttcccctctgactcaagaggaactgtatggaacagaatttttgaagacagagaacaattaatagatgacatgccagtgtcagagcatcagtgttcgctcttcacattctcttccctccactgtttctgttatttaatgactaagagggatcagggaaaacaattcacaaataactgggcagctgggttcatttcagcaggtagcagtcaagtgccaattgtgtgccgctataacaccactgtggtctgcagcactccaaagctgtcctattttaggcattgctgcagagaaatgttccttttatttcagattgaagccaagggaacgttgaacggggaaaaggtggaacaccagaggaccacttttgttaaacagttaaaactagggaaggtgagcccacactacacaccctgttggctttgttttgaggactccgtgtatcctgcccctgaaacaactcggttctcccgatttctcttccacccgcagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccaggtgtgtgcgcgcgaggagccgatgcagcaggaattttcagcacagagaaaagcagtttggcatcaccaccttctgggtcccttatgacaggagcacaaggcttgtacaatggtgcttaaac

SEQ ID NO: 71377 - DNA, 1088 bp, Homo sapiens
ttcagagacttacctgaaaagggaagaaagtgctcaatatatactttttgtattaggctattggaaatgaataaattcagaatatggacctagagcaacatgacaatactagatgccagctgtagttatatgttttttaaaaagtcaaaagctgctttctccttttcgtgaaaagggctgaactttggtggtcatcaaatctaacccttcacttcacaaatgaggaaactgaggttcagagagactgcagccccatagtcagcccttccttcctaagccaggtgtcaactcagggcagggattatttttttatacagccccaagctcccacctgtaaaccttaagagctctgcatgggcaataaataaacagatgaaagtaaccgtccacagtggatccttgtgtaagaaaaagttttccacagagcagaggaatcaggtgttgcaaagatccagctcagttctggctattcacagagttttataatacagtgtaattacatctcagtccaatatacaaaagataaaagcaacaagtaagctcttcacttataactgacaaagtagtgaaagagtttccccagggggcagatttggcagatgagcctttactccatagaaagaattgaaagattagaaaaggcatagaaaaaggaaggtgttctttaggcatcatttacctgttctcttgctatcctttgagtagcctggaaggaatatttcacaatggacgtgctacaaaagcaatcgaaagtgaaaggcactttttcttctaaattgttgcctttaataatttcattaattcttgtcaacaatttttatgggcctgcttattaaaaataaaagatctaagtggaaacgttgattagacaaaggtacctcccctctgagaacacctaacattacaatatgaaaacggtggcttcaagaatctgagttcttttaattacctgtatcagatgagtaaaaagacactccggacataatgaatgctttcttaacacaacagaaccacctacacacatgaacaggactgttcagggagcctggtttggtgtgaactggggctggctcccaggtggagcctgc

SEQ ID NO: 71378 - DNA, 1055 bp, Homo sapiens
cccttccggctttaacatcttctgtttcctttctaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtaagcagaggggtgtgtgtgtgtgtgtgtgtgcattgagggcttgtttggtgcaattaatgatcgtatgtttggagaaatctgaactcaggatccattatttactgatgggttcactaatggattcatccaatattctctgagcacctctgggctaagccccttaggtgcttgggacataaacttgaaagaaactggattgcctgtctactaggagctgacagatgactcgagtgaatctctccttggctactgatgagtatcttctgggaaagtttacaaaacaaagtaaaaaaacgtgctgggttctactgcagagcacttcaatcagaatcgctccgagtgcaggctgaccacttgtttgtttaaaaagcttccaggtgattctcatgggcagtcagggtttgagaatcactggtctcataggagagatggcaaataaccaggtaatttctccacaccagtggttctcagcatcacctggtggacttgctgttggcaggacttggattgctggaccctacccctgtggtttagtttagtttctaaggagagtccaggtgctgctggtctggggagcacatgttg

SEQ ID NO: 71379 - DNA, 1090 bp, Homo sapiens
tgtttccgtaggcttaggttgtacccccttcaacctcctttactcacaaagggggtaaaagaaagccatgatgtttcactctgcagctttatattggttaaagttgttaacgacccgcgagatgatatcatggattcatttaagtcacatagtctattgtccaggaaaggctggcgtagtaaaatcaccaaccatcctgaatgaaacctggcttgagctttaaaaagccgagaggagtggcactgtcaggacccagcccagagaaagaggcaaggaattgacctgattgaaccacttaggtgggggggcaggcactgtttttgtttgttgttttttaaaagaatttggacataacatgacaaagaactaatgatgttccaaataacttgcactagaagctttcttattgaattcttatggtttccaatgagaatctgattttaagtctagtttatctttaaatcagctaatgggatttgttgcagaagaaagaaagcattacactgtttatccacccccacaccaagtcttcacctggacccagatgtgtgacataaaagatgtaagtacaacttgttgataatttttattggggagaaggagtcaaatagtatttttaaattagggacactggagttaagccacagtccatcattcagtagtaaataaaacactgaaatcccgaggtttggctgactgtatttcagcctgtatttactctttttaatgtttaccacgtggtatttatgtggcaaaaaggaaaactatgtacatcctgtgctcttatttcttgtattttttttaaatcctgaaactaacctcccgcggtgtcagatgttatggtggtggtgaagttcaaactgacacacaaagcagttaaatcttttgcagcttgttatagtcaaccccaccttgacctgaccacactgccttatagttagcactttcaagctcttgacttctggcctgaacagttttgtggttctgttatcagatccctttgctttagtttgtcttatataacagttgctggttggcggctctcatccatcttgtgttcagaagttcgtggggctgggcacggtggctc

SEQ ID NO: 71380 - DNA, 2465 bp, Homo sapiens
gtgggaggaccacttgagcccaggagggcgaggctgccatgagctgtgatggcaccactgcacatcagcctgagcaacacagcaaaaccgtgtctcaaaaaattaaaaaagcagctaggtacatatctttacaagtttaaaatacgcttagcctttgaccagcaactctgctattagcaatctatgccatagaagtgttttatttgttttgtttatgtttgtttgaggcagggtctgtgctgcttacattacagtattgtttaattcctgacccctggtggttcacaggtgaaggttgtcatcctgggacaggatccatatcatggacctaatcaagctcacgggctctgctttagtgttcaaaggcctgttccgcctccgcccaggtacagttgctttacaggtgactgcagtccagacatgattcctttcagatgtgtacttagcttattacaagtgggactatctggggcactgttcactagccttggaggaggatttctcggcctcagcaccattgacatttggggctgagtcattctttgttgtggaggaggagaggagtcctgtgctattgcaggatcttgtgccacatccctggcctctaccactggaaaccaggagcaacccccagctcgtgataatgaaaaatgtgcagacattgccaaaagtcccttgggggcgtaaaatcacccctggttaagaaccactgctttgggccgggcgcggtgactcacgcctgtaatcccagcactttgggaggctgaggcaggagaatcgctggatcccgggaggcggaggtggcagtgagccgagatcctgctactgcactctagcctgggtgacacagcaagactggaaaaaaaaaaaaaagaaccactgcttttggaggatttggtgtatgatatacataaatatgctaaggacagaaaactgtccctgagcaacagtgggggtctgggttgtaactgctgggttgatttacttaggttttccagagtgctgttaaatccaagtacagactaaagtaaaggtctttggcagagtcacctgttagaaggaggactggcagtgttgatctcattaatcggcgccatatgtgccagtgtcccttccaagggctggctgtaacttctaaccttttcacatatgtcttagacgttactgagctttcaaaattatgcttaagattctgttttttgtttttcttgtggcttgctttcagtttggagaacatttataaagagttgtctacagacatagaggattttgttcatcctggccatggagatttatctgggtgggccaagcaaggtaagccagcgactgctagattttttttttttttttttttttgagaccgagtctcactctgttgcccaggctagagtgcagtggtgcaatctcagcttactgcaacctctgcctcccaggttcaggcgattctcatgcctcagcctcctgagtagctgggaccacaggcatgagccaccatagctggctaattttttaatgtatttttagtagagacagggtttcaccatgttggccaggctggtctcgaactcctgacctcaggtgatccgcccgactcggcttcccaaagtgctgggattacaggcataagccaccacgcccagccccgactccattgttgatggtagtggctgctgccattatgccggctgcagcagggaagcacagcttgctacactggatcccatcaagcattggtttcatcatggatttagctcctgttgctgggtattgggctgatttgcctgagcctacatttaacctgtttctctcatgtgtataggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgatagggtatgttttgttttctttcttttttttcttttttttttaacactataaaaacaatgtaaagaattctaggagtccctgctgtgtttggtcctggaaaatccatgttataaaataacttttattttcccttaggcctgttataagggtttcccattgaaaactgagaagaatttggacaaattataggggtgatgagttgtgtatgaggaaagcaaagcaactggccaacttgtgactgaatgcagttggtgctgtaggcatgaacttggtgtctacaagatacaagtccctgggtaccattcacttaacaagtgatggatgaggcatgtttctggcttccaagaaatttgggaacatatagaaaacacaaagaattccactcaatcacaaatttaacttgcccatgaaaatactatcagtgatcattattgttttgtttctgggttttttgttttttgatggagtct

SEQ ID NO: 71381 - DNA, 1543 bp, Homo sapiens
ttgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtttgttttgtgcaagtgtcctttgtgcgtccaggccagggcatccatggacgtccttgggctgccctttcccttggcgcctcccagggttcccatagcaaccaccgtctgcaggaggggccgcccttgcccctcctccccgccctgccgctcagtggaacggcccaaccctcccctggctgcggtgagcgctgggcccaacccccggcctggagcagcgccccaactccgagcaccgtggagcaccggctgccagctgagaccccagaggggtaactaacggcctgaggaaggcatttcttcggggaacatggcgtgcccgtcgtggctacgttctgccaagccctgtgacgttggaggggagccgcctgcatcccccgctcagccagtgtttctagactccgagacatctggaactcggaagtgaggccagggctccaggaagactccctgatgacgcactggcccgcagcccaggctcaggtagtgggggctgtcaggat

SEQ ID NO: 71382 - DNA, 1047 bp, Homo sapiens
gcagtcttgacctcctgagctcaagtgatcctcctgtatcagcctcccgagtagctgggactacaggcccatgccaccatgcctggctaattataaaattttttttgtaaagacaaggtctcactatgttgccagggttggtcttaaagtcctgggttcaagcgattccccccacctcagcctcccaaagtgctgggattataagcatgagccaccacgcctggcagttagtttcttaagcttgatttctcattcaaggttgggttagttcttgaggaaatgaaaagccattgtgagaagctgaagggagtgtctgtattccgctggtccagaagcccaggtctagcactatgtcagcagggagaggcgctgtggtttctgggttgtgtgtgtttctcctggatttgggaggaatcaggtttctttgtgactctccaggcctgacagtggagtggacagaagatgatctgcagcagggaaaaagaatcagtgtcccagaagatgtttatgacaagggttgcgtgaaagacgtagatgagggcttggaggtaaatgcagagcctgtgggggccaggggagccagaaccgaactgcctctgtcctggtagcagttggcaactggctaacctctaaagaggtctgtttgtcctttgcacccaggcagcagaaagaattggttttccattgatgatcaaagcttctgaaggtggcggagggaagggaatccggaaggctgagagtgcggaggacttcccgatccttttcagacaagtgagcagttcttgctgtgtcttttcgcatctgtctttgggaattgtttgtgggctgccagattatttctcttagcattattctgtgacagtcaagaagacatttgtaggagctggatgtatcgttgtatcgtattttgcaacaaacgcgtacatttttactcagaaaagcccatggttttgtgtcgatcttgacagaatcttttaggtagttcaagtctataaatcagtgtatctagaaatgatttcagagatacaggatcaaaatagctgtttg

SEQ ID NO: 71383 - DNA, 1159 bp, Homo sapiens
cctttacatttaaaccttatcagtagttccctaatgggttgtatttcacaccgaagactaaattttaaggagtgtgtcctgctgtgaaccacccaccactctgaggcctgtgacagcagccccatgtccccagctcagccaagtcctcccatacttgtgatagtttctgcagagctgagaagcccacattgacagagggacccccaaattctgacacaccatctccgacacttctcctggcttgacatgggtgtggaaaggtataaaactagtttactttgtaattaaatgtttttgtgtgggtaactgcccttcggagtgaaaaaatcccaaaggccttagcattaaaatctgacgtggggcacttagccacgaattaaattgagttgggcagttttgatgatcaggttttctttgccagcttagaataattaattttaatcatgcttagtgaaaaatcaagatccttgaagtttatggaagattgcagcaaaaagggcttacttaataggagtaggcggaagacaggtcagccagcccagacccctccgagtgaagtgacctgtggcttgtcacatgctacgagtggaccaaccgcaacttcaacagaactcacaggcagaaattccagcttttcttattgctgttagtgagagtccagtagggggatcaactgtcctcgttttcctggcaccggtttctcaggttgaaggacttctcagtgctaaaatggggaccaccccaaggaaactgggacaagtcactcacccgtgagaccagcgggttaactctcatacccagcttccagacccacagctgacttttcatggcctatggatacccttgtatgaccttactgggtcttcattttctcacccccaaaatggggtcatcagtgtccttccccgttacctgctgacagcacacaggatgctgcaagacatgaaagcttactcggccaggcacagtggctcatgcctgtaatcccagcactttgggaggccaaggcgggcagatcacttgaagccaggagttcaagaccagcctggccaacatgacgaaaccccgtgtctactaaaaatactgaaattagccgggcatcctggtggccatctgtaatcccagctactcgggaggctgaggcaggagaattgcttga

SEQ ID NO: 71384 - DNA, 1036 bp, Homo sapiens
atctgggggattcaggggacccatgtggaggctctggcctcactagttcaggtagttccagaaggaagcagtgcaatggcttgagtcaaaggcatgtaaagatagtataacatagcagtactagttcagtcacttatcagcctcagtttccttatctgtcagtgagggattagaaaagctcgcctctcttgagtacttacgaaggcaaaatgaggtagagttttaaatgcttagcaagagccgttgcttgttattagttaatactttttgttggatacacactatgtcccaggcgtttttgcagtcagtatatctcatcctcttattagtatcagtgctattgcaaatgtccttgggatgtcttggccctgaaactggaattgctgtgttttggggcagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatgtaaggctggcccgcgccgtgggggtctaagtcaaagcagaagcaggctgcttgggccatcaatttgtagattaagatggcatttggaggcggtcttgccttgctctcccatgtcattctgggttggggtagccccctctgagtgttatgttaaatgtgttagcctttgaatcttggtttttcactcacctaaaaaggagagtgaatctccaagtttaatccattctgtggccatgttggatttttgatagagacaaggtgtcaccatattggccaggctggtctcgaattcctgacttcaagtgatctgcccgcctcgacctccaaagtgctgggattataggcgtgagccaccacgcctggccatatggccatatttgggataagttgtgcactactgtggttgactgtaatgcagtcctcagattggttc

SEQ ID NO: 71385 - DNA, 1089 bp, Homo sapiens
ggtcgtattttttaaagatccccaagagattctaataagcagcaaagttcagggaccactagtctgatggctcggtcagtttggacctggaccaggggtagaaaccgttgttcctgtccagcattcacccacccctcaccattgcaaggactcccacagtcacctcctacccatgtccagtgctcattggttctcttgctgcattgttctccctcccagctgactcatgcctcacacgagcctgtgtttgtgtcggttgaggtagaagtgggtgccaggtttttatgggggacattttttcaactatggccagtctggagtcctggtgacgtcctgcctctgagcaggtgccttctcctccctgagcctcagcttacttgcctgggatgatctgggaatgatctcagagcctgggcccagccccgggcagccactgtcatgggtgtggtcagagccagtgtcccgtctcctccttccctttccggggattcaagcctggctcgtccacaggacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggtgggcctggggtgagaacgaggccggtgagcacagggggtgctgggggctgagacagctggcccacagctgggtccctctctgaggcatcctctgccccctccccaggcctacttgtgggacaacaaccaggtggttgtgcagtggctggaacagcactggcaggcaggggatggcccgcgctccaccatccgtgagaacatcacgtacctgaagcacgactctgtcctcaagaccatccgagggtgagtggccaccgcacctgcttcccagcctcctggcaaggacccgagcctggattgacccctagctacccgactcctatgcagccacttgaacccgccaccctgtgcagtctggggttgtccccgccccctccccgctccccagcaaagagaccacactccc

SEQ ID NO: 71386 - DNA, 1038 bp, Homo sapiens
ccgggtttggtggtgcacacttgtaatcccagatacttgggaggcctgaggcacgagaatcccttgaacccaggaagcggaggttgcaatgagccaagatcacaccactgcactccagcctgggcaacagagatagacaatgtctcaaaaaaaaaaaaaaattacagatcggggaagatgcaaatattgttttcactcctgcttgcctcctgcttccaacgtaatcaagcaccatctctaccagtaaggggtgagaagcctctagtgttacatcctcgccccttcccataagtaacttttttccgtcttcatccctgggatcttggccttcagagaaatgaagtcagtgaaggcaggatatcctggagagctgtttcttttccctcatcctgtgctgttccaagttttaacaaccagagcacatttgtaggtggaataaggagagagagttgagtgctttgaaatgtgttgtctttgtgttgctgtacctgagggaatactcagcccctcagagtttcagtgtgatatggaagtagttccatagacatcaactgaccctttgaagaactgaatgtgctcatttgatctcatggtaactacagaaacatgtaagttgcccagctgtggcaacagcattcttcctttcctcaaatatgcaataaaacactgtaataaaacaggaatttgatcttgaaactagtagaatttaataagtgaatttcttctgtagaccaaaggttgagagaagaaaatacagtatgtcagtaatgtgtcactttgtgtattttaagtttacagttttttattagtccgggaaaagaaggcacaatagttttcgacactggactggaagaacaagtctataaaaataaaaatggacaattaacagtggtgagtggccgtctctgggagggaagtaagccgttttagatgagaatataagttaaagttctaccaatttcagtcctgtagattgactggaatcataagctattaatagttcatttctgccctctattcctaattctacatctgtaa

SEQ ID NO: 71387 - DNA, 2216 bp, Homo sapiens
ctgcttaaagtccaggtgttggcagagggggtgggccataacttacctgccctgtatactgtgggaacacaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccactt

SEQ ID NO: 71388 - DNA, 1040 bp, Homo sapiens
ttatgctgaatgaaggaatctggtcacaaaaggccatatattatgcaattccattcacataaaaatgtccagaacaggcaaattcatcaagacagaaaacagattagtggttacctagggctgtggggttggggaagcaatggttgagggaaaatggggagtgactgctaacgaatagagggtttcttttcaggcagtgaaaaagttctaaaattagatagtcgttatggcctcacaacttgtgaatatataaaaaccacatattgtgaatataataataactgtacactctagaaagatgacttttatgatatgtgtgaattatagctcagagttatacccctgtatccatctgtctacttatctatccaggcagagaggtacagaggggtcatcctcatctgaaggtacgaagaagagctgggcctggctggtgtgagtggaggttttcctagtaaatggagctgtctttcccggctgacgccttacctggtatatgagtatttgttgttacttctgttgtagagcaacttcacggctggctgtgggttgttttaaaagaagaagaagagagttacttggcaggcagatgcaatgaactactagcttcccatagggctggggccctgccctgcatcagaagaggcagacaagcatagcttgctggctggagagggggaccacatgacccaatagcaggggcacaaaagatgacctgtagcttcccactgtgaacccattatcaggcctcactcaggcaattatacatgtttttatttcaaaagttattcagaagaacctccatcatttctggtagcaaaagaaattccacaagggtgcctccaacataccttatttgaagtcgctataagtttttgttcttccttggatgaggtgatcacagggaccttgcagaaaggctcataagtatctttgttctgctggaacaaaacatgctttcagcctaggaggcctgcctagcactgcatttttaaagttgaccggctggacaggctctggcgaggggagatggggcagtc

SEQ ID NO: 71389 - DNA, 1100 bp, Homo sapiens
ccttctgttccatgggttgtcttttcactttcttgatagtgtcttttgaatcacaaaagttttaaactttgaagaagcacaacttacctgtttttttcttttgactcttgtgcttttagtgtgataacctcagaaatcattgcctaacctgaaatctcaaagctttactcctgtgttttcttctaagaattttatagttttagttataaaactagcatttaggtctgtggctcatttcattattttttatatatggtgtgggatagggaccattattttatctaatagtatttatctttttttgattatggaagcaatacatgcttattgtagaaaacctagataaagcagaaaaacataaaaaagaaaaaaatttctcataattctacaaccagagatacattgttaactttatctgtcctcaatcttttaaaaatgtatctatatttgtgtttatatttcgaaacattatacaatatatatacttatatatagtatacatactatagatacactacatgtgtatatattgtgtatctatagtgtatatatagttttaaataaactgcttaactgaattatgagttattggtgagttaccacagagtgaacacacctgggtaagcaccacccaatagagaaatcgattataccagcactccaaaacccccttttttccctccctccccatcacaaactccttcctcttccatgtatatagtttttcatcttgcctttttttaaagttcattgtagcatgagcattctctcatgtcagtaaaatttcaaaactggtttttcatagctgcacagtatggcatcagcaactggaccatcactgacttgtccatttccccagtgtatgtccccaatttcagccttcagttttctcagaaatcccacgcagaataatttctaggaatttgagcacgttggtggggttgtgcttttgttctggatgcacacggagacctgtctgaatgagtggatctatctgtgtctagccctgtgattgctgcacagttctcagacaatctgattcggccgttcctcatccacatcatgtctgtgcctgctctggtgactcatctcagcacagt

SEQ ID NO: 71390 - DNA, 1063 bp, Homo sapiens
gtttcttcctatatggatgttccgctgtgtttgtgggatgctctaactttgtttttgttgttatcgttcttgttgttagagacagagtctcactgtattgcccaggctacagtgcagtggcatgatcatagcttactagcctctaactcctaggctcaggtgatcctcccacgtcagcctcccaagtataatagctgggactacaggcgtgtactgccatgcctggctaatttttttttttttttaatttttgtagagatgggggccttaccttattgcccaggtttgtttccaattcctgacctcaagtgatcctcctacctcagcctcccaaagtgctggggtgacatatatgagccaccatacctggcctccagcttgttccacaacaattttgaggcttgttaggtcactaagttcatatatagcaaaacaaaaaatccataagaatagaaaacaaggattggggaaatagaaataggtgaacacaatcaagattgggtcataaaagcatgtccacacacatatgttacattagggccactgtggctacctgtgaacttcagtttggctgtgaaccaacatgaaatgtttcagaaaccgacatgaaaaggggtctgtggatgctttcttctaatttcttagaagtagagcttttctgagttcttaagaaaataaatctcccatgtgggactccttataaaggagccactcactgaaccacaggcggggctagcgcttcagtggctttcctatcgcagggtcagtaatgggttccatgggaaggttctcgttgcacgctcttattaaaagttatggaaaggccactaatgcataatttgacagagttacctgcctgtggtgggttttcaggttcagggtgtctgttcttctactgagtgtgttgcaaaactctgtctcatagctagcagtaagcgtgggctcagcaaatgtgactccagcaggatatcaatgggaaggttgaaaacaaaggtagaatatcattcaaaaccaggtgtcagaactagaggttgtcacgccttacttccctctaaaggcacag

SEQ ID NO: 71391 - DNA, 2695 bp, Homo sapiens
acgcccggctgattttgtattttttagtagagacagtgtttctcatcatgttggccaggctggtctcaaactcctgacctcagatgatccacccgcctcagcctcccagagtgctgggattacaggcgtgagccacagcaccgggctgccaaatctgtttctttacacattgtctgtggccgcttttgtgctgtagtggtagcactgagtagttgtaacagtgttagactaaatttggcctgaggatgcctccatattttgagtccttaagtaaggaactgcagcctaacttagtatgtaaactgactagaagtctaacttaggactattcagtatttttgtaacaaatagctgccaatcacagcagcctagcttcaatcaatcacaggtggccatctgattagaccacattcaaataaggcaaagccgaggtgtaaccagtcaagctgtctctgtacctcacttcagttttgcccctaaatgttgcctgcccagaatgtggactggagctgtctgaacctcgtctggttctgagggctgcctgatggatgaattgttttttgctcagacttggctagatttaatttaacagcagagaccttctggcccacagtgcctaaaaatatttactctttggctgtttcctgaaacaaattgctgatccctgatttaaagcataaatgctaagtcagacctgagttctattcctggctctgacatacaggctgtgtgatttggggccaattatttaacctttctgtgcttcagtttcctcctgtataagatggggataacactgggcttcagaaaatggaaagcaaacaatacatacggagtgcttagaatggtgcctggcacatagtcagcacccactgactactggctcttatcattgttactctcgtggtgataatgcttttctccataatcccaccttcttttcacgcacattaaatgttcatggataggtttaagtgttttgtttccccactggataggagaaataacagaccaggtggagtctccacctgaagcttgggtttctctgtgttttttccaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacgtaggttgactgctgtgggactgaattcctttcctagaatatggagagaccaaaatacagtgtcagtaaggaagtaattgctaatgtgattactgcaaacatttggacctgtgtggcagggcattgtaagaactagccatttaccaagtgagcagtgtgcagtaaatgttcagcagttgttagggtggggcctgggagttaaaagttcccatcctttcaaggaagctgatcagtaccactggctgtggcttggggtctcctggagatgggtttagatcatggctcagccatttattcactgtgctagctagattcctggaaaattccaaagtcagagccagggtgcagatccttgctaagcagatcttgagacaccctgggcaagggatcacggattcaacctctctgagactcagttgactcatctgtaaatgggaatgacaatagcacataccttttaggcacatggtagggattaaaagacataattattgcaaagtgcttatcacagtccctggcacataggatgagttcagtacttgttggctcttattattatcaagccgaccctgagcaagtttcttaacctctttgagtctctatttcctcattagaatgaagagaatattaccagttcaatagagggtaagtgaaaaaaacagcgtcaaatacttagtgcagtgcctggcacagagtgggaaattaacaaacattagtcccatttagttcctttggtttttaagcttatgcatcttgtgtgtttggtattcttttcattccaccttttcccaaaaggttggtgaagaattataagatacaatggacctcaggcagttatgttcaggctggaagactttagccggagaggatcagggacatgtaggtggcagattgggtgaggatcatggaagaactcactgagcagttggaggcaagagcaggggtctagctgctggtgaagacatccttaatcactggatgggggtaagccaagagtgaatcttattctagtgtatggagcagtgttaggaaatgttcagatagagctgtgtcttaaatggctcatttattcatatgttctttcaaacatttattcatttactcacaaatgcttactaagtacctgctaagtgtcactagtatgtgtcttagatatcgaaaagattctgcagctttcctcagtaaacatcgactctcagtcaatgttccttgatatgcagacatgaataaggaaggcgtgaattgaggtgtgaattaagaaagtgtcacagtcagatccttatgaataagaaaaatatagagtacagattttttcttaattgtattttttaactttttactatggtcgatttcaaattaatagaaagtagaaaggataatataatgaaccctcatgtgcccattatcagcttcaacagtaccacctcacagccagttttgcttcatccaaatgcccacctgct

SEQ ID NO: 71392 - DNA, 1018 bp, Homo sapiens
ctcaggtaatccgcccacctgggcctcccagagtgctgggattacaggcgtgagcccccacgcccagccttgaggaggattttctcgtgggccattcctagctggaccctagctgcagccagaccactctttccggaacgttttttgcttgtgtattcaacagtatttctaattcccacaagtgttccagggaatgcttctgttctcacaggacacttctaactggtagcacatgttaaggcatcccattctgcttgcatctcatctaacttcagtttcagtcatttttgcagagtgtttttatggaatcgtcagtttgctgaccctgttttctgatcccgcctttgttcattttagagagttctactgtttcgaaccatggttaccaaggagaaggagaaactggggctggtggaaaccagctctgcctccccgcatgtcactcacatcaccatccgccggtccaggatgctggaggtgagtgtgaagcctatggaatcctaccacaaggaagtgggccctgcaacatggaagctctttagtggacggtctctggcttttgaactgttcctgttactccttgatctgaaattaaggctctgggagcaggaaaggggtcatttgtcctgttgactgctctgaacagctgcttggttaaacatgttctcattgctggagacccagcagtgtcttcctttaccccatgagagctagagtatcctgggctagagcatccacctcttcatgtccctttgaaatgaggacaggagctgccagtcacagcggctgcactaacactctcaggtctgtgcaaactccatttgtcccagcaggcactttgctgagactctcaactgtgattgtagtatataagtggagtggaggtgttacatttactgagttatgtagagaaatacttttatcacagagccagaagttctttgtagacagaaacttacaagataccactgaagtgacccacctgagctaaatccgttgtctggaactaccactatac

SEQ ID NO: 71393 - DNA, 1027 bp, Homo sapiens
ttgttacatcagtggccttttttcacctttttagtaaacgcacattttcatcatattgtttagtacctgcacagtattccagggtatggatgtaccagtgtttatttaaccgtcctactctactccgaaatgccaacacattcccctccatgacatcccgaagtcttaatacaaatgtttgaacaaggattgggtgagaaaaaaaccttttgtattgatcatgcagggtctgcttgttgatatttcagccttgactttttatgagaaaggatggttcccaagcatgtgccatcttaattccatcattatcatggatgtttgtgctgggccctctcatctccgggaagctttatttccccattagagtcctccctattaattactcccatcttctcccccagcttgtttgccatgaactgattcctggagggaagaccattcctgttacaaatgaaaataagtgagtatagcaattaggtttttaaggtcaccacttgaaaagacttcattctggctctctgcgcttatgttgagaatttattaagatagattgaagtagaaagaggccataaatatcataatggaatttactggttacagttcataggccagaattgtattaaattcaatttgcggccgggcacagtggctcatgcctataatcccagcactttgttaggccgaggcgggcggatcacgaggtcaggagttcgagaccagcctgatcaacatggtgaaaccccgtctctactgaaaatacaaaaattagctgggcgtggtggctcatgcctgtaatcccagctactcaggaggctgaggcaggagaatcgcttgaacctgggaggtggaggttgcagtgagccaagatcgcaccagcgcactccagcctgggcgacagagtgagactccgtctcaaaaaaaaaaaaaaattgatttgcaaaataagaattgaccatttattttttgcagtagcacttctaaggtcagaggcacccaggccacggtgttcttaggagtttaataacgg

SEQ ID NO: 71394 - DNA, 1036 bp, Homo sapiens
tccttgccatgtttccatcaaagtagagcacacactcttttccagaagcctgggggctcgacctgggtgggacaccaggatgcagctgaaactctgaaggactgtggagacgggtggcccctgctttgctgccactgtgacagctcttgttggaaaatgttttgcgtctttgaggagagcagaggagggactgggccttcctggcttcgaatccggcatcaaccttggtggtgcaggtgcaggagcatgaggtgggagagggtgggtggctgtcaacacagaccacaaacagggcctctgcctcagttccctggagctaaagttcttacaacaaaggtaaagaatgagggcagaggaacacaatgggttggaagagaaatgaagtttaaaaaaaaaacaaaaaacccagagggtgtgagcctctgtcagtgcaacgggcttccgggttccctgtgctgaggaaggatgggcagcaagacccaagtttcctgggattttgcagactcaggagtgaagccaccgcccagatgggatgtgtaccttaggttagtgtttgttcctcattagataaccagtgagacaaataagcagggtcaaaggcagccgtcctccgcgggacaagcaggctttggggaacaggcagcacattctggaaacggggctgctgctaagggccgttgtttttcttcccccaaaccaggatgccaatgtgaatgcataggacgggaataggtccgggaagactctctggcagctcagcccgctgaggacgcagaaaatgggagggccgcggcgtggagcgcgtggcttcaaggcaggagcagcgccttggactcacggtgtccatagcgtccctagcaggcgcctgcgcttccctgggcagcagatgggcctggctgtctgggaagaggcgctgtggacggcatggaggcagaaactttgtggggtgcatagaggcttggcgaggccttacctgagtaagagatttcagaaacggaaggagaggatctcacgcacagtaggctttgtacactca

SEQ ID NO: 71395 - DNA, 1035 bp, Homo sapiens
gccaggtggctccctcaactcaccagccatccttgatccctccttggccaggccgtcctgcgatgtgctggtggaaagggggccgatggcctgtttaaacccacctgtgatggatttgtcatctccactgccggccgagcctgtgcaggttcaggttgagcggtggcaggatgtgaaatgctgctcaaggtttaggcccaggtcagagcctgttgagccccataatgtcacgtgactcagtgtctcctccctttctagtgtggtgcctcttgtccagatgggagagaccgatgcgaacgtggccaagttcttaaacaggtactcgcgtggaacctgggggttcctctctgaaagccgaggctcatctgtgggaagtagcagcggtgcagcggtccgggaagcagtgtggggcagcattcccgcaccccctccttcattcccttagtgtttatgaacatctgctctgtgccaggcaccacgccgggcacaggggaggcagtggtgaacaaggtgggccctgtgcctgtcccgataagatttagatcttattgggagaggctgctgtaaaaaccaggaagaaaaacctaagtgcaaagtggcattgcgggggcaaagggcgttcttagaggctgggtgctcaggggaggcctctcggtggtgactgaccagggagccaggcttcaggccctctctcagccagtttcctgtccccgagagggcctgcggcagcatgaaccaacaagagagccgggccaagctgcgctcaggggaccccatgcaggccccagtgagccaggctagcccagggagggcttcctctgcctcgcggccggcccatgaggctggagccacacctggcccaaagcctgctctgcgggttcctgccccagccctggcttctgtggcatcagtgtgggcaaggccagagcctgggggcaggtagagagctgggggagcaggtctgcaccccaggagctgtcctgggtgtctagaaagtgacctcaggcccttgactgtggccactcctcccagaga

SEQ ID NO: 71396 - DNA, 1506 bp, Homo sapiens
ggaggccaaggtgggaggaccacttgagcccagaagtccgaggccagcctgagcaacagagagatcccgcctctaggaaaaattaaaacttagctgagtgtggtggtgtacacctgtagtcccagctgcttgggaggctgaggtaggagaatcaattgagcctgggaggtagaggctgcagtgagccgtgatcgcaccactgaactccggcctgggcaacagagtgagaccctgtctcaaaaaaaaaaaaaaataatatcacctacactccttccactaaccctccaaagtggattcacaaccaggcttggagtctcacagcctggattcaaacccaacccctgcaatttgcctgctgtggtaaccttggtcgggctgcctcagtttccatatcaagaaaatgaagagcttgagcacacccacctctctcggttctggggaggactgaacaggataattgggtgtgtggcccagatcaagccctcagctgatggaaggttcctgttaccaccccatttgacagacaggcacattgaggctctgcagggagaagtgcttgctctgaggtgcctgccgccaggtgggtctgatgccacagcccatgctcctaccccaccaccataatgcccccctaattcccaccagggaggactggggaagggcctgaggacccactgtgcagtctgggctgccccatctggccattgtgaccatctccaggggctctcagggtgtttttaccttccgtctctcacttcctttttgctccctggagagagtgcccagcagctttctgcaggagccaaggcatggcagagcccaccacggggtcttttgcccctgctgactccagcccagtggagccagcaccatgacctgcccaggcctgtttttaggagccagccctgcctcctcctcctgcccacagacccatctgatgaaaacgccaacggagaaaaggaggttgttttgggtgacaatgaaactgccaataaaatctcaaacgcagagataggcaatgactatttcacttattctgacagtttgagactttgctggggaagggaagtgacaggcacctgccgacatcaacaccacttctttcggagaacagcccgtgggagggggcttcccgggagacctgccttgcccagatgccaagcgggctgtggctgctgctgttggcagcaggggctgcggtcacccacggggagagactggacactctgactctatccacaactcccctctggcacagacatatgccaggctctggctggagaccacagaggcagaaacaaccagcaaaacccctgcccttagggtttgttttgtttttttaagacaaggtctggctctgtcattcaggctggagtgcagtggtgcaatctcggctcgctgtaacctctacctcctgggctcaagccatcctcccacctcagcctctcgaatagctgggactacaagcattcatcacgacacccagctaatttttgtattttattg

SEQ ID NO: 71397 - DNA, 1043 bp, Homo sapiens
gtgtctccattcactcacagggtcacctggaccgtgccttgcagacacatccacagtgttacagagatacacacggagtcccaaacagatagagaagagagtgtctgcaggacagcagcagcagacagtggcacagacacaggtaagcaatgcccatccacccgccagggtcaactggacagtgtcccactgccacagataaactgcatcacagacaacagaggcacccagcagtgtccgcagacatggacagacacattgtgtctggtacagtgtcaccccagtagacagtgtcccacggcatctgctggcatgatgcccctgacatagtgtgacaccatgtgggaccctatcacatgtgcatgtgtggccaggaccacacacacgcacacacacacacacatacacatgcacacatgcacagacacacacatacctgcacacgcacatacacacacatacacacgtgcgcacacacactccctcccaccacaggtccagggcagagggccgggacctcccctggggacgcagacctgaagttgggccctggcccctccctcccccatgtgtaccctcccttctctgagtcacagctcctccctgagagaatggccacctgccaggtaacggggcttcagtgagacatgaaagtctgacatttgcagtgggattctggcgatggaaggcccagcctcagggtgaggcacagcgggtctctgcttctccatagcaggccttggacgggcagtgccggcgaggtcaccatggcatggaagcccctcagggacttcagaggctggccttggatagggagcggtgtggaatggaggggcccaagatcaccccctcggcctccccaacacccccctggccatgagcaaggatagcttggagatggcatcaccttggacctggactacctgcttgctacttagaggactcagctgagccccctcccacaggggacgtgcccaccgggggcctgcccctctcctgaccgaatccagaagctgagatcctggaatccccttctccaacag

SEQ ID NO: 71398 - DNA, 2537 bp, Homo sapiens
gtgtcccagtggtcaagtgataagaaatcagatggcccacagcctctagagggagtaagatgagtctgcagttaactggaattctagacagggctggagcagggctggaggagggaaaacctgcagctggtcctggagggcttcctgacaaagcgggctgtgctctgtgccctgaggactgagtggctctccccagcatggagtaaatgggggtgtctctggcagagggagtttggagacccgggagcatgaccaggaagggcagggggagcttataagatggtggaggtgaaagggagattaggagggtgtgcagggggcatcgggtgctgagctaagggtgctgtgaggccctgaggaagagggaagccagtgaaagcatctgagaggcaggggccagctaagatcccagtgccttagaggccaacagagagcttgggagtcgcagacctgggctgaaacccggtgagagagagcacctgcactctcactggctgtgtcctcagagaaattattttacccctctgtgcctcagtttcctcttgttcaggagagtctcaacagctttctcatgggcttgtgggtggggtgagcttgcatgtgcatagtgcttgcagggggcttagctgagcccctcagagctgggtgggctgggcttgaatacaggcctgggccagtcctggccccacagcaagccagcatcccagccgcagcagctgtttggggccctgggggcccctgctattgtgcagagggcacaggggacaaaggcctgggaggtcagggggtgaggccgagactagctgtgaacaggctcccggggatggggacttaatgacgcagaacttaatgacccagagtctgtggggaggggggcctcccttggaggaggagggaggtccagccaccagctgtctgctccaggattcgctgccagggcacgggcagctgcctcacagagtccaggcctgagcttggcactgggggaggcagaggtggcagggcctcctggcatgaaatccccaggcctgaatgcagggcttggccctgcccctcggcatctgcagatctccgtctcttcatctgtgatgggccaagggaccaccttagagggcagctgtgaggtttggcagtaaccgatagccaatgggcagtaaacaggaactgctatttttgctctttatccatccgttcattcagagagcttccctgctccaggccaggctccctgccagatgctggggacatgaagatgaacaagccccagttgccttgaaaggtggtgtgtacctaccgagggagaggcctcgagtgcaccccctcagccacccaacaagtgcatgtgggttaattgccacaatggaggaattcacagtatgtgggcactgtgccaggggcaggggggcacagcagtgaacaagccagacgtgggccctgccctgggccaccaccagtctctcaaaggaaatcagaggtggaaacaattacttctggctggagtagccagggagggctccctggaggaggtggcacttgtaattgaatacttttgcctattatgagaatcacaggacactggtatctgctgtgtgccagactgagtttcctactttggcattttgttctctcatttaatcctcatatccctctctgaagggtgtttttatccctgtcatgtgaatgaagaaacttagcctgatgatgtgaagcagcagccctgggccacatggcaggcccacagaacccccttcattatccacacaagcttttgcctcttcactgcctgtaagggtactgggcatggtaggatcctcgggcaggggccgaggggacgctgttctgggccagctgtctcctttatgagcttcacgaccttcagcaggtcaccttcccccacccctcccaacccagactcagccgcgtccttcataaatgtcaaggatggcaaatctgtggcaggcctggcttgccttatgccgctgtgcccttggcagacattgccaatcaattgctgccctctttccctgctgagttcttcccctgaccttgggttccttccagggctctgggcaggcagcgccaatcaatcagcagggcctgtgagctgaaaccagttgcctgcctggcctcaatgagctcagggtgcctctggcccgtctccatgtggctcagaggaccaggggggacagcgagggattctaggggatctctgtgtatccaggttgttcttaagccacaaaagccttttaggtgggagggtctgttaccctcttctaactcccacttgtgttcatccatgcagattccgagcactgacagtctggatgatgataacagcatgtatttagttcttcctgagagctaggtccttcctgggcactctctcgttcatcattctgcagaacacctgcagcaagcctccctgcacctccagggagaattcttaacccattttagagatgagggaactgaggcttggctcagctaagcagagtagggtcacgcacttgttgggtggccgagctggcattcagacc

SEQ ID NO: 71399 - DNA, 1104 bp, Homo sapiens
ggagaatgatgaaattcacttagccacaaaatctccactgaacaccactaaatctttctttagcaattccaaggggcatcacttcaggatcctgtgggacctcaggattaattgccagctaattgaatgttcttgttaacagaatgctggggaaccctgctaatccactttgtttcttttctgggggtctagaaggcattgggaagtcctgataccctggagggcttggaggcgtgtcttcccctccagagcctcattgtcccctctcccctctggcctctcttgtggtctctgctgcactgcagcttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaaggtacgggctgggaggaccctctggactcgtgtgttcctggagggagtcacacacacaccacatgcacacttatgcacctgcagacctgaggatgctgggtaccgtgggggcaggaggcatggtctggacactggggtgggaccagggtggagatggaggaatggggaaagtgagaaaccatgtgtctcctctttgcctccataatcccgctggggtctttagattctcttcaaggaccttttccgattcctgctcgtctacttgctcttcatgatcggctacgcttcaggtgagctctgggtgctcaggtggtcctggcaggggtggtgcaaggacgggaacagtagccatgatgtataggggacaatagcagccttgctgagttcttttttttttttttttttttttgaggtggagttttgctcctgttgcccgggctggagtgcaatggcacaatctcagctcactgtaacctccacctcccaggttcaagtaattctgcctcagcctcccacgtagttgggattacgggctcctgccaccacgccccactattttttaatttttttttttttgtatttttagtagagatggggtttcaccatgttggccatgctggtcttgaactcctga

SEQ ID NO: 71400 - DNA, 1020 bp, Homo sapiens
ggtggatgggtagatggatggatggatggatgagtgatggatggatgggtggatagatggatgagtgggtggataggtagatggatagatgagtgatggatggatggatggatagatggatgggtcggtgagtggatgtgtggatggatgggtggatagatgtatgggcagtctgtgcatttctttctgtttgtctccacccaacacacagtaggtactagctatagtttgttggataaaacattacttagtttttacatctgccccaactacctcaccctgttccttgtaaggcttcagctgcctgcccgccaccacagtctctgggtccctaaggccagggacagtggggcaggcaggggatgagccctcccatcaacttgcctccctacctcctccaggaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgaggtgagccacccagatgggcatagccagtgggacagccaggggtgtgggggaagcctggcattgggggccccctttcccctcagcttctttctttgggtcggtggactgcattggcctggaaagtgcactggacagggagtctggtcctgtgtgtccttcaccatgttacttaacctctctgtgcctcagctacctccatttattcattctttcattcattcagcccttatgtatgaaaaggttagtgtagtgggtaagcagagtccacctacctgggttcagattctacctttaccagttaagcgatgtgtgacctctctgagcctccgtttcctcatctgtaaactggggaataatcatagcatactcctggctctcatcccacagagagcccagcgcaggcagctggagtcctggagctcctgctcccctgagggaaggtctgg

SEQ ID NO: 71401 - DNA, 1081 bp, Homo sapiens
ttttctctgttcccctactctcccctcttctccctcccagaccctgtgcctccatcttcctccttctctttagtctcttattcattgaacagagtcttactgcatcccaagatgtgccaggcactgggccaggtaagaatgtgacagagagagcattcctgcctcatggtggccctgggctagctctttctctctcagaacctagcacataataggtgccgaaataatgtttgttgaatgactgaatgagtgtctccaagccctccagctcttagtgtctgtttccttcctttctctctctatctcttctcttcccagccctctctgtgccacacccttccgccatctgcctctgtagccccacatctctcccatgcacatacaagctccagacacacagtaggcactcattaataatggtaatatcaactaacatttattgaatgtttaccgtgtggtgggccatgggcaggtacatatgagcatggcctcatttgtctcaaatgtttgttgaatgaataaattaatgggttagttatggaatgaatggatgaaatgcctcatcttttagtctgctgtttctttattttatctttgtttttgtctctttcagtttctctgccttagtaagtactcaataaatgactaatatatgagtgggtgggtgagtggatgggcagttggatggatggatggatggatggatggatggatgggtgggtgggtggataggcagatggatggatagacgagtgatggatggatggatggatggatgggtgagtggatggatgggcagatgggtggatggatgagtgggtggatggatggatgagtagtggatggatgggtggacagatggaggagtgagtggatgggtagatgaatggatgagtgatggatggatggatggatggatgagtgggtggatggatggatggatcagtgagggatggatggatggatgagtgatggatggatgaatgggtggatggatgatgggtgggtaggtggatgggtggatgctgggtgggtggatgtatggatgagggatggatggatggatgggcgggtaggtgga

SEQ ID NO: 71402 - DNA, 1078 bp, Homo sapiens
tcttgctctgttgcccaggctggagtgcaatggcatgatctcggctcactgaaacctccacctcctgggttcaagcaattctccagtctcagcctcccgagtagcgggattacaggcacccgccaccacacccagctaattttttttgtatttttagtagagacaggttttcaccatcttggccaggctggtcttgaactcctgacctcgtgatccacctgccttggcctcccaaagtgctgggattataggtgtgagccaccgcatcccgcctcatctttttttattcacctacatatccacgtactcatctgtcccccattaatctacttgtctgtccatctcttcacctacacatccagccttccatttgtttatcttcttatttatacatctgttcatccatccatccatccatccatttatccatctatcatctactcattcatttacccatctttacacttttttgtccacctatccaatctatagatccattgtccactcattaaaatatctatctactcatctacccatctgtcagccatctgtccagccatacacccatataaccaaccttccattcatctaccattttctcatctgaatgtcatttcatcttctcacctacccactgtttctagtcatctagccattcagctatcaaactattcatcattcattcatttattcattcattcattccatttctcatgcttgattgctcacctgcctgctgtccttctttccttcctctccttctctcttctaaccaccaattcattcacccagatctctgtccatccatttgtccattcactcttttgtttgcttagtcactgactcatttattcatttgctcatcttttcttccatttttgcatctattcatccatccatctccctaccttctcttcctggcacacatccagctgcccctcctgggtcttcttcaatcatcacctccattcctggccatccagtggctttcctgaggcttagaaagagctggaaaccccaaggcattcaaccttctttcccataatgacagccttgctgaaagaaaagacagactgga

SEQ ID NO: 71403 - DNA, 1028 bp, Homo sapiens
aaaaatacaaaaaattagccgggcgtggtggcgggtgcctgtagtcccagctactcaggaggctgagcagaagaatggcgtgaacccgggaggcggagcttgcagtgagtggagatgcgccactgcactccagcctaggcgacagagggagactccgtctcaaaaaaaaaaaaaaaaaaaaaaaaatagggcagctgaagaaagtgaagatcagagaggttgggtaacttgctcatactcacccagcaagtgagctgtgggtctgggatctgaccctctggtctgcctgacgtcaaaatgtgccccaccggctcagggggccatgagagcagaaagccaggtttctggaaagcctggggtctctgtctagggcagaaaggaaggtctggggaccctggctcagccctgtatctcatcaccctactcaggactcctgcaccccttaacttgcccactcctgagcccttctggtctatgcagttcttaacaccatccgacatgactctgctgcttgatttgtctagtttattgtttccccaccagaaggtctgcccccaaagggattgatatctgttctgttcacatctgtgtccctagtctagcacagtgcctggcacatagtaggtgctcaataaatgtgtggaataaataggtagctggcttctactgctgccccttgggccctttccagaggaagatgcagattctttgtccatcctacacaactgccatctctgtgtggaccaccattcagtatatatattctaaagaagagtttgaatataaacctgcttttgaatatataggatttaaaaccaacatattcaaaaaccgctactttggctgggcgcagtggctcatgcctgtaattccagcactttgggaggccgaggcgggtagatcatttgaggtcaggagttcaagaccagcctggccaacatgtgaaaccccgtctgtactaaaaatacaaaaattagctgagtggtagtggcatgtttctgtaatcccagctacttgggaggctgagg

SEQ ID NO: 71404 - DNA, 1043 bp, Homo sapiens
gaggtcagagctctgccaacttgaggagggatttgggttattctggctgctgctcttgttctggcctgggctccttcaacctcgggtgcccttgcagcccatgagctggcaccccagtggccggacaggaatgaggaagggacagggcctcactttcaatgtgactctgacttccttcccacccctagccccttcctgagcattggtttcccctttctgccccgagccctggccactgccggctgtgtgaccccaaggaggttacatcacttctctgagcatgtttcctcatcggtgagggaggatcacacgagaccacaccaggcgcacaggaagcccttgccggtctccagatgaggtcagggcattggaaaggccacagaaggaggcgggggctcaggggacagacaggcgggccattgaccaaacgggaatatccttctatttctttggttagtgagtaacagcagcccctcttgtccacccaccctgccccttgcacaaagagctcctcagtctcaccaggcgcccgttttcccctgagggtggagtggcctgggttccacccggttgaccgagtgggctggccaccttctgggaccattccctgtgtgtgtgtttgtgtacgtgtgtatgtgtgtgtatattgatgtgcgtgtgtatgtgcgtatgtgtgtctgtgtgtgtatgtgtatgtgtgtatatgtatgtctatatgtgtatgtgtatatgtgtatatatgtgtatgtgtgtatatgtatgactatatgtttatgtgtatgtttgtgtatatatgtgtgtatgtgtgtatatgtatgtctgtgtgtatgtgtgtgcatatgtgtatgtatatacatgtgtatgtgtgtatgtgaatgtctatgtgtgcatgtgtgtatgtgtgtgtatgtttgcgtgtatatgtatgtatgtgtgtatattgtgtgtatgtatgtgtatatgtgtgtaatgtgtatatgtatttgtgtgtagtgtgtgtgtgtgtgtgtgtttatggagggtgggttccatgggctttgggc

SEQ ID NO: 71405 - DNA, 1048 bp, Homo sapiens
ccgtcccggaggtaagtggggcccgggcccgggaggggcggctcagccgaggtcccctcgcgcccctggggacatctccgtggcccgtccggctccggggggtcccgaggctccaaaatgcgggccaggggcgcgggagacggaaggcaccaggttccgcaggcgccagcctctcagctaagtgcccttgggccggacaccggctctttgggtctcggttttatcacctgtgaaatgggcaccaacgtggggcctggggtagcaggtctggggggagggcggttcggttccctgagaccccaagccagggaaccaaaggcccggagccttgcagcccaccttaggagacttggaagagggatttcgggggacctaaggtttgcccttggcccctgagcatgtcggagggaatttggagtctggagcttccaaaggcttcttcttggttactgagtcccggagagacggctgtttcctccaagaggcatgaaaatctttaacctctagttctgccctggactctcaggacgtcccgggggcgggtggctcctgggggtgggtagcgggggtgggggtgggggagagagagactcccacactccccgcttgcctggaaacaccaaccacagatgcattcatcgagccacccactgctccagcctgccccagctgttccctctgtctgtcctctctgttttgcagatggggaaactgaggcttaggtcggggatctagacaattgggatttaaacccagggactatccagccccaaagcccttcccaccacaccaggtggcctgtcctggggccagctctgcacacagggcctggtgcccccggggtgcttgggaagtggcagggcagaggtgggccctgtggctgttctggctcagcttctaaaacaagagcctctgctgggggcagaggggccgtgaacccctgaaatgttaggcagataccctgtgggagctttgttctgggatgctaagaaccgcttgaggatttaagctttgccactttggctccggagcaagggcagagggtaag

SEQ ID NO: 71406 - DNA, 1064 bp, Homo sapiens
gcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcacatctgtgcactgtattggttcttgatttttttttctttcctgcatcagaaattacaactggggacccttacaaatcctaccaagaatgtattttctggcgtccatggttttaaaattttatttatctattatttttaaatgtttttgtagagattggggtcttgctatgttgcccaggctggtctcaatctcctggcctcaagcaatcctcttgcctcagcctcccaaagggttgggattacaggcatgagccactgcaccaggcctggcctccgtggtcttaaaaaacagaactggttgctgcatggagaaacgggaatttcacataagaatcttgggtttcggcagggtgcagtggctcactt

SEQ ID NO: 71407 - DNA, 1092 bp, Homo sapiens
ggcctcccaaagtgctgggattacaggcgtgagccacggcaaatttaaaaggatgatttgcagcactagtggcagatcattttaaaaaatgctggtgcctgggccctactaagttttttgattgaattagtttggagtggggctcagacacggttttgtttgtttgtttgttttaaagttccaccagttgatttcactgtgcagccaaggggtggtgaccactcgttaaagggatgaggccaagctggtgagggttcctgggatttgcagtggctcactttcctcccattcctgttctcagatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggaggtaattgtgcggtaactgccgattggatggaagtggggaccacttgctggtcaggggatgaggccttaaggatttagggagcgtaggatttgccaggcagtatgaattacctgcatggtgatgtttttccagctggaaatggaaaaaaagatcatcagtgcagccatacattggcattgaaaaagataaaatgatgcagaagcatatgatagaatttggaagcctggttgtaaccccatatccccagagacagccacagttaacagtctggcacatatccttccatgctgtttcccactggtatttgtgcttaaatatacacacacaaagctacttttatagaaatacgtgtaaaaacatggaggccaaaagcataggctttgaagtcagacctagatggaaatcctgaccgtgtctcttgctgaatgtatgagctttggtttcctcatcaatcaagtggggctacagcagacctatgctgtaggatttatgtgatggataatatatacattatttatacatttatacattttctttttgcaaaaaacaagattttctcttacacatactattctgtgacctgctgtctctgctttggctggg

SEQ ID NO: 71408 - DNA, 1032 bp, Homo sapiens
ggtgctcaggtctgatgagatgccagttaactccagagccagcaggaaaagagcttaggtccttgtgcagggactgggttttggatcagttagctgtagtctctttagccccttcaatcattacatctgagtgcttttcctttcttccagttctgtgggtccacagagatctgggactagtctgttttaccttccaaagtagttatgtgaaacagtgagccctaatctgtgcttttcagcctgctgtattattttgagaccccctagataggacctctgtgtagcatcagattttggcccccttttgtcatcattgcaagagtcacttggtagtgccatgtggttctcagagctgtgcatgtgaagcatgagggtttgaacagtggttgcagtgacggtgtgaagggaggcactcatagcctgagctgacttccactgtgtgtcatccaaaatgtgaatggatttgaaaaatgacatcaggctttccattttgtgttttcttgatagattgctgaacaacttttgtacgaacactggaaaaagaacaacccgaaacttcgagaggtgaaaatcagagatctccattgatttatctaagtagatgaaatcatgtttccagacacttttttttttgaacacgtatcttgtaccgggttgaaacagaggagggaaccttgagccacctgaaaagagcgccaggcagaagatctggcacaggctgcgctgagcggctcattcggttgttgaacaaatgttgattgaacctccgctgcctggtctgccaggtgcgggcatggagattagacatggtttctgctcattagcttgtgtccagcatgggagctcattacagggcaggatgcagggtgctgggccagcctgagaggatgagcatgggccagcgcactcaactctggaggggttggggaggcttcccagaggagttcctggggtggaagagtttgaagggatgtatgtgtgtagaggtgaggaaaggatgttctaggttgatgtgactgtgagaaccaggct

SEQ ID NO: 71409 - DNA, 1033 bp, Homo sapiens
caagaaaatgttttatgaaaaatttcatttatagtttcagccataggcagggagttttaagggatggaaaagttttcacaaactttagacaatgaaactatacttttggatgtatgtgatcaactcaacagttgttgacaacacaaccgaacatcagaaactaaaccagcaaataggcacaaaataaggcaagtgggttaaatagttgaaaattggttagaaaacatgcaaaaataatactgagttttcttttaaaaagttttaaaccgtcattaaatgtttctttttgtagaaatctgaagagttctgcgtctgaatttgaaattggactttataaagcctagaaaacagaggaggcggtgccctgcccttgtcagttgttgttctctttggtggtgatggtaaccagctgcttggcagccttggcgatgtcgtacgcacactggatgacctgctgcgtgaccagctgaacgtctgtgggtgagccggggtcccctgggagggtcttcttgcactctgactgcagtcggtaggcactggacgtcagtaaacgaagggaagtcctcaccatatcagacttgggtttctaaaaggaaaaagacagccgtttaccctgaactgcagggcagacatccaaaagcaggggacaaacattcttctaaagcaaaccaagctgctccccagagtgaaaggcggtttggtcctgccctttctcaaaggggtgcttcacacactccaagctttgcagcccacagcgtaagagatgctgaaatattctgattcaaaggtcaaagtgcatgcagggtaattttagtagtatgtggtattttgaagtagtttttgaaaaatattaatccatgtgggtaaaatattccagaaaatcctataaattttaaaatgtgccttttagcacgacttgtatatccttgtcttattaaatcaacattcatgcagaacaaaaatatttcaaagctctatacgactgcatattttattttattttacttttttttgagacttgagtttcactctt

SEQ ID NO: 71410 - DNA, 1014 bp, Homo sapiens
cacgtgggtccggctgccttgcctgtacccaccaggtgttatcagtaaggagtgacaggctttatgtagagttttgtggggtttttttttttttttctttttggttttgttttgttttgttttgttttgttttttgagttagggtctagctctgtcacccaggctggagtgcagtagtacgatctcatctcactgcaacctccgcctcctaggctcaagagatcatctcacctcagcctcccgagtagctgaactgcaggtgtgcactaccacacccagctaatttttgtacttttagtagcgatgacgtttcaccatgttgcctaggctggcctcaaattcctgacctcaagtgatctgcccacctctgcctcccaacatgctgggattatgggtgtgagccaccgcacctggccatgtagaccttcttaaaccaacttactcaaaagtagccactcttttggatgaagctacagggtttccatatgtttaaacaaagctcttagtttacatctgtgtccttagccacattttattgcagcatcaataaaactccttagtcccatgttttgattaacttggatgaaattcaaggagtaaagctagaaatagctcacacttatattttataaggtaagtggtttaggttttaaattagcctccactgatctctgttccagagaagttctcaagcattatgggtgaaataaatagggaaaataatgttcatgaaatactcagaacatagtccccttcgaaggaataaagtccccttcaaatttcgtcaccctagaagatcgtgtgtttagcagtgctgccatttgttcaaaacatttttaggattcctcttttgaatctgtatcccatttttgatcaccacagttgcaccaaatctttacattttaaggggtagatttgagcccaggcatgaaatattggaggtagcaggaggcaggagacctggtgcttggtcctgtttttctgcagactttgtggcctttggtgggccaccca

SEQ ID NO: 71411 - DNA, 1039 bp, Homo sapiens
acaactaaaggacagttagacagtgattaaatatctcattagaaattttgtaagtcaaacctcttttgtctactgtgaaatttttgttttttaatttgtatggtagccttaaaaatcattgcaaggactgcttgctgagacagagttttgtacaaaaatcatttaaactgatcaccctgattgttcctgacagcttcatcatgagtttagatttttatggcgtgtctttattcagagaaaactgcaaacctattaaatacattgaaccagcaccagctataaggtaaccttcctattaacagctttgagagagcagcactcttaaccaatagcttttggctctgcatgcttataatatttttgatacaattaaatgctggctacactgaaattctgtacatatgcttttgttgacaacgatggaaggacttaactaacgtgtaagtaactgatttcctgggtggttgctgctatatgttgttttccatacttgaaaaaacatttaccaaatgcatttattaggtatatgagtcactactcttctaaaatgtttaaatgaaacttggtacttttcatcattgagggtaatgcatttgatttgcgatttatcacattttcatcagggaaggcaaaaagattcattataaaggccagacatggtggctcacgcctctaatcctagcactttgggaagccgaggcaggtagattgcctgagctcggtagtttgagaccatcctgagcaacacagtgaaaccctgtctctattaaaatacaaaaaattagccaggtgtggcggtgggtgcctgtagtcccagctacttgggaggcttaggcaggagaatcacttgaacctgggaggccgaggcagaagttacagtgatccaggattgcaccactgcactccagcctgggcgacagagcaagactctgtctccagataaataaataaaaaagattcattataaaaatgtagaattttctgggtttaattctgtttctagtttgttttccactggagcagctctgggcaaattttt

SEQ ID NO: 71412 - DNA, 1023 bp, Homo sapiens
cactctgatgcccaggctggagtacagtggtgcagtcatggttcactgcagcctcaatctcctgggctcaagcaatcctcctgtcttagcctcctgagtagctagtagctgggactacaggcctgtgacaccaggcctggataatttttaaattattgtgtagggatggagtctcattgtgttgcctaggtaggtctcaaactcctggcctcaagcagttctcctccttggcctcctagaatgctgggattacaggcaagagcacagcattcagccctttaagtcctttaaatggctaaaccaaaaaatcctctccgtagttttttggaagaaaagcaatgttttaagcctgaagtaaagttgtttgcttttattgatagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaaggtgagaggccatgcgtcccatggaagggcaagcacgcatcagctgagggctagccctgccaaagctgctgtgcagtgaggttgggtttgttactagctcaggccaagcaaaggtgaaacaaggttaaatggttttaaaatagggatccttgtccctgcatcacagccctgctgcagttgagactttataaaacttgtgaggagtgattggtgtgttttattcattcaacaagtgtttactgagtgacttctctggatattactctcctgaatgaggcctcgtccctttcctgtgaggctctcattgcctaggagagagagaactgcggagaaggcacaaagtgatgtgtgtcatacgaagcacacacaggctgagggagtgagcagagagagaatctatggctgggagcatcaggtggggctgtgtcataggacagctcttaagatgcgcctcaagggacgcttgggattggggcatgtggaggagtcagaaagaaagtg

SEQ ID NO: 71413 - DNA, 1048 bp, Homo sapiens
agattcactggctgccatttggatccagccatattgtaaacctctttcccatcccatgccattcatcagtgctttttaaatttctgctgttaaaagctggtggtcttggcccatgtgcgtgctcagagtttgccggctctgtgccacaacctccctttagcctgtgtctttcttccagactgcccacctcagccttaggaaaggcctaagggcccaaggcctcaaggccctgggaaatctacttctctgggattgacttctctttgtctagttctctcacatgaagcctcaccggggcacttctctccactttaaccaccaaagtatactcctcagctgttcccattgctctttggatcagaaccaagattcttaacttctttttgtaacctgtaagggcatcattcagctctcacctttcagagattgccctgcttcccatctggttccgtgtgtgtgtgtgtgtgtgtgtgtgtgtgtgtgtgtgtgtgtgtgtgtgtgtgtgtctttagattaacaccctctgaggccatgagctgcacattcaagtcctcttccaggaatcctgctttgcctacagcgtttgcctttcccagcttccatctctctgattcaaggacctgaaatctgaccagtgtaggtagcggctttcccaaagcctgactctgacattgcagcttccctcatttatgactttctcctcatttctgttttcacagaagaccctttactaaaacttcatataatactcagtattaaatattacattaaatgaatttatccttactagtatttaactgtattatgaaataaatgtgttttatgcaatttgtttggtgtctctgtgttctgtatctacagttttgtgtgtctgtgtgttttattgccttaaggaagttgtaaactaagatgatcaagatgataagctttggagtcagatagcactaaatattgtgtgatttccttttaattactcacaatctgtaagtaaattttattataaataattcaaacctagataaaaacccacgttttcttagactatcct

SEQ ID NO: 71414 - DNA, 1109 bp, Homo sapiens
tcagcatcacctaggggaaggaccttcttcaacatattggcccctggccccatcctgtccccattgattcagaatttccaagggtggggcctgcacatggtatatttctagaaatgcgctagttaatttttgagaacttctaccgtaaaccattgattaatttcatttttttacctcattaaattaagtcattctgtatccttccctctcataagtctttgaatttcttattaaatattctattttggccttaataaaggaaaggcgatagttcagatggtgaaaacagtttataaaagtgggatgcaaagtagacttcagaaatctacctaccacaagaaggttgatgattctcaaaagtcttgtgtgataaactgctcaggtgtctcaggagacgtctttgtactccattttaaagtcagtgaatagtgagcaatataaatggtactttgttttctcttggtaggcaaggagggcaccatgagctggcagagcgcctcgtggaaatacagtatgagctaacggacagactagccttctatctctgtggcaggaaaccaggtgagtggatggagaatgaccgtttcacatctccagttgggaaggttctagaaaaacaagttgggacactatttgttattacctcctctgctgtaacatatcactgagaaagctatacatatggcttttaatttgaaaggataactacagaattgtcagttacatgtaaaagatataaagttggacaaaactccttagatttttcatttttaatagctctagagaaatgactatttcaagaatcagactgaataatcaaagcaaaattgaatgggtaccacagttcttgaacatggtgggactaggaatgtaggagcaaagcaataacctttgtagttatttgaaaaattcttcttaaggaatggaaaaaaagtccagaagtaaactttgccaaagccaacttggctatttgtgatagggaacaggggtcagcaaaccatggtttgtagcccaaatctagccagttacttgttttattaaacaaagttttgtatcgtgccactgcacttcagcctaggtgacagagtcagactctgtctcaaaataaa

SEQ ID NO: 71415 - DNA, 1100 bp, Homo sapiens
atgaatctggttcatttcaaatacatcacactctgagttcaattacttgaaaactccatggagattttcagtacagtagtagagtggtcacatgaaatgttcaatgttttaagtatttcccatcaaaaactttgtccagtgatcatgaatttcacgtctagaaaatatctgaatactgagaaaataatttagaaaagatataacaactaacattactactttactatgtgtgaggtacttcacttattctctatatccttactatcccgagatttgtcattgttctcatttgaaccatggtgaaaacactcaagtaacttgtctgagatcattgtgcaagaagtggcagagttggggttcaaaccctgaactccttgtctctagagccaaccctcttaaccaccatactcactggctcccaggattcgtctttgattgaaagcccataacttttcattatatggtttgaaagggtttgaataaactcttaaaaaatggtaaagatggtgtacatgcattttagagatttttgtggacattgaagaatttttaaatgtaaccctttgaccaggcagcttaagtggcacctattgtcaccccattgtgagtctgacgaagtatagctctttctttatttgaggtttctaggtattcagtttacttacccagatccatcctgcttgccaagtatgaaattattccttgtttcaaaggacagctaatgaagctctatgactttaaagggaaaaaagtattatacacacactaaaaatattattcatttttattttacatctttgcctctgtgaagctgctgttattgcaacttcttttttttttttcagatcagttgcaggattggacttggtagtttatgtaaaacaattaattggctgggcacagtggctcaagcctgtaatcccagcactttaggaggtcgaggtgagtggatcacctgaggtcaggagtttgagaccagtctggccaacatggtgaaacctcgtctgtactaaaaataacaaaaattagccgagctggtggcacacacatgtaattccagctactcgggaggctgaggcaggagaatcgcttgaaccctg

SEQ ID NO: 71416 - DNA, 1081 bp, Homo sapiens
tggggcagttaggtccgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccaggtgaggggcggggcgggggtccgtctcccggtggggacttcggggaatcgggggtcgtttcgcctccctgagcccatttccagccctctgtccccgggatccccagaccccttccactttgcaggtgtgggacagtcctaataataggacacgtatcgagtgcttaccgtgcgacgggctttttaaatatcttctctcttcacctttccaataacgctggtgggtaggtactgttacttttccactggacagagaaggaaacaggtcctcagacgctacgtgccttgtgcgaggccgccccgctgataaatgccaagtcgggattttaactcgggccggctggctccggaatgcaccgtcttaaccatttttaggttctgctgcctcaaagacgtaagaatagcacactctccttgttgtaaggaagggcttggttggttttggagtccaggttctaactcgccctgtgaccttgggcaaggcattttccctctctggccgacgttaacttagctgtagaatgaggatgttggtgctggggcagaacccaacacttgactctattgataggtctggggtgaggtccaggtgccgcatttttaacaaactccccagggaggctgatacctagcaaagtttgagaatcacgggttctcaggctccttaaaatcccttcctgttctaaagtgctttgatgctttaatcttt

SEQ ID NO: 71417 - DNA, 1121 bp, Homo sapiens
gattacaggcatgagccactgttgccggccttttttcatttaaaaagaattccagatacgataaacttttgtgagagtcatcgttcttaattagatgacagaccaactatttaagagttaaggagatatgacacatgccctcagactaaatgattcaccattaggcattttagtatactgatcatttaattccttttctattactagacatggtacagaggtaaaaactgtaagactcagctaggacactttaaaaatgaccagttttggtttttaggaatctacttcttttggtgcccaggctggtcttgaactcttgtactcaagtgatctgcccgcctcagcctcccaaagtgctgggattacaggcatgagccactgtgccttgcccaaatcctgtattcttaacccctactatacttctttcagtaaaaatgacttcatttcaagattatggagaataaataaggaagataatggacctgaaagtgcaggcatatggtaattggaaacaatatttactagtagctgctgctattataatcatcatttgtaaacctggggattgagcttttttgctctatattccagtttttctgcaaggaagatgtattgattgcataattaaaaacaaaaaattcttaagtccgggcacggtggctcatgcctggaatctcagcactttgggaggctgaggcaggcagatcgcctgaggtcaggagttggagaccagcctgaccaacacggtgaaaccccgtctctactaaaaatacaaaaatagctggatgtggtggcacgtgcttgtaatcccagctactcaggaggttgaggcaggagaatcgcttgaatccaggaggctgaggttgcagtgagccaagatcgtgccactgcactccaggctgggagacagagcgaggctccgactcaaaaaacaaaaaaaacccaaaaaattcttatcaccccagcaataaagtggctgtttcccttaatgttttgtttgctggtgagtttctgctgtcagtttcctcattccgtctatcacctgattgagacttggagcatgtatactgatagctgtaagaatttttttccaggttttttgttcctgttccaggaacagc

SEQ ID NO: 71418 - DNA, 1002 bp, Homo sapiens
tgcatacataatttctgtgaattctgtaataatatattttataaaggacattgatggaatatattgctaataagaatgcagattattaagaaaaattccgcacctttggggaagatggctcagagcttcctatgtgttgtggaaagctggtcagataatccctgtgcaaataggtagtcgataatcagtacactgtaggttttaccagatagcacctgggaggacacacatgaaagatgatacattttaacatacgaagcttccttgtttttgcatcttccctactttgcacttagttatgcctttgtttccattaatagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaaggtacaaatttagactctaaattttaatgtctaatccccatgctgccatcttgagtgacatgtatgtattaattgtaaattatggatggattgggctttttctaatatgacataataaacactagtgggttttaagattgatctctaaccagtagaaattgtagctgacactcgacaccatccatcatttttacagttaagtcttagaagacttaaccaacatgaagagtatgaagaaatgtcttccttttcttttatgtcttttatgtgccctttctagtggattttacttgaatcctatttttgtcttagtgtttatggatccacaatactcagtcccagaccacagagcgtggagtttctggaggttagaattgacccagtactgagttcagttgtactgatattggtcagtcagattcacacttactatatagttaaatgtttgtttgtttgtttgtttgtttgtttaacccacctgtgaggtttaata

SEQ ID NO: 71419 - DNA, 1076 bp, Homo sapiens
ttagaagaaaagcaaactatttggaaacaaaatgctaataaccgcatatgttctttgtaacgtggctaacctgctgctgttccctgagcttcctgcatgacatcccaaccactcagtggtcagagcagaagtcaggctgttgccgtagccagggccaagaggagctgggatgtgatgtcctagacaaagggtagggctggtcagggatcccctgtgagagggagcgtttcccagggcaagctgctttgaaaaagaatcagagcctcctggctgcttttggttcctaaatacattttttttcaggagtatgttgagttgaataactgagattttgggcatattaccaatgctgcatctgccactggaatgctgggctactttaaaaggagttccacagagatggaattaacagctgggctaaaaaaatctgtttttcacatcctttgccctgctgcaccaaacctgcccaaacatgtgactcagctattttgcagacctaatggcatctccaagcagctcaccacagtgatgagttcctggcccacctgctcttttgtaaggagcaggatggtctgtgcctcattgttctaagaattcctcgagtgagatgtggctacttgtggagatcccaccattgacatgcatgtccccagttaagatgacccagataaatgctctgacctggttaccaccttgtggcaagcccttggatgctggtcatcttcagtcacttctttgggactgctgtccaataaatgtcaccacctttgtcctcaatgctggcagttttgtaaagaagccaagattggaggctttctatgcctggggtgaggcaaattgattaataactgtgggaggagggtggagggtgcataagccatctgtcattgctaaccgcctcctgtggacaataggaccatgatttccaagtgtccttcactaacttaagctgggggggaaaaaaactataaaggctacagatataaatctgaatggcatattgtacatgtagaaatttgtggtgttcactttttatcagaactaaatccggattctggggctggaggacagataaa

SEQ ID NO: 71420 - DNA, 1116 bp, Homo sapiens
ttccctcttatccattataaacgaggggcctctttatagaaatggaacttaaaaaggattcaggactttatattgcaacagagcaccttaacaaatattttcttacttgatgctcacagtaactatatgaacttggtacagtggatgtccctgcgggtcagaaaaatgaaattacctttccactatcaaagctagacagggaaacagctagaacttcaactccaagtcttccaagtctcatgcactttcagatatttctttctttttttctttgttataatcaggagataaaaatgtaaaggagagtagagaaatattttaaaatgaagaaatccattacacttcctgtgtagtttggtgatatcctcatagattttcttgttccatgcaaaaaagttagtgaatagaacttcccggtctttagctggttaacacgtccacctcagacactgagtgccacaggccttcacttgtgaacatcatttggcatttctgactctcctgagttctggctcagcaggacctcaccacggaatgtgctactgcaaacaaccccacagccatcacgcctgatgagtacttcaatgaagagtttgatctgaaagacagggacattggaaggccgaaagagctgacgattagaacacagaagtaagagaggttcagctgccattttcaacctatgtatgtttcagaaattgtgctgttttatggtgttatgttggatcattccactgccctccccaccacccttatttttttttcagacggagtctcgctctgtcgcctaggctggagtgcagtggcacgaactcggctcactgcaacctctgcctcccaggttcaagcggttctcctgcctcagcctcctgagtagctgggactacaggcgcgtgccaccacgcccagctaatttttgtatttttagtagagatagggtttcaccatattggtcaggctggtctcgaactcctgaccttgtgatccgcccgcctgggcctcccaaactgctgggattacaggcatgagccactgcgcccagcctcctctgcccctttttataaaaaataattttaaaattactttgccatgaaagctaacagtagattgtccatg

SEQ ID NO: 71421 - DNA, 1003 bp, Homo sapiens
ttttttttttttgagatggagtctcgctctgttgcccaggctggaatgaagtggcatgatcttggctcactgcaacctctgcctcctgggttcaagcgattttcctgcctcagcctcctaagtagctgggattataggcatgcatcaccacgcccagctaatttttgtatttttagtagagatggggttttatcatgttggttaggctggtctcgaactcctgacctcaggtgatcagctcgccttggcctcccaaagtgctgggattacaggtgtaagccaccgcgcctgaccgaaaatacacaactctcaatctcagttttcccgtctgtgtattgggaagggttgttatgaggcttaaataaaattatacttatcaaagtacttggcatagtaagcacttagtaaatgataactattattgttattctcagtaaagtttacttataaaagtttttattttgtttgttagaaattcccttgtttcatgtcttaaatgcacggattacatttggaaatgttaatggctgtagcactgccgaagaatctgtatctcaaaatgtggaagggacccaggctgattcaggtaaaaaaataaataaatacaaagtttagttttgttatttaaaaaaaaatttatggccggacgtggtggcttatgcctgtaatcccagcactttgggaggccgaggtgggtggatcacctgaggtcgggagtttgagaccagcctgaccaacatggagaaaccctgtctctactaataatacaaaaattagccgggtgtggtggcgcatgcctgtaatcccagctactcgagaggctgaggcaggagaatcgcttgaactgggggagaggcggggggatggaggttgctgtgagccgagattgtaccattgcactccagcctgggcaacaagagcaaaactacatctcaaaaaaaaaaaattataattcagtcatcatattcataattcactctgaagctggaatatctgagggagt

SEQ ID NO: 71422 - DNA, 1036 bp, Homo sapiens
ctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgcc

SEQ ID NO: 71423 - DNA, 1468 bp, Homo sapiens
agacatgacatttagttcacgtaggttggagattttgtttgacaaagatcttaaaattacttctggcctttggagttatgacatgctgtctttgtcaccttctccttccttcttccccctcactcaccaaaaaaagatgaattttcttttcttttctttttttttattttgagacggagtttcgctcttgttgcccaggctggagtgcagtggcgtgatcttggctcaccgcaacctccgcctcccgggttcaagaaattctcctgcctcagcctcccaagtagctgggattacaggcatgcaccatcacgcccagctaattttgtattttcaatagagacagggtttctccatgttggtcaggctggtctcgaactcccgacttcaggtgatctgcttgccttggcctcccaaagtgctgggattacaggcgtgagccactgcacctggcctgatttttctgtatagtcggttttaaaataataaccggtttaagcgtggagggtgtgtgtggggtgggggggtcacagatactacaaagttactgatttaaataaaactatggtcaaatcttggtttttcttttgttttgttttcttttttttgacagagtccctgtcgcccaggctggagtgcaatggtgcgatctcggctcgctgcaacctccgcgtctggggttcaagcgattctcctgcctcagccccctgagtagctgggattacaggtgcccgccaccatgtccggctaatttttgtatttttagtagagatggggtttcaccatgttggccaggctggtctcaaactcctgacctcgtgatctgcctgccttggcctcccaaagtgctgggattataggcatgagcccccttgcctggctaaatcttggtttttcaaaggaacagtaatgagactgaagaacaaccatggttaggccctagctggaacctgggatgggcccacatccctacagacacacatcagtgtacatttgcttgttttgaatgcttcccaagatcgctgagatagttacagaaacaagattgcgtatcactgctgctgttgaagaaacctctgacaggttgctggttacgctagtttttttttttctttatttttttttttttgttatgtagtagtttaaagcccaggtccttatcctgtatcaccagggctcaacttgagtaatcagttgtagttcccatttctcacctgagcaccttgaaaatttcagatgtgaaatttagtcttaaaaacgtaacatttttttttttgtttttgtttttttttgagacagagtctccctctattgcccaggctggagtgcagtggtataagcttggctcactgcaacctctgcctcctgggttcaagcaattctcctgcctcagcctcctgagtagttgggactacaggcacacaccaccacacctggctaattttttttgtatttttagtagagacatggt

SEQ ID NO: 71424 - DNA, 1026 bp, Homo sapiens
actttaggaatctaacccccaaaagtggaaaggaatacattagtgttgttgaaagccactaagttagtggtaatttgttacagaaactaatataattgggatttaacttgccttgggggtgctggctctcccccattttcttctcagagcatctcttgggtcctcaacccttgctgagcccccaccatggcctagaggaccagggatggacttgattagattctcctcttgggattttaaaaaagagaagcagaggctgcatgctcagcttctccgtgccgcactgcaggcacagtgcccggcgccactgttctttaggggtccatgaagatgtctgttggccctgggttagtcatgaggtaagggatatgagggcagttcactttggaggctcagccctttggtgttacttttgctctggaaccttaggagctgtaagggggagaggaactttgctgaaaggcacatcctccctgcagagcttgaagaacaatctaaccatgctggcatggggcccatcctacctgcaatgccaaggtaagtctgcgaaagtcacttatattcagagcatgtggattgggactctgaagaacaactttatggtggacaccttcgtctccatctggtgagtccagcacaagcagcctgagggttccatgggctcaacctcaccctccatccttatttccctgccactccagggctcctcctcatccagacttgcctgtgagtgccccttgatggatgtatttgtctgttctcatgctgctaataaagacatattcgagactaggtaatttacaaagaaaagaggtttaatggactcacagttccacatggctgggaaggcctcacaatcatggtggaaagtgaaaagtacgtcttacgtggtggcaggcaacaagtgactaagagccaagcaaaaggggaaacctcttataaaaccatcagatctcataagacttagtcactatctcccaccaggtccctcctacaacatgtgggaattatgggagctacaattca

SEQ ID NO: 71425 - DNA, 1072 bp, Homo sapiens
caatatgtggtcctttgtggctggctttttttcacttagcatgttttcggtgctcatccatgttgtagctgttgtaacatgttgatacttcattactttttttttttttttagatttggggtctcactatgttgcccaggttggtctcaaactccagcactcatgcaatcctcccacctcagcctcctgaagtattaggattacaggcgtgagccaccatacctggctgacacttcattcctttttatggctgagtaatattccattgcatggatggaacacttttatgtatccattcatccattgatggacattttggttgtttctcttttttggctatcatgaataatgcttccataaacattgcgaacaaggttttatgtggatatatattctcatttcccttgaatatgtacctaagagtggaattgctgggtcatatgttaactatgtttcacccttggaggaactgtggagctgaatttcacagcagctgcacccttttacattcccaccagcagagtatgaggggtccagtttctccacatcctcaccaactcttgttattgtctgtctttttaattatagccatgcttgtgggtgtgcagtggtagttcattgtggttctgatttgcatttccctgggagtgactgcctcttattctctgtgatgatgatgatgatgttgatgatgatgatgatgatgacaacctatacttatagagggtggcagtgtagtttactaagagtcaaggcaacttattttataatactggctgtgtcttcttggccaagtcattaacttctctgagcctctgtttctgcatctgttcatagggttgtgacaattaaacaaaaaaaaaggcatgaggagcccttatcatgatgattgacatagaataagagctccataactggaatccattttttaaaataatctttttgaatgtattatatatatatatttgtatacaaaatacatgtatgtatttttatatacatcctctcctttgaccctcagagtaaccatgtccaagtttggaatttgagatctggaaatgtggattctaaa

SEQ ID NO: 71426 - DNA, 1049 bp, Homo sapiens
tcaaacaaacaaacaaacaaaagaaataaataaaccagcatagtaaactacttataagtttcttaattattcttgttctctgtagctttcaatcctttatacatagtgttccttttttttaaatactgtcttccccttgttcatcttccacctaactgttcttactaatccttcgtgattagcttagatatcaatttctccaggaaattgtccccactgatccccaagcctgggttaggttcccgggagtcctgtgtgccttctgtaacaccttgtgttttcctatcatagctctcagcagcctgtttacttgtctgaacattacttgagaggaagaatttttggctgttttattcactattgtctccccagctcctaacaaagaacctggcacacagctcaatacatggtagctattattattatcagcaccttcatctatcataattctcaaatgtctggttgttgcataaataactcttaagtatgccaagaagcttagagttaagttacaagactgacaagggcatgcattgtttcagagccatgtttgggacctttgtttttcacttattcaatcattttccctttttatactaggaactgacccaggagtgtgatgaaaagaaatcccagtatgatagctgtgcagcaggcctcgaaagcaatcggtccaaattagaacaggtaagaagagagtttttattttaacaatttagcaaaaactacctgtgtgtacacctgtagtcccagctactctggaggctgaagcaggaggattgcttgagcctaggagtttgaggctacagtgagctatgatcacaccactgcattctagcctgggccacagagcaagactctctctctaaaaaaaatgttttaaatactgcccgtgtacgcacattttcactacatcaatgtcaaaagattcccaaatctttatcatcatctcctaagctccagagatctttatttctttaatttgtacacacttaatttcccatctgtaccactcccagcaaagtacaaggctcattatctgctgcctg

SEQ ID NO: 71427 - DNA, 2849 bp, Homo sapiens
ggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggct

SEQ ID NO: 71428 - DNA, 1394 bp, Homo sapiens
ttatagagctatattttggagttgaaatttgagctcctttttggtaactgtggagttactgctcaggaaatgaactgtgttacatttttattttatgagttggtaaatagcaaaagaataagtgtttagggagtacttctatagaattaatttgctttggtttgtttgatcaaggaattgcagatataagacctgttgtgttgattttcttcatgtggggttgggtactgctgctgcattgtctttagtgtttcattcctcctgtctgtatcttttaaaagaaagagcactgactctctttttgtgtcagtttattcctattgatgtaacagaaaaaacatggtagaatattcaggtttttttggagaagtgactaggcgattcttatatacatcatgcgtcatcaagtcatgcttaaattaaaaagaatattagtgacttacttcaaatatcaaactaagtagtaaactgttaactatagttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgccctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccac

SEQ ID NO: 71429 - DNA, 1037 bp, Homo sapiens
ttatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctttgctgctgttcatgaagcttgttaccttttcgctgtcttttttttgagacggagtcctgctctgtcgcccagattggagtgcagtggtgcgatcttggctcactgcaacctccacctcccagcttcaagtgattctcctgcctcagcctcccgagtagctgggattacaggcatgcaccaccacgcccgggtaattttttgtatttttagtagagacggggtttctccatgttgaccaggctggtctccagctcctggccttaggtgatccgcctgcctcagcttcccaaagtgctgggattacagacatgagccacc

SEQ ID NO: 71430 - DNA, 1007 bp, Homo sapiens
tcattattgccataaatcatttggaggagtgttttcatgatttactaagtagatcttttaaagaagattttattatgaaatatgcaaacattttaagcaattttttaattaaaaaaaattcgacctccaagattaaatcattagatgtggttaacactgtttctggattggtaagtttccacaaaaagaggtttttaaatttttaaccacatagaccactctttaccatattcattattcttagtattcattgtggtgagttctctctttttaccacgtttatagttgttggattgggaagtgcagtgtgactcttactttgtagtttttaaatcttaacaagtttatagttgtatgagctaaaagtttaaacctctgccccattttcttggggcagtgttctgtgaccagttacatttttggacttaggttatctctgaagtgctgtgttgctgtataaatgtcatatggaggataacctacaaaatacacttcggatctcccaacagctttgcggttctgaaacagccttcagtagtaccactgaaaagaaacggggaattaactggttttttgtttcttttatagagatgagggtctcgctatgttgcccaggctggtctcaagctcctggcatgaaatgatcctcctgccttggcctcccaaagtgccgggattataggcatgagccactgttcccggcctagaattaaacagtttatatatgctctaaaatttaagtcagtgatcaagttgtttatactgtggatttatgtcacatggatattacttgatatgaataataactaaatgaacatgactgttagatgatcaccttttactttaatcaagaattgaagttttattttttctaaatagatacatataaaatgaatggaatttattccctctccccagattttatttggattctaaaatggaattattacatcaaaagataaggtatttttaagaagtatagttgtttttttgagactgagtcttgc

SEQ ID NO: 71431 - DNA, 1029 bp, Homo sapiens
gaaagaaaatagattttgtctatcataatccctttagtgctagccacttttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaatttaattaattgcaaatttttgaccttaatgcatataaactttgcagt

SEQ ID NO: 71432 - DNA, 1159 bp, Homo sapiens
tggggttttttttgttttgttttgttttgtttttttgacatagtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatcccagcactttgggatgccgaggcaggcagatcacgaggtcaagagattgagaccaccctggccaacatga

SEQ ID NO: 71433 - DNA, 1004 bp, Homo sapiens
gaagctttgattattaccctgacctatctcgctttctcacactgaaatttcattttctatattgtaatatagttttgttgttgcatttgatagtttagaaaggacaaataatgtttgatctatagtgtatgtgacttaagattttcagtctaatgggattttccttatttatattgtggtaaagtatacatattataaacttacccattttaaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccacagtatggtaattgctaaaaagcgtatatattgctttgacgttgggctctgtttttctttaatttttatttttattactattattattattattattattattactattttgagacagggtctcactctgctgtgcaggctggaatgcagtagcgtgatctcggttcactgcaacctctgcctgcctgttcaagtgattcttgtgcctcagcctcccaattagctgggctcaccagcatgcaccaccacacccagctgatttttgtagttgtagtagagatggggttttgccatattggccaggctggtctcaaactcctggcctcgtgacccactcacctcggcctcccaaagtgctgggattacaggcgtgagccaccgtgcctggcctattattattttagttaagcccagctgtgtgagacattgggctcttaagtgc

SEQ ID NO: 71434 - DNA, 1010 bp, Homo sapiens
tgaacttttcaaagactaagctggaataggtggttttttgagggagatatggagagagagtttaaggaaactaatttttttttttttttttttttttttttttttttttgagatggaatctcactctgtcgcccaggcaggagtgcaagggcgtgatctcagctcactgcaacctccgcctcctgggttcaagcgattctcctgcctcagcctccctagtagcagggattacaagtgcccgccaccacacccggctaatttttgtatttttagtagagacagggtttcaccatgttggccaggctggtctcgaactcctggcctcaagtgatccgcccgcctcagcctcccaaagtgctggaattacaggtgtgagccaccatgcccagccaggaaactaaattttatatgttgctataccagctaatcattccaaagagaaactgggtaagcatacatagcaaatgctaatgtgagtcttaagtatctagaacacaagagccaaatgaaattgatatggcaaataaaaacatggagaaaataacccgcacataggctgtgctcagtggctcatgcctgtaatctcagcacttttgggggaggccaaggcatgcagatcacttgagtccaggagtttgagaccagcctgggcaacatagtaaaaccccatccctacaaaaaatacaaaaattagctaggcgtggtggtgcgtacctgtagtcccaacgacttgaaaagctgaggtgggaggatcacctgagcccaggaggtcgaggctgtggcagtgagctgaaattaagccactgcactccagcgtgggcaacagagtgagaccctgactcaaaaaaaaaaaaaagagaaagtgacccacatgttcacctcttaagaagccacagtaattctacattatcttaaggccaagaaaatatttctccggatggatggaaaccaaaagtagtgaagttgtacataatcttataagaaatgaacgtcattgtttttaagctttc

SEQ ID NO: 71435 - DNA, 1032 bp, Homo sapiens
cacagttaaatctgcccatctaggtggtttggtgttaatgcttaggaaaggtggttcccatggccagcagcggtggctcacacctgtaatcccagcactttgggaggccaaggcagatgaagcacttgaggtcaggagtttgagaccagcctggctaacatggtgaaaccccatctctactaaaatatacaaaaaattagccggacattgtggtgggtgcctgtagtcacagctaacggggaggctgaggcaggagaatggcgtgaacccaggaggcggagcttgcagtgagccgagatcattccactgcactccagcctgggcgacagagcgactccgtatcaaaaaaaaaaaaaaaaaaaaaaggaaaggtggttcccaaaccacatggtttcttctcctttttccaaaatcttcatctcagtagcaagaatgaaaaggttggcacttcctggtactgtgactaccactgaatcatggggagtagagaggaggtgattacaggaaatcaggaaggaaatgccagccccatgaaatcaggtcaggcttcaagatcaactggcctatcatggtctgatggttgaggagaactctcatttctcacagttcttaatgtcttagctattctgacagtgctcaggggctctcaaactcaaaaactctctatgctgatttttgttttagactattttgctcttctgcttatccgttttctagagtaataatttataccttggctttggaaacagaggtatagcttccaggatttacagaacaactaaagcaatttttcttttttgttttgttttcttttttttttttttttgcaacagagtctcgctctgtccctcagggtggaatgcagttgtgcaatctaggctcattgcagcttccatctcctgggtttaggcgattctcgtgcctcagccacccaagtagctaggattacaggcatccaccaccacacccgggtaatttttgtatttttagtgaagatgggatttcacagtgttggccaggctggtctcgaac

SEQ ID NO: 71436 - DNA, 1124 bp, Homo sapiens
agtatactgtgaggattttgttctgattggaaatctttattgtaatagcaaattaaagagctgtggattttcaagagctgaatttgaaaggtgtcagatgttaaatggaaggtaattcagagtttattcttttattgtacctgcctccacccaaagagtcagagaaaaacatttggaagaaaaaattgcagagcatccctttggcaagagtaagaattttccactaccacttgccctaagagcattgacatgcctcaccagggaaatgttacaggatgtgatcatcggaacagcctagcctgctcttcatgcacaaaatcctttgtctgaaattcacagaagcctctccagacaaagggaaattgttgtgtcttcacttgaaaagtattcggtggacctttactttcatgaaccttttaactctaagaacctgttttcctaatagagtcaaccctaaattgactctgatatcaacaaaaggaatgtaacagtcacacagcaagttaaacaaaggttttcattaattgagcttccttagagaaggctacttttacttcctagcctgagttcctgtgcataaaatgaagaggacattggttggtcaagatgatgtgatggtccctctagctaagaaaatactagaatatggcaggttcgttggtttgtttttgagatggagtctcgccctttcacccaggctggagtggcgcaacttcggctcactgcaacctccgcctccaaggctcaagcgatagtcttgctttagcctcccaagtagctgggattgcaggcacccaccaccacacccggctaatttttgtatttttagtagagatggggtttcatcatcttggccaggctggtcttgaactcctgacctcaggtgatctgcctgtctcagcttcccaaagttctgggattacaggcataagccaccgtgcccagtctatggcaggttttttggatttatgtttcttcaatatctttctacaaagatcagtttctaatagaagccaattaaacatagaaactctaaggtagcatatttcccaagtgttgggaggctttggagctttttagcttcgagttggtgtgcctgatagatgagaaacagcacaacagaa

SEQ ID NO: 71437 - DNA, 1019 bp, Homo sapiens
atattgaattgtttaagtctgttcagcagttacaatgcagaagtaaaatagtgcttatagattgacgaccgctatctcacattggacagaagtcttctactccataggatcatgacattgacgtaaatcaaatcctcagacaccaaaggaacatttggaaataaattttccatttagggtcataatattcatcattgaacttgtcctctttttgaaatgttcgagggcatgtaggatcaggttaatcatgacaggcagaaatagtgcagtatagggcatgttagctgttaaagaccactaaagtttagaatatagttactttgttgtcttaaatcatctgttagatgtactctcttcaatgtagttagagcagaattatattaaaatgaaaggttctcgttgattcagtctgaatattgctgttcattgcacaagcatttccagcaggaatttcaccttagcttgtgtgtccctgcagtcaaatgcaagggtgatctttgcctgttgagattatatattgacaaactgtgccgccttgtgaccacattgcttacttaggctatagcattgtttttatgcactcaaattaaaaaagtaaaccatattctccctgaacttaagctccgaagtagagaaaaatcagaactaatttgaaggtttaagaagttcagtgttggctgggtgcagtggctcacgcctgtaatctcagcattttgggaggcaaggcaggtggatgcctgaggtcaggagtttgagatcagtctggctaacatagtgaaacgctatctctactaaaaatacaaaaatgaggctggttgtggtggcgcacgcctgtagtcccggttgatcaggaggctgaggcaggggaatcgcttgaacccgggaggtggaggttgcagtgagctgagatcatgccactgcactccagtctgggtgatagagcaagactctgtctctgaaaagaaaataaaaaataagaaattcaatgtttacttcttggacaggagtgctattttgcc

SEQ ID NO: 71438 - DNA, 1047 bp, Homo sapiens
tgtagttttattttgcatttgccatgtgtttcgttaattgaatatctttttaaagggggccatttgcttcctgttcacaataatttagcttttttgatggaatgaatcatggcatatacaactttattctctttgctgtgccttgtgtatatgtagtaagacttttacttactgctaagtaggaaagtattctttaaagtgaaagcttgaaggcctgtctgaagatacagagcaaaatttcttagaataatgtagttaggtttccttaagcctcattctcttccttcctaattcaaatcttgaatccatctaaagttttttatgactccaagataggttgatcactttgcttgttttaactgaattttatgtatttgtgttatatgcagatcatttattttctttaaaaattgatttggagacaaattcatctttagataacatagttttaaaagttgctcatttcagccgccttttttttctcctaattagttggtgacaaagttcctgctgatataaggttaacttccatcaaatctaccacactaagagttgaccagtcaattctcacaggtaaatatgatatattaagtcattgaatttctgaagaccttcgcatattccatgccaatagagttggctcttgcctcactgtccctttatggtatcccatcttaatcctctctaagatacttatttcttagtgctttagtctcgctccattgcccaggctggagtgcagtggcgtgattgcggctcactgcagcctccgcctctcaggttcaggcagttctcctgtctcagcctcccaagtagctgggactacaggctcctgccaccatgcccagctaatttttgtatttttattagagatggggttttaccttgttggtcaggctggtcttgaactcctgacctcaggtaatccacctgcctcggcctcccaaagtgctgggattacaggcgtgaaccactgcacctggctgccgatacggttttaaaggcatgatttaaaaacaaaacaaaatggctgggcacggtggctca

SEQ ID NO: 71439 - DNA, 1314 bp, Homo sapiens
tttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaa

SEQ ID NO: 71440 - DNA, 1347 bp, Homo sapiens
aagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagt

SEQ ID NO: 71441 - DNA, 2152 bp, Homo sapiens
gtgcccagctcaacgtggcctgtttaacttgagttttacattttttaaattccccttagagaatgatttgatcagattattaattgctcatatttcagagaaagcacgagaaaatatagttttgacatcactttctgtaattttttctttttagaggaggttttacaagttttcatttgcaatgaaaacacaagcctaaatcttacttttccaaactgggcttctgaattataatttgtgaatgcaaatcaagcagtggaaaaattatctttaagaaaatagcttatgtcgctttaaaaaataaaattaatcctttcctaagcatgcttccatctgtattgtctagggaacatcaattcattcagctctgcgggctccttactgtatacatatagttatgcagcttcatagaacatgagctattgccacaataaaaataagtgggaaggagcagagaagcagtttgtcttattttactcgggaaatgtttatgcaactctgaaatgtgagtttattcttcccaagcttttgtgcttagctctaaggcaggactacctaataccactctcacagccagccatttgaaatttgggattctgagcaatctaaagagtaacttgtctctggaactgaccttttgctgaccgggagtcctcataacttggattttgtgtgggttgttgtgtctttggtgccactgctgctcattcattcagcacctcagtgatgctgtttttcatactgttcgattggtcgggggtgtgatgggcgaagcagtctaatataattaagctagttagggtaagggacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgtgagtaaccctcctcctcatttaaaggatctggtgtggcagtttagtatttgtattgatttgcagcatgtctacaaagttaagacagctttctgaatgtggctcaagtcaacacttattactaaagtagtaaatgtttttaaaacaaaaactttgaaagatgaaccaaaggttataatccagtcatctttttgcatcttctgggctccaaactttcaagagggatttgtgtttgttattcactgtagccagtggtggaagaattgaattaagaatttctggtctttttactgattgatttctgataccagagatgcattctctcttttgtttttgtctaatattggctctggcatcaaattgtttggaattttttccagtatgttgtcccagaaattctgttttcattattaaacaattgcgggggggcagggggcgggaggaatcaatagtggcgaccataccctgctctaagagtgttttctctttgggcaggcataaagatgataaaccagtgaattgtcaccagtatgatggtctggtagaattagcaacaatttgtgctctttgtaatgactctgctttggattacaatgaggtaagtctcttcataaattagaaggaatggctgttcctagttcaagggtggggtgggtggaatgaaagtctagcctgccttcctcccttttgaaagtcaagggtgcctgattttgtttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtc

SEQ ID NO: 71442 - DNA, 1187 bp, Homo sapiens
ttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacg

SEQ ID NO: 71443 - DNA, 1156 bp, Homo sapiens
gaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaact

SEQ ID NO: 71444 - DNA, 2173 bp, Homo sapiens
aaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttcccc

SEQ ID NO: 71445 - DNA, 3932 bp, Homo sapiens
tgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgt

SEQ ID NO: 71446 - DNA, 1049 bp, Homo sapiens
agacttgggctatttagaaatttccatttttgtcacgggcttaactggatggtaccatttgtctgtgtgaaagggtgaggttccttccctgtgggtgctggcatacaggggtaccaaagttcctatttttggcccccacggtttcttttaaggaagagctcctaagaaacacagggctaagcactcccactacttcctggaggtgacgacagctcatgcttttaaaactggtattgcctgttctcctttcttttgggaagggaagaactgtcctgtgatcctcaatcaaccgtgactacacacaattccccggtgccctggcagtcaccatgctcgcctcagcctgccgtgaaggtgcactaacctgttgagggcgttacacatttctatagttactagaacagagagcgccattgtcatcgggtatggggattcaaagattgcacaatccacgccttcaaagtccgggttgtcctctttacactgtaggaaatgactctgcaagaaaatccaatcaaattcctatcagcccagtatatttcccaagtccaggctccaaccccataccaagcctagcacagaccagcctgaatgcagagccagccaagaggtttaccccaatttctcggagaagccctggtccttcagaatcatcttagatgtaactgtttattgtctgagtcttaagatgatttgatagataccgaaaccacagaaaggtcaaggcctcacaacacttctcatgtaaggtacagaaagaaaggtgactgagtaccagctggtagaaggacactcttggaccaccgtcagcagcaatgaaccaccatgcagcagcacccacggtagcagcgccgacgtaacctgggaacaaacacagtgatgctgatgcacttgcctctgcagggctcgctgccaccgaggccatgcaggccagtccccacaaggacgaagatcaaagacatgggacagtgatggtaaccggggcctgtggtgctaccaccacctgctcacgcctggtagccagagcaactagaccctggtttctgaag

SEQ ID NO: 71447 - DNA, 1952 bp, Homo sapiens
ggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaattctcagtgtggtggtgactgttctgtgggagggggactgatgggcaccaagggcctccactccgcacccgggcctgcccctctacagggaagcaggggaggctcagtctgggcagggtggccatgtgactagaggggacaggaacctcttggactcgacttcacagtagacaggctgactggcagcaggtccgcccatgtgaagcccaccctggctccctaccctttaaggatgggggaagctgagtgtgtgttaccagtggggtcttaaacacacaaggcctcactcgtcagtgtggtgaagaaagccaagactccgcgctctccattgttagcagcctggaaagatctggagactagcaatggagagatgtttcttaggctgttcagatccaaaacttccacattccccgttgttgataggtatgggatggagaggtgaacagaactgaagcagctgttggaattcatttgctggtta

SEQ ID NO: 71448 - DNA, 1002 bp, Homo sapiens
gctcctgaaatgctgctatgtttaattacatcataagaacatgggacacctatactcagagaaattcctattttttgtaaccctgtagctctaaaacccaactttctgggaattccatttgaatttacctggtaatgtttgtttgccactttttcatttgtgttatctggtagccgcctctagcagaatgctaggggtaataggtatgaaaaagtttaagaaatttgtggagaaaaactcaaattgagaactctaaaaattaggaagagactcctttttgcacttctggtggtggactccctcaacccagccttggaagcctgagttgtttggagaggccaggctttagcacattttttgggactgtgtggtcatttcactgccgggccagggagatgacgaatcagccagcaagagcaaggcagagattcaggcctctcctttgttttgttgtcccctagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttg

SEQ ID NO: 71449 - DNA, 1021 bp, Homo sapiens
aaagttaagagcccatttaaaacattataattcaaactgcaaatttcttttttttttttttttttgagatggagtctcgctctgttgcccagactggagtgtagtggcacaatcacggctcactgcaagctccgcctcctgggttcaggccattcacctgcctcagcctcccgagtagctgggactacaggcacctgccaccaagcccggctaattttttgtatttttagtagagacggggtttcactgtgttagccaggatggaaaatttcttaactgaatagggcttcaggtgtgcttgccctcgctttgtgttgcaccagtgttctcttgaggatgtctgcaaagagatggtcagaatggtagttgtggtttttttgtacatgacttaagtgagggtcttttttattcccccaggcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaaggtaggcactagcctcccttgggggaaggccactgaggagggtagaggaggcagtgagctgtgtcacaggagttatggaaacacacacacactttgtgtccatggttgaaagcagaataataatagtaatggtagaagagttatttgtgaattcatgacttctaaaaattttttcttaaaatatattaacaacattagagaactgtttcactcataaccatcccacaccactataacatctgtgttcatttgtatagctcatcttctgtccttgcccacacacacatatttttatagggctgtacctagtatatattttatattcttctttttcaaatcaaagtattgtaagtactttcccatgtttctatctactgtagtcattaagaacttgaggtctgaagttttgaatactaccttcaccacctgtgatcttgggcaagttactaacaca

SEQ ID NO: 71450 - DNA, 1034 bp, Homo sapiens
caatctcagctcactgcaacctccacttgccgggtttaagtgattctcctgcttcagcctcctgagtagctgggattacaggcatacaccaccacacccagctcatttttgtatttttagtagagatggggtttcgccatgttagccaggctggtcccgaactcctgggcttaagtgatctgcccaattcagcctcctaaagtgctgggattacagacgtgaaccactgtacatggcctgttaggcctattctttttcgtggccatcttaccttgggccagagttagtactcgtgggataactccacatccatatgatagtgttggctgtgggaatgggtctgttcattgtgacctccagagtgggcacaatcagggtccaactttgttttgttatgtaatattttaagttcatgtgaattgaccctgggagttcaaaggagctgtgccagtttcagcaacgtttggtgactcagtcacagacattaaaatagatcttacaagatgcagttcctccaaaacatatttttataagcatttaaaaataaacctaggagtctaggagtgatttgctcttaacaggaagatgagttcaaatttgagaaataaaatttggatgttgggaaagagaacaaatctgcttatatagccagagagctatgcctctggatttgttgagggggaaagagtattgtctttgttctgaaagaagctctagcaaaccaaccattgatttcagattaacttcttgatcctgaaactgtaacttccctgtcttcccagctgctgttaatcatgttaattccattatactgcatgcctatttcaccagagctcagggatgcggttgaatagtccgtcctataatatttggacagcggatgtttcccagttggccagtgaggcttcttaagctgccatttggagatttaggtcagggcaactctgactacaccctttgatatttcttacagtttccagttggagcttccttcttttgctggtagagatttaggttaggcaagtgcattctgt

SEQ ID NO: 71451 - DNA, 1129 bp, Homo sapiens
ttggccgggcatggtggcttacacctgtaattctagcaccttgggaggctgaggtgggtggattgcctgagctcagcaggtcgagaccagcctgggcaacatggcacaaccccgtctctactaaaaatacaaaaattagccaggcatggtggcgcgtgcctgtagtcccagcttctcggaaggctggggcatgagtatcgcttgaacccaggaggcagaggttgcagtgagctgagattgtgccactgcattccagcccagggggacagaacaagacactgtctcaaaaagaaaagaaatactaaattatggtttttctctcatgcatcgctcagaatagggaagcagttgccttttagccaagggaagatgtagcccgttgctccttgcatgtggaagagagatatcgtgccttactttctttcttctgctttctgttggtttaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctggtgagagccacaaagttaattcagtgttcttgaggccctttgcttgtctggaagtctgatgtatctgaagtagcaaaaagaaaaatgagatgctttgctgttggtgctgcagccagtctctgggatgtgttagtcttttatactgaatggtcccaaatgtaatcatgtaatcatctctgttggagacctgtaaaaatagaaatctgactgagtttagctctgtgcctgcacaggtagtaacccttgcaaagcaaagcaggctaccttggtgtgtcatttttttttttttttttgagacaaggtcggtctctctctctctctctctctctctctctctctctctctctctctctctgtctctctctctctctgtctctctctctctgtctctctctctctctgcctctctctctctctctgtctctctgtctctctctctctctctctctctgtctctctctctctctctctctctctctctctgtctctctgtctctctgtctctctctctctctctctctctcccagg

SEQ ID NO: 71452 - DNA, 1054 bp, Homo sapiens
cagaacgagactctgtctcaaaaaaaaaaaaagaagatgaggccaggcacagtggctcacacctgtaatccaagcacttccagaggcggaggtaggaggacttgaggtcaggagtttgagactagccttggcaacatagtgagacccctgtctttacaaaacggcatggtggcacatacctgtagtactcagaaggccaaggtgggaggatcgcttgagactaggagtctaagactgcagtaaatcatgtttgcaccactgcattgcagcctgggcaacagagcgagaccctgtctcaaaaaaaaaaaaaagaattgctgggtcatatgataactctatgtttaacgttttgaagaactgtcatattgttggaataacgtttcaaagaaatatttccattgtcttttagtgtcttccatctgaaattgaagtgaaatacaaaatggctgaatgttatacaatgctaaaacaagataaagatgccattgctatacttgatgggatcccttcaagacaaagaactcccaaagtaagttgaatgtttatgtgtttttctcctcagctctcctaaccctgctccctctctccatgttttctcatgcattaaggagtccgtgtgaacattttacccatgattctaattctcattttcttcctcttcatggagtgggggtgggggaccctgaaaatccagctgatgaaaatgatagctggagaatactacacatgcttattctttgttttttcttttttattttttatgtttaacttaatttaatattttttgagacagagtctcactgtcacccaggctacagtacagtgttgtgatcctggctcactgcagcttcaacctcccaggcttaagcaatcctcccacctcagcctcccaaatagctgggattacagttgcatgctgccacacccagctaatttttttttttttttttttttttttttgaggtggaatttcactcttgttgcccaggctggagtgcaatagcatgggggctcactgcaaagttgcccaggctggagtgcaatagcatggggg

SEQ ID NO: 71453 - DNA, 1716 bp, Homo sapiens
atccacccgcctcggcctcctgaagtgctgggattacaggtgtgaaccaccgcgcccggcctttttttttttttttttttttttttaaataaagatggggtctcaccatgttgcccacactgatctcgaactcctgggctcaagtgatcctcctgcttcagcctctcagagtgctaggactacaggcgtgagccactgctcccagcctccagattttattatttttgatcaagcaactcaacttcatattgttgaatgctgggaacacacacacacacacacacacacacacacacacgcacacactgaaaatagttcagccgtcctctaattgggactccgagccagggctatttctcgcgctggcgcggttccaagaagcatcccagccatcactctttcacctgctccttagagaagggaagatgagcgagtcgagctcgaagtccagccagcccttggcctccaagcaggaaaaggagggcactgagaagcggggccggggcaggccgcgcaagcagcctccgatgagtcctgggacagcgcttgtagggagtcagaaggagcccagcgaagtgccaacacctaagagacctcggggccaaccaaagggaagcaaaaacaagggtgccgccaagacccggaaaaccaccataactccaggaaggaaaccaaggggcagacccaaaaaactggagaagtaggaagaggagggcatctcgcaagagtcctcggaggaggagcagtgaaccgtgcgtgccgcctgctcctcactggaggagcagctgccttctgggactggacagctttgctccgctcccaccgccctcgccccttccgcaggcccaccatcaccaccgcctctggccgccacccccatcttccacctgtgcccacaccaccacactacgcagcacaccagccactgcagggctcccatgggctgagtggggagcagttttcccctggcctcagttcccagctccccccgcccacccacgcatacacacatgccctcctggacaaggctagcatctcacttagccgcaccctgcacctgctgcgtccccactccgttggtggtggggacattgctctctgggcttttggtttgggggcgccctctctgcttcactgttccctctggcctcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacacttttcatccttccccaccttccctagtccctgcactaggttggacagcccccttcggctacaggaaggcaggaggggtgagtcccctactccctcttcactgtggccgcagcccccttgccctccgcctgggatcgagtacatattgtggtgatggagatgcagtcacttattgtccaggtgaggcccacgagccctgtgtccgccgcctgaggtgggctggggctgctcccctaaccctactttgcttccgccactcagccatttccccctcctcagatggggcaccaatagcaaggagctcaccctgcccgctcccaaccccgctcctgctcttccctgcccctcaaggttctggttccatttttcctctgtccacaaactacctctga

SEQ ID NO: 71454 - DNA, 1043 bp, Homo sapiens
cactgcagccttcgcctcctgggttcaagtgattctccagcttagcctcccacatggctgggactacaggcgcacgccgccacgcctggctaattttttatattttagtagagatggggtttcactgtgttgcccaggctggttgcaaactcctgagctcaggcaatctgcctgcctcagcctcccaaagtgctgggattacaggcatgagccaccacgtccagccaacatcatttacttaattgtaagtttatataatttgatttttgagaagagctgtgtttaacaaccagcttgaaaaatgcctcaaaatttaacaattggttttcttgagccagaaagaaccagccctcgcacctcaatgctgctatcccttctccctcccctaattaatcttgggtggtttactctttttttcctttaagggaaggttgtttgccacagtgacatttgctctttttctgcttctgtgttcttcctgggcttgccattacaggcttaccactcttctctcatggatcctgataccaaactcatcggaaacatggcactgttgcctatcagaagtcaattcaaaggacctgcccccagagagagtaagtctaaacccattattttcaaattttggtacgaaatgcctaacaatcttctgaaatgatcaaatcagaaaaattcttagctcagtcttctctctcaaattgcccttgtactttgcttggtagatactgtggtctagacctttcaagatagtggttatatgttgcatttaataggaaattgtattatttcttctgacttctccaggaaactcttttgagaaaatggaggaaatgtgcttaattctggacactgtttatcagttctttcaaacaaatctaatgctgttacgtctagaatgccacatgcccatcctttctgtcatcaacctggaaaagaacaacaacaaatattttaacctcttcctcgtctaaatctacttcctttattcattcttcaagatcttcatttttagcaatacctcaatcttaaatctgaagtgtact

SEQ ID NO: 71455 - DNA, 1041 bp, Homo sapiens
aagcactatcacaggaaattagccaagaatcgtcttgaatgtaaattcaaatgagaaatgcttctgggatagaagcacattaatttactacataactggaaaaaaatctgtcaatcatgccttttcttactattaacagttacctataagcagcacctggagctggtgctgggtaattagttccacatagggtattacctgaaaaatatataaacacatactagttctgactgaggggaaatgaatatattttctattttgtgtttccattgtgtcaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagatatgtatgtgtatatataaaagaaacaaaggtttttaatgattcttggacctagataacaagtacactgcagtgtctaatttgattcattttaattaagcaaaatgtggccaagcgtggtggctcacacctacaatgccagcactttaggaggccgaggcaggtggatcacctgaggtcaggagttcaagaccaacctggccaacatggtgaaagc

SEQ ID NO: 71456 - DNA, 1048 bp, Homo sapiens
tggaatgctcttccccttaggttggcaaactccttctcatatactcatatctcccctactcagagacatcatccctgaccatcctacctaaagctttgtttgcactgtacaagtcctggtagagacactgtgttaggtgttacactatgtaaccagaactcttccctttaaataccgcttgtcacatttagaacagtaaggagccttagtgattatggaggacatcccagttagagacacgaaaattgaagggcagagtggagaagtaaattccccagaggtacccatgagtctaagtcaggtttgaatctgcagcccagtcaggtatctttttcccttgttgtcagtcagcctcttggttgatgaaggcatagttttgaccttagtggatagtattccagagtatggaaggtagcactacactacctgttgctttaacctctcatgccttgtgacattacagagcacctactgtgccaccatggtccagcactgtgaagccctcaaccggtctgtccaagttgtaaacctggatccagcagcagaacacttcaactactccgtgatggctggtaagtcctgagcaaaggctccccccaccttcaggaacagtaagggctggggaggcagtgagtactagctgcttagcactgatacttattatagtctggatccctggtgttatggtaaatagcatgagcttgtcatttggtcacatctgttcatggtgatatgtgtgacagtatcctttcttggtctttgatgtaagatttaaaagtaaatggggccgggcgcggaggctcatgcctgtaattccagcactttgggaggccgaggcgggtggatcacgaggtcaggaatttgagaccagcctgaccaacatggtgaaaccctgtctctactaaaaacacaaaaaaatcagctgggtgtggtggcatgtgactgtaatcccagctactcaggaggctgagaaaggagaatcgcttgaacccaggagacagaggttgcagtgagccgagattgcgccactgcactccagcctgggcaa

SEQ ID NO: 71457 - DNA, 1106 bp, Homo sapiens
ccgcagatcctcaccttcccgctgcccgcggggcccatgaccagctgcgcataccgaggcatgttggctcccggagccgcccgccacactcccttagccttcgcgcgacgcccactgagctccgggaaagtgaagtgcgaaccaatcgcaatccacattctttctacgcctccagttctaccacacctcctactacggggcagcccgcgggccaaatcccgtgagaaacgcgtcctgagaaaaaaggggaggggcgagggagaggatttgcgcgtgcgcaaaagtagttgatggaaatcggccgttgggatgctgtctaagcttggatacctgagtaataacggacaacagataaagctccgcatccttgcgccacgtgcttcggtccgtggtttgcgtgcagacgtttgacctgtatggtgaccctcgcgatttgcaaatgtgctgaggatctggaatactgaagtggaaggcacctcttgttttggggagcatgtatatttccctcctgtgacgcactgcttccacagagaggtgcaaacgtgcaaacgctcagcgaccgcagcgctcctgcccctcccccaccgtaactccggggtcgcggatctgcccgccccgctctcccgaagctgttcgggcagtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccagggtccggggtccgactggacggagcgtagctcttctgcagagccgcccgctgtggccgggaccgagggtggcggcggcgggtgaggttgggggccccggggtaagggtggcagcatggggcccccgggtcgtgaggcccccgggtcgtgagccccgtggaggagggctgcggccgacctctcgtctcgggggctggccccggtgccctcaagtgagaggcggggagcagttttgttgtggacagagggcagaggggaggactgcctcgcggttgagggagggtctctgagggaagcttcggaggagcgt

SEQ ID NO: 71458 - DNA, 1073 bp, Homo sapiens
tgctatttccatttttcaaggtttaataaaagttttaaaaatacaagtttaggggccgggcacagtggctcacaccctaatcccaacactttgggaggctgaggcaggtggatcacctgaggtcaggagttcaagaccagcctggccaacatggtgaaaccctgtctgtactaaaaatacaaaattagccagcatggtgctacatgcctgtattcccagctactcgggaggctgaggcagtagaatcacttgaatcctggagttggaggttgcagtgagccgagatcacaccattgcactccagcctggtcaacaagagcataactccgtctcaaaaaaaaacaaaacaaaacaaaaaaaaaacaaatttagcaaggaagcatactagagtaatatataacgtaaagaatcctcttgttagtgtaactactcccaacctaatctagtccgagagtcccaagttatttatgtggtaatttcataagatagggaaaatgtgtatttacattttaaagttgtattcaaatagcaaatatttattgatcacctactttgcaagtcagagcatcatctctgtcaaatgctattctgtatctggatatttccaagcttcccttagcccaatcaaaaaaatacttgtaggatattcttttttttttgagacggagtctcgctctgttgccaggctggagtgcagtggtgtgatctcggttcactgcaacctccgcctcccaggttcaagcaattctaattctcctgcctcaatctcccaagtagctgggactataggcacacaccaacatgcccagctaatttttgtattttcagtagagacgggggtttcaccatgttggtcaggctggtctcgaactcgtgacctcatgatccacccgcctcggcctcccaaagtgctgggattacaggcatgagccactgcgcctggcccttgtaggatattctaatattgctgttttaggacttactatgaacacagaaagaagaaatacgatgcatttgtcagatttaaagaaaagtaattcaatattgaatgcaagaaaagttttaattgtatc

SEQ ID NO: 71459 - DNA, 1016 bp, Homo sapiens
gagtgtagtgttgcaatcttggctcactgcaacctctgtctcccgggttcaagtgattcttgtgcctcagtctcccaagtagccgggattataggtacccgccaccacgcctggctaattcttgtatttttagtagagatggggtttcaccatgttagccaggctggtattgaactcctgacctcaggtgatccacccacctcagcctcccaaagtgctgggattacaggcgtaagccactgtgcccagccacatgtgaccatttaaataaatctagccattttggcaatcttttggtaactgttcatgtgatatgtaacagatttctctgaatccaaatagtcatcttaaattgaaatttatagtgctgctgctttgtgctacaaaacactgacattatttattttttcttctagaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcatttatactttgataacctgtatttaatttaaaaaaaaacataaaaatgaggaaccaagtgaaactacggatataaatattaaagtggacgagatgacctttcaga

SEQ ID NO: 71460 - DNA, 1024 bp, Homo sapiens
taaaatatttataaatgtggggtgggcacagtggctcaggcctgtaatcctagcgctttgggaggccaaggcaggtggatcatttgaggttaggagtttgaaaccagcctggccaacatggtgagactccgtctctactaaaaatacaaaaaaattaggcgggcgtggtggcgggtgcctgtaatcccagctacttgggaggctgagacaggagaattgcttgaacctggcaggcggaggttacagtgagccaagatggtaccactgcactccagcctgggcaacatagcaacactctgtctcaaaaaaaaaaaaaaatgtataaatgtgtgtgttgtggggtactacatcaaaacatccataggagattgaatatttaaggaaactgatttttttaaacatcagtatctctaaaatacatattttcttacgtctttttcttatgttagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacgtgagtagtatagaatttgggaatttgggggctttagtaaaataattgcatgtgtgacatttcgtaaaagaaatgtggctgggcacagtggctcatgcctgtaataccagcacttcgggagaccagggcaggttgcttgagcccaggagtttgagaccagcctagacaatatggtgagaccctgtctctacaaaaaaattttaaaaattagctgggtgtggtggtgcatgcctgtgatcccagctacacaggaggctgaggtgggatgatcacttgagcctaggaggttgagactgcagtgagccacgtttgaggctctgtactccagccagggtgaca

SEQ ID NO: 71461 - DNA, 1504 bp, Homo sapiens
atatgacagtgaggacttctaataatgaaggaaagtgaagatatcaaagattataattcaaaagcacacatttacctgatgaaactgaaggctgttgtatatctctgtaacgtacacctaatagtttgaagtaacaaaaatatcaaattttggctattatgcttgcacatagttgtcagtctagtacagataaattacataattaacttttttgtctattaacaatttccttaaatatttctgggattaatatatcatttcatgttacaactgcagaaatatgaattaccatatcagtctttaaaaatgccaaattctatagggcccagtagtatactttacattttgtaatttttaaaattcagtgtatttacaggtctctaaatgaatcactttagaatgcttgatttcactcttggtaaatagaatgattacctgtattttatatatgcaactgtttacaaccaaaataagattgatttagaacaaagtacattaccataagtatgtctgtttaaattgtcatgatacaatcaatgatgaaacctatcccaaagctgatgacctgaagaaaaatacgtacagattcagcttctgagattaaataaatagtcatgataggaaccctatgaataatttctgggattcgggatctcttatgagacttaaaagggggcttacaagaggagactattttgttttgatattgtgtttaacattatgctttatctcaccttgacactttaaagttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgaggtgatgtatttccctttcccttctcaaatatctccctttcttgattattacttacataagctttatctttagaccagggtttctcaactggtaaggtttttttttttttccctttttcttttccaaatgtaaaattactatacatcatgcccctcccttactatttgaaaatcactgatttagatcacctagtaaacattaaatacttattctaactaaatagatactgaataaaagtggctttgttactgttttatgctgtcgtttaatttataaagttttttttgtttgtttttgttttttttgagatggagtcttgctctgtcgcccaggctggaatgcagtggcacgatcttggctccctgaaacctctgcctctcaggttcaaccgattctcctgcctaacctcccaagtagctgagactacaggcacacaccatcacatccagctatttttttttttagtagagatggcgttttgccgtgttggcaaggctggtctcgaactcgtgacctcaggtgatcctcccgcctcagcctcctaaagtgctgggattacaggc

SEQ ID NO: 71462 - DNA, 1090 bp, Homo sapiens
aaccaatgagagcagagggagacagaaattgccgtacggaggcccgcacggacccttctccgccgtaaagccgtttgggaacttgtggaggcggggtggtagagtgcagagacgagatcgcgaagctttgaaaagcgcgggcaacatccgggcacctgggccgtcgagctgaggcgcgccttccgagcctgctttttagggcggatggcagccatgctgaagtgcgtgatgagcggcagtcaggtgaaaggtggagcggcctttgttgtcttcccatttagcagagagaaaagcagacgttaataggtcgtccctaccattgtctaatttttcctctttgcctttttgcgcaatgactgaggacgcacgccctggccacagccccacccactcaagtccctgttaacttctgaggggaggatgaggacccatctcgtgtgacttagaggcagatgtaatatgggtggtatccgggaaatagagttgtaccatcgggccacaaactcgggatgctgaggactgcatggggaagagttgagagaaaaaaataatgcttggacagtaaaagtatttttgtgccaagagaacagcattaacctggttttttttttccccagattctaccatttttaaaaatgtatgaacttggaaaagtcactaaatctctttggggctcagtttctaaaacggaaacaggggtaatgacagcaccttcgtcacagagtttgtttggaggcaatgaaatggaaatgcgtgtaaagagcccagtaatagatggaatgtacaagaactattagtgttgtaaacggcgctttcaaaatggaagttaggccgggtgcagtggctcacgcctgtaatcctagcactttgggaggccaaggcgggtggatcaccttaggtcgggagttcgagaccaccctgaccaacatgatgaaaccccgtctctactaaacatacaaaaattagccgggcttagtggtgggcgcctgtaatcccaagctacttggaaggctgaggcgagaggatcgattgagcccgggaggttgaggctgcagtgagttgagctcgtgccactgcactccagcctgag

SEQ ID NO: 71463 - DNA, 1281 bp, Homo sapiens
cccaggctgtagtgcagtggcacgatctcggctcactgcaagctccgcctcccgggttcacgccattctcctgcctcagcctcccgagtagctaggactacaggtgtccgccaccacacccagctaatttttttttgtatttttagtagagacggggtttcaccatgttagtcaggatggtctcgatctcctgacctcgtgatccgcccaccttggcctctcaaagtactgagattacaggcgtgagccaccatgcgcggccaaggtttggttttaggacgtgttggaccaataatgaaggttctgggtgttctgtgaaccatcaccagcaaagacagggatataatactggtcaggtttctgaggagggctgtcacctggagcatttaatgagcaaactttctctttggaatcaacaatgcagttccttttttccctccagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttc

SEQ ID NO: 71464 - DNA, 1179 bp, Homo sapiens
tgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaactaaaacgtgtccatgtcagaattttaactgttagcaggtagtttgtggcaaagatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacatttaaataaactgtaaagatatttaataaatatagtatttatactaatctgtgtgcttcttttggtttgaatagtaactaaatgagacaccagcccttgacattgagtttgttggtcactatcaggtcctcatttccaagcctcctagtcattctagcactgattatatgctgctactttaactggctccagctgcttcactacatcagtttagcttcctcagaaattcatcaaaatggacggacaattaaatgtaaattatagaactttttcccagctgaggctttgcaccttccgtatagtatagagggaagctacaaaaaaaatctgctgtacagtcagtcgtgttgtttaacagagatgttctgacagatgcatccttagcaatttcatcattgtgtactgacacaagcctagatggtctagcctactacacatctgggctatatgaatagcctgttgctcctaggcgacaaacctgtataacatgttactgta

SEQ ID NO: 71465 - DNA, 2535 bp, Homo sapiens
atgccatagctgtttggcagattagaatacaaggctattcctagtttcaaaacattggatatgtctgtctaaattaggattgtgggtatagaagcatgtaactttctcgtcagattcactgtgattgatgtgaacagagggtgtggtggctgtttgaatagagctcctgttgtaaaggagcagggaagatttttttttttaagcttcagtttcatgtaatttcttggagttttgtttaactgtttttttttaatcaaatatttttttctttattctactagggtatactgacaaaccaaaactgcctggaatgcaagcatttgtctcctagtacttaatttaagtacacattttttattgacttttccttttaaaatatactgataggttctcattttcattgtaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaag

SEQ ID NO: 71466 - DNA, 1006 bp, Homo sapiens
tgggtggctggtgattacagtggctcatgcctgtaatcccagcactttgggaggccggggcaggcggatcacctgaggtcaggagttcaagaccagcctggccaacgtggcaaaaccctgtctctactaaaaatgtaaaaacaaattaggcgtggtggtgcatgactgtggtcctacaggcactattttacatgcctgtagtcccagctacttgggaggctgagacaggagaatcgcttgaacccaagaggcagaggttgcagtgagcctatatcgtgccactgcattccagcctcgacaacagagcgagacttgtctccaaaaaaaaaaaaaaaaaaggcggggggggatggaattcggctgtaaagaattaggaataaagactcatttccactaggattttagaggtgtgttagatctgactcagaagaggacccttcctccctccttctcagccacttgtgactaatcatcagacttggttttactcggtagtttcagttaaaaatttgaaacatttatattagaattttcgattaacttttttcagagttgggaatttcagaatgactttttttaaaaattgactccattatgataaatcagtttttcttgcagaaagcttattacattgtaaaatagtgcctgtaggacattttcaactcatctgtaaagggccttcttaactttgtccctcccctgtccttgccacagtccggatgctgctgatagcacgtctttcgatgtccagctaggagacattatcctgacggcaacagatggactctttgacaacatgcctgattatatgattcttcaggagctaaaaaagttaaaggtaattaactcaaaggttagctcttgggaaaagtggccctctctggatagctgagttttatggattcagttgcattatctctttgtagttttggaaagaactattttgtgaatttcaggaaaataataatagctctggtctttcaaataattagagcacttggaaaaa

SEQ ID NO: 71467 - DNA, 1018 bp, Homo sapiens
cttccatctgttttttttttcaagagttgtacacaaaaaagtttagtgagacatctgcctcctgttcctgcccttagccacatattctgtcctcaaaggtttctttatgagcagtttctttagtttctttttcttttttttttttttttttttttttttgagacagagtctcgctctgctgcccaggctgctggagtgcagtggcgcaatctcggctcactgctactgctgcctccctggctctagcaattctcctgcttcagcctcccgagtagctggaattacaggtgtgcaccaccatgatctaactttttgtattttttagtagagacagggtttcaccatgttgggcaggctggtcttgaactcctgacctcaagtgatctgcccaccttggcctcccaaagtgctgggattacaggtgtgagccaccacccacagcccgctatgagcagtttctttgattctctccagatctattccctgcatatagaagcatccatgtctgtgtgtctttctgcctttttttttttacggaaatggttgcacatacgacacaccgtcttcaccttgctttcttcaacagtatattgaagagttttttcccccaatttggagagtcaaatattttgctgcttcattcagttatgcaacagatatttcttctattttttttttttcttgagatggagtcttgctctgttgcccaggctagagtgcagtggcgccatctcagctcactgcaaccttcagctttggggttgaagcaagtgattctcctgtgtcggcctcccaagtagctgggattataggcgcacgccaccatgcttggctaacgtttgtatttttagcagagatggggtttcaccatgatggccaggctggtcttgaactcctgacctcaaataatctgcttgcctcggcttcccaaagtgctgggattacaggggtgagccaccacgcctggtcaagatatcaagatatttcttgaagacgtgttacatgaggcacactaata

SEQ ID NO: 71468 - DNA, 1029 bp, Homo sapiens
actgtggttctcagcaccgcttttcttactcatctttgcctgcttgtgcctctccaaacacgtgagaatgattagctcttctcccaatattaggctgctggggcctgagccacgtgcacacatcaggaatttgaggaggcaaaagaggagggtacactccaagcccagatggttctgtaaggctgggcttatacttgttggtgctgctttggatactgaagctcagtcactcaccaggactgttttgattccaactcagcgagttactgtcgcagggtagcaaaggatagcctggcttcgtcagtgagtatataaggagtcacatgagtccttcttgcagcagaattttcaaggatgtgctactcgggttgtttttctttctcagaatataatcccatgagttttcagaagatgttttgggtggtgatctattaatgataaaaggttagagttgatgtgcactgagttaggaaggaaaggtaatgggcaatctttgtcctactgtaagctatggagcgggttatctgacagcactaccagtgagttacagtacccgtgctttgcttttcgttgacacttaatggctagcatagtatgagttagtactaacgcatatactgtagataacaaggaaatggaatttctgggcattagcatgagaaagacatgtatatttttaagtgtttttaaattactttgttaggacaaaattaataataaaaattacccatgatcccactaaaacaactattaatatttgagtgattatgctttcagattttttttctgtgtgtatgtgtgcatagaataatggtaacttgaattgagtctactatgtgcccacaacagccccatgaggtaaatacataggtacttaattttattcccctccaccttttttttttttttgagacagagtcttgcactgttgcccatgctagagtgcagtggtgcaatctcagctcactgaaacctctgccccccgggttcaaacaattcttgtgccccagcctccgaagtagctgggat

SEQ ID NO: 71469 - DNA, 1015 bp, Homo sapiens
gttgccgcttttgatgttctttgtgatctccagctctgactgaattgtatcgtcactagcatcagcactttgcttaaaaatcaattttcattcttataaaagacaaagtattaatgacacaaatatgtctatacacagatgctaatcctgctgaaattgaactcttggctggtaggcaatgccaccctgtggtagctcaaaagtttattcatcaatatatgaaaggccaaattctaagtagtgaatgtggcttaggagtgttagtgtagaatacattaaacgtgagtgctttttattctgaattttggagtgaatgtatgtagtagcatgtagtgaaattaactgttaggagaaaacagaggtaagaattcctgagaagttggtaagattgttcttttactgtaatttttgttttttcttcaggggttgcagatggtgtaggaggctggagagactatggagttgatccatctcaattctcagggactttaatgcggacgtgtgaacgtttagtaaaagaaggacggttcgtacctagtaatcccattggaattctcaccacaagctactgtgagttgctgcaaaataaagtccctttgctcggtaagtgggtatcttatgtgttttcctctaaagaagccccctagatagttaaaaacaaaaccaagaaaatcatttatcggaccagcttttttctgaggctcttcctactaagcagagtgtgatagagaaactataggctaaccgctgggcgcagtggctcacgcctgtaatcccagcactttgggaggctgaggtgggcagatcacctgaggtcgggaattcgagaccagcctgaccaacatagagaaaccccatctctactaaaaatacaaaaattagccaggcatggtggcgcatgcctgtaatcccagctacttgggaggctgaggcaggagaatcacttgaaccccgggaggtggatgttgcggtgtgccgagatggcgccattgcaccccagcctgggccacaagag

SEQ ID NO: 71470 - DNA, 1055 bp, Homo sapiens
ccagaaacattgctaacagcatttggcatttgaggaagatactgttgcaggccagaaaggagtgaagtgaccttttcagtaacttaaccttcaactctgcagtttgtggaaggcagaccagtgattcataccaagtttgtaatttgcacaagttcccaagccacagttgagccagaatagataattccacattaagtattggtatttaaacagaattattgaagttaaaggaagaacatttttatttttaaaaggatgactttaagtttctttgccttcacacaattgtttcctaatcctcatgtcagcacttttcactgctttttaagacaaggcaactgcccagaatagtctggaaattatcttctctagttaatgaagtattctagacataggtgtaagtgtatgtggaggctcattaatttgattaattcttaagttgtctcataattactaagctagcaaggaatagctaactattttgtttggaattctcaaacacaaaatgaaccgcttactacagctttgattttgttgtttgagttttgcctatagtttccattttcacacttttttttttttttgagacagattttcgctcttgttgcccaggctggcgtgcagtggcgcagtctcggctcaccacaacctctgcctcccaggttcaagggattctactgcctcagtctcctgagtagctgggattacaggcatgtgctaccacgcctggctaattttgatttttaatagaaatggggtttcaccatgttggccaggctggtcttgaactcctgacctcaggtgatccacctgccttggcctcccaaagtgctgggattacaggcgtaagccacctcatgcggccattttcacatgttttattacagggttgaacttttcagtccatcctttgagcttcattaccttcacttttgaattaacttctgcttagagatcttgttcttgacgtagtcttgatctctggagaatcaaaagacacagatttcattgtgattaatgtggaatggaaacttcttttttcttcttcttctttt

SEQ ID NO: 71471 - DNA, 1062 bp, Homo sapiens
gttcctcacaccggccctgtgaaatcgaggatacgactccattcacaggtgaagctactgaagctcagagagctgcccaaggccatgcttagcacatcttgttctggggctggagtttgaacccagatctgcctccagagcctgtgtccttgctcagtatcccacactgcctttccagttagaaaagatcattttagattttcttttagggaggtgattttggctgattgtgacttctacttagttattagctattgcttttgttttaattaaggggttttgcttaactgttaactattagttaaaacaaaaacttaacaagccttgttgagtttggtagcctcaggccagcctttccttccagggactcctaaatgccgtaagctctgcactgcattgtttgcgctgattaatggtgagaggttcctggcatgaatgtaatagacatttacctggaggtcaagtttccctgctcttggaaccctcacctgctatgacttgtactttattcatgtaagtcagaatcctagggaattgctcaaaatgcctgtcttgtcagcctcctctcctacaactcattttctttcatccttcaaggctcatttcagacacttcttcattaatccttttgattccttcagctatgcataatctgaccttctttgcttttgtttttattggtgcatattttactttattatagtcatatatcttgaatctccctaaactgtcctccccaaccaaaatcatcacttcattttaagttcccatatgcaggaaatattttattacatataaatctttagctccctttcaccatagtgtcttgcatacagtaaatgtccaatagaatgttttgaatagttttaatattaaatgtgagtatagaatgtggtttttacctgatttacataaatagttcttgtcatccttcccatgaaagtaacattactcattgctaaaaaattggaaagtatgggccaggcacggtggctcacgcctgtaatcccagcactttgggaggccaaggcgggatggatcacaaggtcaggagttcaagac

SEQ ID NO: 71472 - DNA, 1045 bp, Homo sapiens
tgggtgtgtgtgtgtgtgtgtttataacttctttattcactctgactcataactgatgtgcaacaaaaactcctctgcatgctaaaccacagtttagagaaaccacttattttaaaaatggcagcctggtctgtgccatataaattttgacctctgaatattgagttgtaaagtatttattatgaaactgtgggatgtttatttaagcttaaacttgaaacctaaaagtgaaattaaaataatttcatatcccagcctttggatctgattttgatcgtggtcaggattttgaagtgtttttgtgagtaatgtcagtcttaaaagtagttgtcttgaggtgtaaagatcatatgaacaaaattaagatctaaattatatttaggaagtgaatggatgaggtagaatttggtgttttcaaacagtcatgatcattttaatgtacttatagaacctctattctgaaagtgagttgtccttttaaaaaagtagtcaccttcagagtgtgtgtgtgcacccactgacttcagtctttcaagaagtccttgttggaattttcctcagctagatttcaagccatgtcaggacaccactctcattatattaccataatttttttttctttttttttttaattttactttttttaaattccaggatacatgtgcaggacatgccataattttcttaaagtcagattccagcatcatctacctgttgatagcaaatatgaccctgagtgaattttttttttttttttttttttgagacagagtctcgcccttgtgcccaggctggagagcagtggcgcgatcttggctcactgcaacctctgcctcctgggttcaaacagttcttctgcctcagcctcccaagtagctgggattacaggcacccaccattacacctggccaatttttatatttttagtagagacggggtttcaccatgttggccaggctagtctcgaactcctgacctcaggtgatccacctgccttggcctcccaaagtgctgggattacaggcgtgaaccacgtgcccagccc

SEQ ID NO: 71473 - DNA, 1040 bp, Homo sapiens
attatgtgactccattctggtttcttgcaggtttttgtttaaaggaatggtggcgttatttatttaaaacaggctttaaaagatacggttaaaacagggtagaaaaccctcacgtggcccacctgcaattcctactaacttaacataggtcccgcgtctgaggaatccccctaggtcctaaatctttggcagccaagtcaaaagtgactacgactccgggactataattcccaagagacactgcgtccgcaccctctgcgcatgttcaaccttggtgactgcataaggcagcgagcccaaggggctgggcttgggcctgagcggtgaatcggggcggggctaggggcagggccagggagggggcggtgctgccggcaccgcccggaacacgctagtggagcggaagatggcggcggcggcggcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcggcggcgatgttctcggtcctctcgtacgggcggctggtggcccgcgccgtgctcggcggcctctcgcagaccgaccccagggccggcggcggcggcggcggcgactacggactggtgacggccggctgcggcttcgggaaggacttccgtaagggcctcctcaagaagggcgcgtgctacggggacgacgcgtgcttcgtggcccggcaccgttccgcggacgtgctcggtgagtccccgacccggttcccttgccccagcctcggatccgcctcccggggactccccgcgcggggcttccccagttcctcccggcggcgaaaggagccagagcgctcacatggagggagcgcttactatgcgccaggc

SEQ ID NO: 71474 - DNA, 1117 bp, Homo sapiens
tgaaaccttgtctctactaaaaaaacaaaacaaacaacaacaaaattgtatatctgtgttgtaacttattttacagttttacctagattaaaactttttagttgccattggaaaattgaaaaatttcttctcttttgtatttttttttccttgggaatgttaatgatttctagcgtttctggtgaaccaggctgttaagtgcaccagaaaaataaatttagaacagtgtgaagaaattgaagccctcagcatggctttttacagcagcccggaaattctgagggtaagaattattttgaagtggaacttactcattaggtatgtttctgttctttctgcgcttttaaaatatgacaagtacagaataatttcagtacatgattgacactcgagtttaaatttctccagtacttttatatcagtgattattgaaataatcctttaaataatttttatttttttatagttagctcatattttgcttttgttgatttttttctttcattcattttgatggtaaccaatatctgtctcctgaataaaaacaaatctttacgaataactaaaaactttagaaatcataaaaacatcttcatgtctgtgacagaaataatcttattagccccaaaaagggctccctctcagaaacaggccagaaaagaagaggaaatccactttctggttggcagatgacacaggcagtcaggaaagaacaggaaatgggagaagtgggcacaatggtgaaggggccccttctctctggttacagtgactgaaccctaaactgaagaaatgatgaggccactggcccacatgacagatgagatggagggtggcaagggaagaagacctttttcaatgattaaaaaccatatgataggctgaggcaggaggatcacttgaggctaagagttcaagaaccagcctgggcaacataatgagaccctgtccctacaaaaaataataaaaaaaaaccttttgtgtcatggttgtgcacacctgtggtcccagctactcaggaggctaagacaggaggatcacttgatcctaagaggctgaggttgcagtgagctgaggttgcagtgagctaaggttgcagtgagctatgatcgcactc

SEQ ID NO: 71475 - DNA, 1051 bp, Homo sapiens
acaaaacttctgttaatgtaccatgacatcatttggccttcagttggcacaaaagcattatttagaatctgcctcagcctttttctcatttgcttattatgatacttgtacaacttcaagccagcctagtcataaacataaatacagccaccaaatcatgtggcactcatcagttaaatgaattaaaatagttttttaccaattatcagagagaacttgcagctttcaaaattccaaagattgtgcaaggatcccctacaggttggagaaacacttttgtaaagaactttttcccctgtatcagaaggagtagctaaagatactaccaggtgtagacttcagaagattgtcattatactcagaggcaaaataatttgtccagataatagattttatctgttcgtcatagcgttaattaccaaatgtttacattcaacatagcttgtgttaatatgctaggggggcttttacagttgttggggcagttgtgaacaccatctgaacagaagatctgaatgaaatttaaggactcttaagatttggggttgagtatatttcctaaattaactgtcttttgaatctccagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccct

SEQ ID NO: 71476 - DNA, 3057 bp, Homo sapiens
cttaatcattatcaaatctggaattctggtttcatgcttctgtggaatttaaaaagatttcatgtgaaaatgtaagtcattgcttttagatcagatatgtgtctctcctaaaccccttccctctaggagagtctttctttaaagagatggggtctcactatgttgcccaagatggtcttgaactcctgggctcaagccatcctcctacctcagcctcccgaagtgctgggattacaggtctgacccaccacgcccagctcttattttaaaagagccttaaaataagatggttttattaagattcttaataaaaacatagtttcatttgcttaaaaggcacccagaatcttgctttgggggaagttaatcctgagagaatgagcctacggaacagtaatactctctttttaatgtaatactctctttttaatcacaggtaaaagaagatacaacattaaactatggaaaactttcacagactgttttaactgtttaccgatagcagccatcgtggatgagaagatattctgctgtcatggaggtaggtgggctgatttttgttccaaataggttttgatcccttccaaagggtgaacactttaacatttgtgagttatcattgggatgactttctctgacagaacactctcctttgttgatgtgttgcattgcactttcactctgatacagccaggatcatttggataaaaatcttaaggaattgatttattacagggaattctagactctgtaagctaggtttgaaaatagagcagaaaatttttatttttattttattttttgtaaggatgagttctcaccacgttgcccagtctggtcacaaattcctgggctcaagcagtcctcctgcctcggacttccaaagtgctgggttacaggtgtaagccactgtgcccggcttagaaaagtttttggttttttttgtttttgtttttgttttttgagacagagtctcgctctctcacccaggctggagcgcagtggcaccatctcggctcactgcaagctctgcctcccaggttcacgccattctcctgcctcagcctcctgagtagctgggactgcagccacccgccaccacgcttggctaattttttgtatttttagtagagacggggcttcaccgtgttagccaggatggtctcaatctcctgacctcgtgatctgcccgcctcggcctcccaaagtgctgggattacagacttgagccaccacgcccggcagaagagtgtttttaactataaaatgaacaatgtgtaatttgttgtgccagagatcctctagaacactcaagatgtgagtagattttcccttgattgttttttatcctctcagaactttctctgacttggattttaaaagttattttggccaggcatagtggctcgcatctgtaattccagcactttggagaggccaagccaggaggattgcttgatgccatgaatatgagaacagcctataacatatcgagacccctgtcattagaaaaagttgtaaaagttagccaggtgtaatggtgcacacctgtagccgtagctatttgggaggctgaggcgggaggatcgcttgaacccaggggtttaaggctgcagtgagctatgatcgcaccactgcactccagcctaggcaacagagcaagaccctatctctgaaaatatatacatatatatgttataagctgttttgctttgctcagtggttgtgctttctataatgtaattaaaatagtaattgcaaagagaatttcttttcctgtatggtctgaaattaatcagccatcaaaaagcctgcataatgtcttttatctctgtgcttctgtacttaggttttggtagagttggatacatggtttttaactcttacaatatgcatcccatattgtaactcgatacaataagctcttgtagattttagccatcaaaaagcctgcataatgtcttttatctctgtgcttctgtacttaggttttggtagagttggatacatggtttttaactcttacaatatgcatcccatattgtaactcgatacaataagctcttgtagattttaatggtctgtgaacagtgcaggtttcctagagaactacctcacactgagcatccttatcttctcagctcagtcattataagccatcaatcataacatcgctcattattgtcatcaactgggggaagcccatagaagagttttttaaatcactggattttattttacagtgttctgtataatataattgtttccatgtactgtttaaacctactgcaccccatgcattactgcatgtaattctagtgtgtatccagttgtcctttttctgtgtttttttcttttaaccaaaagtaaataaaatataatcatagatttcagtttttatgtcaggattattgaatttctctgtagacaaatggaacttttgaaggggtagtatccttttaaaagttctgctttcttcattttttttttttcctcattgaataggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtattgattttgaattttacatgtacacttaagagcatgtgtgtgagcacagattctccttgttgattttggtgggtaggtattgcttatttatacaaagtgtttctggaacacaagatatcaggctcaatgggaaactgaaacatggttttactcacctaatatttgcacctatttatattgaaaaaattttctcttcaaggtggttgaagatggatatgaattttttgcaaagaggcagttggtcactctgttttctgcgcccaattattgcggagagtttgacaatgcaggtgccatgatgagtgtggatgaaacactaatgtgt

SEQ ID NO: 71477 - DNA, 1005 bp, Homo sapiens
tcctttgagcatcatgtgagtgctcaaaaagttccaaattttggagcatcttggattaaggatactcatcctgtggtggtagtagtagtagtattgctgttggaaatgggagttggtggtttttggagattgcccttcagcctttcgtaagaaggagtttgcttttttttgagacggagtttcactcttgttgcccatgctggagtgcaatggtgcgatcttggcttactgcaacctctgcctcccaggttcaagcaattttccttcctcagcctggcgggagaagtttgttaaactttccgaaccccctagtgaaggacctctaaagaaatatgcaacagggtgaaccatagtcagtgttagacccagtcattgagaaaccagaaattattaggagaaaagataacactcctctgcagagagaaggcaaacatttgttgaatttacatttcatttcaagccctgtggtaaactccctaagctgcttgatttgcattacagggtgggaggtgtggttcaggtcagttgcttgggctggctctaactctcaaaggagaggtataggtttaaacctttagatgtccctgtattccccaggaaaagagactaaggacaaactcttggtttgttttgtttgttttgttttgttttttgagacggagtttcgctcttgttgcccaagccggagtgcaatggcacaatcaaggctcaccgcaacctccgcctcccaggttcaagtgactcttctgccttagcctcccaagtagctgggattacaggcatgcgccaccacgcccagctaatttttatatttttagtagagacgggatttcttcatgttggtcaggctggtctcaaactcccaacctcagatggtctgcccgcctcggcctcccaaagtgctgggattacaggtgtgagccaccgcgcctggccaaactcctggtttttaaagattgtgcttagtatagtaagtacaggaaacaaaggcatctggacaattgg

SEQ ID NO: 71478 - DNA, 1106 bp, Homo sapiens
gacgcagccaggtagtcgcagaatcaggattcaaagccagtagctcctgcaccaccccctgccacattgaaagttgacccctctattgctggcatcatcgggcagtcattttccattgacttttaactaaagtgtggggtgcacactttcccttgcagaatctctcttttctaatagcttcttgtctgggccgccatctgtccctctgccccatggcgttgcttcagcagtggggcgaggccccaccagccaggtttcccccaaccttcacactacttagcaacatctagcagatgcaagttttctgacacgggctcccaggattagcagatgctctttcatgagcatcatttccatcatgtttattacttccctgagattatcttaattccatagtccccaggagacacatgatgcttatgtggccatgtggcccctggagattggaaggaagtgtaggcctgctggggcttcttgtggtggaggacttgccctctaaaacagacttcagctcctagagaagcttctagacctgggggaggctgggaggtccaagcagttatgacagctcggtgggagtaggaaaagggagaaatccagagggctctggagttagcctgtctggattttaattcactgtctagctccatgaccctggacaagttacttcccctctgtgccttcagtgtcctcatctgtaaaatggggataataataaaagtgctggctgggtgtggtagctcctacgtgtaatcctagcactttgagaggcccaggtgggaggatcgcttgagccagggagtttgagaccagcctgggcaacatagtgagactccatctcttaaaaaaaaaaaaattagctggatatggtggcacacatacctatagtcttggctgctcaggaggctgagacgggaggatcgcttgagcccaggagttcgaggctgcagtgagctgtgattgtaccagtgcactctagcctaggcaacagagtgagacctgtctcaaaaatagtaataaaagtgcctacctgtggggtcgttatgaagttatatgaattaattcttggtgcttagatcagtgcctagcacatagtgattaattat

SEQ ID NO: 71479 - DNA, 1048 bp, Homo sapiens
agtcatcgattagctgccgcgaccatggagaagcgctagtgagccctcggtcggcggagcggccgagcggccaggcggccgggcgaggagcggggaaggcaggggctacggcctcgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcgggcagggaggaggaggaggagaggaggaggaggaggagagaggaggagggagccggggttggcgaggaggcggctccgcgccccgccgctcgccggcacctcagccttcgccgcccgcctggctgcgcagcccggacgcgccgccacccgggggccgccgccgccgccgccagagccgccgccgccggactggccgcaagcgccggcagacctcttctcctcgggccggggtcttggggttcgtcttgcttcttgcctttacccccccgccccttccatccccttcccaagtctagatgcagacgggcggtggaggtgggcccgggcgctcgcaagtttgcgctcctgcctccagggcggtggagagccgggagcggcgcagagcaggtgactcccagccctcgggcccaagggaacttttaaatgagagatttccttgcttgttctgcctcctgcgtttctccccgctgctcccctcgtctcctctctcccgtctctgcttttcttctgtttctttcctctcttccctgctctttctctctccttccctagggcgactcttcgaaaccccatcactttctccccatcctccctttgtgggagtctgtgtgcctcccctagatttggaggtgttctctgcggaccccgtaggagccggggctgggaggtggaatctcagagaacgcaccgtggaggcgcggctccggcctctgttctttcccggagtgccccggacgcgcctggcaaggccccccagccttggagtctcgcaaagtctc

SEQ ID NO: 71480 - DNA, 1069 bp, Homo sapiens
ctttctatagatgacagcagtaaataagctatcagccctgttggcggaatcctaactttggaaacttcaccataatagaattgctgccgaggtccaattgcagccgaggtggggagcgtgagcccgcagagcttggcatggctcagccccctgagaggggttggcattaggtgaagacagctctgagaataagacaaacccttggactctcttctaactccagccagtgggtgaccccattccctctgcctctccaagtccgtagaacccacaccctgtggcccttttctgcagaaagagctagaaacaggtgttgagaatttatttaaagaacccagcagccttttctgggtctcccaaaattgtagtttctcaacttgacagagattgcttctcaaaaacgggctctctctttgaatgctagaagaaaaaacaagcaacatctcatccctcactggttttactgttgggggtcttgaaatttcttttattaatacttgaattcactgtagaaaatggagaaaccacggaccagctaaaagaagcaaataagtgtctcggtgggttatttcagatgagcacggtgctattttgaccagagggaacagcttttctgatggtggtggtggtttttctttcttttacttttttccttatttttttttttaaactctcctgttaaaaagaggattctatcttcgaacttgacattctgtcatggtaacctttcttccggcagatgggatttcaaacgtgagcaccttggctagtgctaaatatatggtcctggatgatggtagacaaggctgcccagaaactgtggttttctgtgctgcttctgaaagggctgaatttccggtggcttcctggctatctaattcaaaggccgggcctggcagaggtgaagcattggaaggggactcaggtggtgacctgcctttgttcctggccttgggattcagggtcccatcttctgtttgatatttttcctctgggggtgctcattatttatgatggtgtcatatactggagggtgtcagggatggtagaggttggcaggggggaagga

SEQ ID NO: 71481 - DNA, 2694 bp, Homo sapiens
cctactagctgtgtgaccttggatgagtcacttaacctctccaagccttactttctttgtctttaaatgggactaataatagtctccgccttctaggttgttcaggaagatcaaaccactttgaacatgaaagtgtttagcacagtgtggggcacacagttgctgccctgtgaatctgagtgacttcctattgtcattggtatttttagagtatgagaggagaaaaccaaataaacagcagcggctggaacttgctggccttgcaggctgttttagagatttctgagcaagttttctcttctctcttactcctttggggttactatattagtattgtactaatattatatgtagtatattttgggagttctgaccacagaaattgcagacggggagctatgtctggcccatggatgtgtctgtctagattagtgagatatttaaaaacacttttgtgtaagttgtcagcatttaaaacacaagagatttacctaagaaatctaggtgaccagtgtcccctgaaaatcaggagctctggccactgtgggcaggtccaatggagaaggggagtggagacctgggagggacatttccaggcagagggaacacccagtgccagggccctgtgccaggggtcctcagtgggtcaggccagctgtcggagtcctgaggagggtcttctctgtagttcaaggccacaggccgcaccttcccagtgcctagttccagaagaggctgcatttccagaacaaatgaaaggctcctgaccaatgcatgaagatacccggttagtagggttcagagcctgctgtctctgcttcttcccaggagcccacacccccaaaagtgggcctgtggctgtcccccgaaacccctccggagcacaccccagcctctgccagtcttcagttcagcccaatgaaacagcagttccaggatatgcatttgccattaaaaacaaagaaagaaagaaagaaatcaatccttcggcctctttggcctgagctggtcgtctgcccagagacgctggggggcccaacggtgcttaagactctgtgagccgccgtcgctcaagctggacggggtaaatggctcccggggaaccattatggtcgattgacttgcccagccgccggtgtggactgtgggtgttgcggatccggagaccacaggggtcacaggggccgccagtccagggcagatttccctgagtggggccatcactcctaggccttgctgctacagatgcctgtgagtgtctgtcatctgctacgagtgtctatgggtgcgggtgtcccaggggatgtggtgtgagctgcggaatcaagccctacaccctccacccccaaagactacctggactctggagccagcaggcctcggttcaaatcccagctctgccacttaccagctgtgtgaccttggatgagtcaattaacctttctgagcctcacttttctcatatataaaatggggataatagtagtagccacctccttaagaattgttgtgaggacttttattattatttttttgagacgaggtctcagtctgtcacccaggctggagtgcaacggtgccatcagggctcactgcagcctcaaccttctaggctcagatgatcctcccatctcagcctcccaagtagctgggattataggtgcaccgccaccacgcctggcttttttttttttttttaacgtagaagtggaggtctcaccatgctacccaggctagtctcgaactcctaagctcaagtgattctcccaactcaacctctcaaagtgctgggattacaggtgtgagccaccgtgcccagcctgttttgaggattaagtgagttaatgcatatgaagcgctgagatccatgcccagcacattgaaacatgatataatgttaaagtgaataataattgctgttatccttcactccagaactgtacattcaccacttacggtataaataattatatataaaaaacaaatacaataactaataattacatattaaagatgatatagtaagcaaggaaggcaaggtgccagctctctcagagcccacaggccatgggacgagtggatgcacatgccatttcacagacgggcaaggggagtagattccgagacagtatatggcaaaggaattgcctgggtctggacctcaggggatgcttcctggaagaaatgacccttctgttgagatctcaaggacaaggttagggaaaagcatctcagaagagggaacagcatttgcagagaccccgagaagggtggaagaattgtgcctccaaggaactgaagaaagcagtatggccgggagaagattctgagcaggttactgggcctgtctcattctcacttttgccacctgccaatgaggagtagggatggaggatataatacgacactgcatggtggccgggtgcggtggctcatgcctgtaatcccagcactttgggaggatgaggcgggcagataatttgaggtcaggcatttgagaccagcctggccaacatggtgaaaccccttccctactaaaaatacaagaattagccaggcgcggtggctcacgcctgtaatcccagcactccgggaggtaccattgctatacccatcttccagatgagaagactatgcctctgaaaggggaaataagttgcccaaggacacatatctaggaagaaagaagtagag

SEQ ID NO: 71482 - DNA, 1566 bp, Homo sapiens
ctgtcgcccaggctggagtgcagtggcgcaatctcggcttactgcaacctctgcctcccaggttcaagcaattcgcctgcctcagcctcctaagtagctgggattacaagcgtgtgccactacgcctggctgatttttgtattttcagtagagacggggtttcaccacgtcggccaggctggtcttgaattcgtgacctcatgtgatctgcctgcctcggcctcccacagtgctgggattgcaggcgtgagccaccacgcccggccccttgctgttctttttaaaaacctctgaagataccttgccactgtcaactcatggaaatggatttgggccccaaagcctgagaagcatgggtcaggggaaggtgagagaaagctcccggttcccagcgtgtctcccagcctggagaatgagcaccacccggccatccatccccggcccccgctgggtcccggagccgcgtggcgcgccctgtcgtccggcctgcattccgcgagatggaattctcggctggggctgataataagcaggtattgattgctgccgtggtcattatcaagatttatttagtcaatatggcctccccggtcaataaatcgtgtcgttgataaagaaggaaggagatagacttgtagcctttattaaaaaagttttttagattttttttttaaagccaagtccagccctcctttctgtggctgtaccagccacactctacagttcgcgtttttaccttataagctctttctttccatggcagaccttatactcattgctctgactccaagaagcaaggacttggggctggggctagggctggagaatggtccctgacctttgttctttcattgaatcctcccagcatcccttggggcaggctctggtgtcaccctattttgcagctgaggctactgaggcccagggaggttcatttactagcccaaggtcacacaagactcgaacccagacagtctggccagagtctttgctctgaatctgacattcatccatcaaatagcaggtatttcttgagcacgtgctataggccccgcacaatgccagctgctgggtgtggaagggcaagctaaacaaataaatgtgtaatgacagaaatagaaagaatggaggaaagagcgctgaaatcacatggaggggccgcctgtttatttagggtgatgatggaggcccacactgggtaggtgacatttaggctgagacctgaaccatgaagaggagctgtgcaggcacagttcaggcaggggagctcacagctccaggaggagcctgtgcaaaggccctgaggtgggactcagcttgtaaagtcctggaaccaaagggaggccagtgaggctagagaggggagaagaggggagggagagaagtcacagggggaggtggttactgctcacgcaggcccttttagaccacggtagtggctggattcctttgaattctattatcatggaagtgggaagatactgagggtctaaaacgggagaaacgagatccaatttatgtttggctcccgctgggttcagcctgataggaaacattgaagggagg

SEQ ID NO: 71483 - DNA, 1117 bp, Homo sapiens
ggcctcataaaggtctaatgtgatgatgggtggctcttggtggaccatgttgtctggcaggagtcggggcctgggcccaaattactgggacaagcatcagggatgtcagagtcccagaggccaccgtcagagctggtcaccatagcagcatacactgggggactaggccaatttcctgtccttcctatcctggggtagctggaccctgggaccctcgggccagcagcctggaagtcgcaatgaggcggccccggccctcggaggatatcctcttcagcctctgcaagcaagggggttggtcccacggcccttggcctactttgtgaaattcatctctggaaaaaaattattctctgagcagagcagagcatcttggcatatcacagtgggtgaggcctgctgaggccgtctgcctccctggagggggcgaggagagaaaccaaggcccagctcctgcctcccgcctggcccccaaggtggggcacctgaggaaggcagccccccttcccccagcccccggagcttgcccgactgccccagcggtcccatcggcgcacgtttcctgtcccctgcccaggatggcacccctagaaggttggggctggcccagcctccctacaggtaagtaggcttgagccagaggataatttgtttctgtgggatgtattgatgagctgccctaattaggcaccttgctaatgagaatcaaaccacttcgctgggagtcgggctgatcgcagcctagctctgccgtgaagcagccatggtcctgagcaggccacttagctgcgtggctctcagtgttatcttctgtaacatggggcttcctgcgttctttcccctccatagctagattgtttgctatgcccctggagacctcgggggctgttgagatccgaggcaaaaggcggaggccaattgtggctttctttgggtgttcttgtcactggtggacagatccatggatgcgtttctcatgccggcctcttggatggatctgtcagggaaggaggatgctagagacgaggactgttcttaacatgtgtgactgcatgtgtctctgtaaacgcagcagtcatttgttgctgggtagcaagccaccccaaacttagtggac

SEQ ID NO: 71484 - DNA, 1048 bp, Homo sapiens
tgccatgtattatttacctaggggcttgtgaaaaagagaaggatccaaaaaaaacaacagcaagcaaacaccccctccccccaccaccctgcagtccaacattgctccaggcgtgcagcctgagggaatgagtattttttttcctccagtatctgtacgtgtgtgagcatgtgagacgctgtgctagagctccaggtcccaaccagcataggtggctctggggcctttgggacatcgcgaggcggcaccatcgcctcccacagccccggcaaaggttggcctcatggggcctgcactttgagatacggtgggcttccgttttagatcagtctggtgctccagtaactccagcagggcctgccttgggggctgggggttctcaggcaggctggctcctggaagggtaaaattcccagaggaagggaggtagcgagtccgggggatttggcggccgcccctgcatagcattattctgtgcctcacacattcttattagcatcgtaatcgctccaaaatactgattcattattgcactccgagctgcagacggaggcaatggggtttaatagttccatatgagccattctgggctgttgagtaaatattgctcattgtgaaaaattgggtaaatgtgtgtttacgctgtcgaggagcgaggcaccagccaagtaggtagctggtgtctggacatgcacccggcaaggtggtggggacaggggaatgaatgttctctgggaaatatttgcttcctgtctggctggccttggaaatgttctttggacatggacgttgggatcaagaaaggggctttacctcaaaatcaaggtagaaggagccttgtgtttcttgtgcgtgtgcaaatggcttaggagtgggcaggaaagaccctgggccttccaagcttgtagagacaaatgattggattcagaatcagagagctggttaccaccagcagcaggaggcgatgtggcaggtgagaagtgtgcaggtgagagggtttgactctgggttccctgttcaaccacctgctaattgtgggatttcaggc

SEQ ID NO: 71485 - DNA, 1067 bp, Homo sapiens
caggtctctgttgtccctatagctgagacgtgggaaggaagaaaggaaggaagcctgaaggaaggaagtctagagccgcctggaggcagggtttcagacaatttcatggggacagagtgaaaccagcctgcagggagaggctaagagacagagtcctgatttgaatcatcctgagggcattctctctctttatcgtttgattacaggagcccaacccatgtttttatttgtgtatttggttgtttaagcttgttcagaccgagtttctgccacctacaatcagaaacacccccaaaacatgtctccccatggaaggttccgggaactcttggccactccattctgtgtgaccaaaattctccaaaggtgaatcagacacaagtcatgtctgccaacctggcctggtgttgataggcgggtctggtgcaggatgtaccctgttgtttgaagaacatcatgtggagaacaaggggacagagggaggccatagggtgtgccaggacacaggcctgggcagaactccaccacccttgggatttgagtatcccagaagaaggaacatttgggcagtgacatggccatgttcgtgtcactgaaccaccctgagaaataaggtcccgcgcagagcttcagcagatgtggaatagttccaccccctgcctcagattcttttcagggcagcccatcacgacccctctagcaagagttacctgccctccccaccgatcataccctagtccagcagggaatggcttttgcccacttttaaaaagtggcctgcagagcctggcgaagtccctcccgtgtccccaagcccaccacacctgcttcgttctgcatagttctccccgctttatctttgatctcaaaaaaagatcatcttggaaaagattgttttgtgtgcagtttacccaaatgccactttttctaattttgccggagttgccctccccactttccctcttccttttctttctttcttggatttgctctggggttggcttcctcgaaccaaaataactctcacaatgcacagggaaaagtgcttcctgtggatgaatgacatc

SEQ ID NO: 71486 - DNA, 1628 bp, Homo sapiens
tcagcccagagcctgccctgacttcacaggaagcagcagctgaactttggcagcaggagggaagtggggggttgtgggcaccagaaccaactgcattgatttctggctgcagttcttggaaggcctgtcatgaggaaaacaggcagcgggtaaacagcagacggcggcagggcccagcagctgggaggacctggctggacctaggaacctgtcttagctcgtggtaccggccaggtctggccaccactgttggggacaccgtgcccctcgggcccaggcctgagcctctcgagaccccaccatctagccaggtaaggtttgcccagacctggtcccccagaactgtctcccttgctctgcccctgcctgttcagagccttagggattctgggttcattcatccagtcccccacaggccttctctggaccaggcctggccgagtcacacctgagggctgcagaggatggaggagacagccaccacccccaccccccaccacccagccgcaccctgagccctgctcacaggagcagccgctctccctggctctggagggcagatctgatttctgttccatcccagctgctgccaggcacccctggagccgtcagaccgcagccaactaggcgggccgaccctgtctgcgcagagccaccgcaaaattacagctcagacaggatcaataggatcaggtcgaggggcctttggaggatgattttgctttgaggagaggtcagaggggcttcagacttataaatttattatttaagggaggattcctggtggtccgtaagagtttgttggacagggagttggcctctctctggtctcctggatgttctctggggtggagtcaaagcgtctaggctgtttgcgatgggataagctgggtgccttccccggcaatgggtagaggggatgatcagggtttgggggcagcgttcggatgcggagagggagctgctcaccttccatgtccatttgctgctgttgttttttggggagagctcagttgacaaatatatttgtgtgtcatgctgtctttttacttatttgggcgcttattgtaggcctggcattattctaggctgagggaatcaggtcatgaccaagccagatggagcttataagtctcattatttgtccttactggggaggaatccaaggcccagggtgtccgagtgatttgcccagggtcactcagcaagaggcccctgccaggttccactctgcctaggaaatgagcaaaatagtctccatcagaccaagtgggaaactgagtctgaataataatgatgatgataataaccagccttcagtaagggcttagcaggtggccgggaactgtgctaagtgaaccctatgaggttggtactattgtcttcccattataaaggtgagaaaactaaggttcagagaggtgaattcacattcttgaagtcacacagctagtcagtggcaaagctagaatttgaactcaggactttggctttcaagcttaaccacacatcatgtggatactttctgaagttcccactaaagccttgtgcactggagaggcaagtcagcatcatcatttttataaagatcaggtcctcaggctgggatgtgcagttgaggaggatgc

SEQ ID NO: 71487 - DNA, 1084 bp, Homo sapiens
tgccacaaatcagggcttactccttagagagcccattgttaaccatttaccagcatgcatctgagcaggtcatgcggagatctgggggagggttgggaagggtgttccaggcattccctgatgtgggaatgtgttcagaagggttgaggaacatcctggaagccagtggggatgggatgagtgaatgaaggggagaatggaaggagataaggccaaaggaattctgtaaatacttttggtctctgaaatcctctaatcagtttacttgtgcctccagaactttgtgcatgctgtacctctgcccagaatgctcttcccctggctgattcctttggttcctgtctcccctagagaagtgttccgggaccatttttgccacagcacatctttcgcctttattcttatatcagcactacttggttcccttcccagcatttgtttccagttgtaattgggtattgggttgtttctttgagtttggaatctgtctccctcattggactgtaagttcagaaagatctcgtcccctgccatctccccaccttccagcaagggcttacacagggcagatgcttgaagcattattgtcacatcagtgaatgctggtggagagacttttctgcacttattattggtttgggaaatgccctgaatggtgtgagatcagggatcaggagcagatgtagctgatggagaagctagaggctcctaccttgtgccaggcctgatccaggagcataattcctaggtcccttctagttaactttgaagcaacacagtggcagattgaggccactctgatgatggtcatagtaattacccccaccagctaccaacctgtcagtgagaaagagcattctctctgctcctgctaaagacattggccacttcagtggttaaatatttctattatatcatggtagtatcacagagcaatggatgtgagttcagaacttaagatgaagattgtgtcactgatggagaaagtacttagttcacaggcaactggaactgtgtagcctggggtgcatcaaagaaggaaacattttcatcaaaagaatcaggtttggctgacctgattatt

SEQ ID NO: 71488 - DNA, 1048 bp, Homo sapiens
tgcagagcagaacctgcgtcagctcagagtcctgtgggaagggaacggctttatcgcagcctttcgcttttatttttgcacattcgctttttatttgccggtggtgctgctgacgggccctcggagcggggctgtgtctggacacttctgggagccttggacggctctggagaggaggcaggagctgcccagggtgagtgcaaggacccgccgagggttgagaggacttgggggatgtgagagcaggagcctgtgactgtgtgtgtgtgtgtgtgtgtatgtgtgtgtgtgcttgtgtctgtgtgtgtccttgtgcctgtgtgtgtccttgtgcccctttgtgtgtccagctcgatgtatgcgtggcctgtgtggctctccgtgtgtctttctctgcgtgtgtggtggccgcgagagccgtccatgcatgagattgagtgtggatctctgcctatctctgtgtgtgcactcatgagttgtgtgtgtgtctgtgtgtctttggaggtggccatgggtgtggctgggtgtgggtcttggccctctgtgtctttctgtttgtgcggatgtgtgtgtgtatcttaaggagacacatgggtgcgtgactggtgggtctgtgtgggtgcagacacccatgtgtgcaagtcagaggggtatgcatgcgtgtgtgtaagcatgagtgtacacccacaagtgtgtgaattgtatacatttgaacatgtgagcttgcatggaggagggtgtcacgtggcagagtgagttgtgtgcatgtattttgcatgtgtgtgctacatatgagagcgtgtggactgagcacacgttgcacaggagggtgtgagcagtgctcatgtgctggagcacctgtgtgagtatgtatgtgagcacatgttgcatgtgttgcatatgagcacatgtgtggggcacttccatcttgcatgggggagcccccagtagagccctccctgggcagctcagcttgccaccaaggaggtcactgtagactcccagcctcttgcctcagccccagctccagtcagagcctggaaaaccc

SEQ ID NO: 71489 - DNA, 1012 bp, Homo sapiens
ctttatctgagcaggctgcattctacatttgaggttaaaactcacatttcatttttatatgctgtgcttaatccaataatgatttcttgttacaaacagaaataatatctttcagcatagttaatcagaatagacttaatgctgtcactatttattaacctttgttgaaaagcaagaagtttctctctaatctgtgattgctggtcttgtcaggctctatcaagtgaaaaaacagttttggcattcattaaaacagtgcgaatcctgaaatgacaattggagctggatggtatttggtgcatgaaatcttcgttgtgttcaccaggataactgagaaggctggggaggcgtgaagggggaacccacacgttcaaaggactgagtgtttcatccccaagtccctcttggataaagaaactgttcttacgaattgggaaagtggggcagaggatggggtgcaggggaggggaagggtgaggcctgctggtgcctcttgccagagaaacatcattagttcaagacaatggcttttggccaggcacagtggctgacgcctgtaatcccagcactttgggaggccgaggtgggcagatcacctgaggtcaggagttcgagaccaccgtggccaacatggtgaaaccccatctctactaaaaatacaaaaattatctgggcatggtggcgtgcacctgtaaacccagctgctcaggaggctgaggcaggagaatcgcttgaacccaggaggcggaggttgcagtgagccgagattgcatcactgcactccagtctgggtgacagaatgagactctgtctcaaaagaaaaaaaaaagagagacaatggctttgaacttggatctcagatgcctcatctctttcccaaccctatccagcgctaatgatctactgggagtcatttattcacttttactcctccccacaacttctttttcatttagtaaacaaggttgggtctccccgatctccaaggcccacattcagttggagtccagtt

SEQ ID NO: 71490 - DNA, 1090 bp, Homo sapiens
tagagtcttgctctgtcgcccaggctagagtgcagtggcgtgatcttggctcactgcaagctccacctcccaggttcacgccattctccttcctcaggctccggagtagctgggactataggtgcctgccaccatgcccggctaattttctgtgtttttagtagagatggggtttcaccatgttagccaggatggtctcaatctcctgacctcgtcatctgcccaccttggccttccaaaatgctggataaaatttcttaataatattgaatcttccaatctatgaacatggtatatctccattttctaccccatgctcttcccctgcttactcttactcctctatcaggtgccagtttaagtgttatcttctcaaggaggtctttgttatctcctgactcgatgatccagctcctgttataccctctggtgccccctctttttcttcttggaactaatcacagtggtattaataattattaatgtgagtatctgttttgcatttgtctcccccactagaccataagttccatacaggcaaagatcaggtctgccttgttcacagactagcacacagtaagttgtcaatgaagatttataaatgaatgaatgaatgaatgaacgaatcccctcctattctttgacatagatctgagaacactggctgttgtcattcacagtttgatgaataccttggtctctgtttgctgatggagaacccaagccctaatccctcacccctttcttggccttctgcctaaggcttagttcctgctgatatgcattatatgttgagaactcctattcatttgacaggtagatgtgtgtaattatgatttttaaaaatgaaattatacatctacagagaatttttaggtaatgattataatacagaagtttaatttatctgggggaacgaaagatgttgctttcacagcatcagtcagagcattggaaaaaccagtggtggaatcttgattgaattaggctgtgcttataattaggaaatgccaaggcctgcagaatattgagaagtggtgaggacaaagtgatgcaattaagagtctcttttcccccctttcagcagttt

SEQ ID NO: 71491 - DNA, 1025 bp, Homo sapiens
gtgcccgacctttgggtctcatgtaacaacaaaaaaatggttgcatgaatacactgaaaaaataaataacgtttactattgttaaaaaacattatgaactgggcacagtggcttgcgcctgtaatcccaacactttggggggccaaggcgggaggatcacctgaggtcaggagttcgagaccagcctggccaacatggcaaaaccctgtctctactaaaaatacaaaaattagccaggcatggtggcacgcgcctgtaatcccagctactcaggaggctgaggcaggagaatagtttgcacctgggaggtgaagtttgcagtgagtcaagatcgcggcactgcactccagcctgggcgacagagtgagactccatctcaaaaaaaaaaattttttttaaacatggagaattgcaaaagggaatagcctggagaatccccacatccccatggccttgctccatcatgatattgaagtcactcttttggttgtgtttctctaaattctatgaggacagcaactctcttcattatcctctatatcattgctatgccctggtgttgtgcccggggtacaacacgtagtaggtgttcgataaacttgggttggataaatggaagaatgaatgaatgatgagctggtgcacttagatgtgatttataagacttctagggggatcaccggctattacttagaactatattgtgggtcaaatcacgtctccttccccttaaaaccacaaatagccgggcttcagcatctgccgtggacatcagaattcctgagaaccttctgaaccgtgttggctcccaggccccactcctgggagttgttgggctgttgagtagactgacatattgggaagcctggtagaatctcacaggtgtaggaaaatctagctgcctagggttataaaggatgccctttgtcctcaactcctttgacaccttctctctggagacctgctgaataaggaagggagtaaccacaaggaaaaaaaaaaaaaaggcaacaaaaaccaactgg

SEQ ID NO: 71492 - DNA, 1128 bp, Homo sapiens
ctacactgatttttttgcacactgcttcattcccaaatagtcagagatgggtagaatcgcccagtatcagaacagactttgagggaggctgcattttgcatgctaaccctgagaattcactggcagcttcctggagctctgcgttgacaaggattcttagactgcattctagatcagcaaaagagagcctcattcaatctataaacattttggagcacttactatgtgccaggcactagttgggagaggctggtaatagatactaaaagaccagctcatgcaaaactcaagcacaggatagagttggcatcttattctgaatgcattgagaagctatgggaggattttccttggggaagtgctaggatctggtttatgtttcaaagattacagctttaaaaaaaaaatcactctaggttgtgtatagagaatcaatggaaaggaggaaggaagagatgccaaaaggccaggttcaaggttattgcaggtgaggatgggtgatggataagaatttatttgatttgggctttacatgaaaagtccagttgaccaaattcatcgatggtttggattgcagcataggagttggtgatccattagtaatgtctaccatggacacgggaggtggcagtgagcatgcacatgctacatatttgttatctctgcctcataagtcattcttaggttgatgagagggagtggggaagatgaagaatcacttagggatagtagtgtatagctttagcaacagctacagatattccaggagatgtatttgaagaggaatgttcactggccattcctgcagacattaagcaaagacatggattagcacaacatccatgagaccacatgaatgccatgttgtctccacctgaaattgtttaggaatcagtaaagcaactgggaccctcagaagatgtaaaaattaaaccaaatccctggagagatgtgcaaaggaccaatgtgattccacagagacgcaatcaggaaggttcaaagaaaagaggcaaggcaggaggccaacgatggaacggataatagaaaaacagttttcaattatgtcaggtgaaaacggaggatcagggatagtccccttccccctctcttcctcacctcacaaacagg

SEQ ID NO: 71493 - DNA, 1376 bp, Homo sapiens
ttcttatttcacaccagaatcactcacaggcccacagtttgttacatagactaagcagtggccctgccatctcactgatggtctgaccctcactcttctgggaggaggagacagcccccctaccccaccaggctccggagactgagcccaacatgcagatcctgccacagatgccttcttgcctccccaggcagcatcaccccgagaatccgcacgcctgagacaggctcagacgacgccatcaagagcattctagagcaggccaagaaggagatcgagtcgcagaagggcggtgagtgtgacccctgcaggcaaagcctgaggcccccggggccagctgcgaacaggagatgaggcttcgtctacctttgtccaccccagagggaatccaaggtggatcagaaccaccagaggccagagggacctgtctagagcgcatgggtagctgtggcactgctcagaaccctgccatggttccacacagctctcaacataaaatctcaacccttggccaggcgcagtggctcatgcctgtaatcccagcactttgggaagccaaggcaggctgatcacctgagatcaggagttcgagaccagcctggccaacatggtaaaaccccatctctactaaaaatacaaaattacctgggcatggtgatatgtgcctgtaatcccagctacttagaaggctgaggcaggagaattgcttgaacccgggaggcggaggttgcagtgagccgagatcacaccactgcactccagcctaggtgacaaagcaagactctgtcagaaaaaaaaaaagaaaaatatcccaagactcgacaaggcctacaggccctacagtcttcaggcccctccatgcctgtcacatgaactgttcatagtcatgcccagctgccgtgcactccaccctgcgcctctgatgctgtccttaccccagacacctttcacctggccaactcctactcatacctatgactcaactcagaagtcacctcctgcaagaagatgggttggacactgcacccgcttccctccacccccaccacagtgacctgtttgcttggtgtagtggagctggactggccacaaattctggctctgctgtttattggctatgtgaccttgggcaagttacttagcctctttgtgccttcatcgtctttgtttgagacagattctcactctgtcacccaggctggagtgcagtggcgcagtctcagctcactgcaacctccacctccttggttcaagcaattctcctgcctcagcctcctgagtagctgggattacacgcacgcgccaccacacctggctaattttttttttttttgtatttttagtagagatggggtttcaccatgttggtcaggctg

SEQ ID NO: 71494 - DNA, 1014 bp, Homo sapiens
gactatgggggcgtacccacaggcgggtggcagaatccaggtgggaccccttccccatcccagggcctggagggagccccacatggcctctgggagatggaagaccccatcacataggcacttagatatagaacacaggcccaagtgcagtggttcatgcctgtaatcccagcactttgggaggccaaggtgggaggatcacttgagcccaggagtttgagaccagccctggcaacatagggagacctcgtctctacaaaaaaaactacaaaaattagttgtgtgcggtggcatacacctgtagtcccagctacttgggaggccgaagtgagagggtcacttaagcccaggaggcggaggctgcagtgagccaaaatcataccactgcactccagccggggcgacagagactccatctcaaaaaaaaaaaaaatttaaaacacaggcaaatgtggaagaaatcccagctccatcactttcagctgtggagccttcttcacttccctgagcctcagtcttctaacctgtaaaatggggtggacagtagcaggatctacttcatagagttgcacagaggatttgatagactaacatagttacataaaatacctagcgtgtaggccaggcgcggtggctcacacctgtaatcccaacactttgggaggccgaggtgggcagatcacctgaggtcaggagttcaagatcagcctgggaaacataatgaaaccccatttctttgaaacatacaaaaattagctggacgtggtggtgcatgcctatagtgtcaactacttgggaggctgaggcgggagactcatttgaacccaggaggcagaggttgcagtgagccgagattgtgccactgtactccagcctgggcaacagagtgagactatctcaaaaaaaaaaaaaaaaaaaaaaaatccagcacatagtatgtggtgggtattgatatgattattgtcattatttttattattatttcaccctgtttgccttgcgtctgcctcaaag

SEQ ID NO: 71495 - DNA, 1053 bp, Homo sapiens
gggtccctgctggggcggtgacggccaggctgctctttagtgttcttggcacacatgtttttcagcctgtgcctgccacaccctcttccccacgcccgctgctgggggacactgagggcagctggattcaaccccaggacctgcggtactggcttcttttcgttgatgtgagtgccaaaatgccatgcttcagtctcccaggagacctgggttccggggccagctgtgcccctggagatcttggatgaattatttgcctttttgacagctctttccctgaaagctcactacccaccaagtattttgcaaaatgactcttcaggagtcaattcactcagcccttagagggatggaagttaacgtcaccattttgcagatgaggctgagaaaaaactccgactcacagcagctaatatttgcaatccatttcccatagtttgccagtgggttttccttcttttagctcatgaaccctcgccacacagcccaatttaacagatgaggacactgagacttggaaaggtgaaacgacttgtccaaggtcctccagcctggacctgcggaggcaggaactttgccttgggagcagagctgggccaggctccctccagcttcctgtctggccatgggctgttgaatcagcagcagtgcccacagtggactctgaacttcttggaaaacagtgtggggagataaggcaggggccaggccttcgctccaggcaaggctggcgcctgtgcccctgcagcttcctgtcttcccagttctggtggaggcaggggtcatgggcagagctgggtcctgtgcctgctggtgaccttgaaccagtttggcctctatctaggcagtcgggggaggagggttgctgagcaggagggaagttgctattcctttggccttgatggggtggagagaccccaagatcagcccctttatttgggtggcttgcctggagcatgtgattctgggcacagttgtatgcctctagccaacttattgaatctccctgtgtccatttccacatctgtgaatgtggggtgagatcccttgtct

SEQ ID NO: 71496 - DNA, 1032 bp, Homo sapiens
gcacatttccaggcactgttctaggcgctgggaacacagcagtgaacaacacagatatccctgcctgcgtggagctgatattctagtggggggacataaggcacgaataagcaagtgggatcagctatgacaatgacaaaacagttacgggatggagagctggaaggggatgtcttagatccagggctcaggaaggacacctctgcggaactaacatgtgagcttagaaccctccatgacaagaaggatccaggtgctataacgtctgagggaagagcattccaggccaaaggaacagcatgtgcaaaggtgctgaggtgggaatacatgtggtgctttggaataaagtcataaaggcagtggtgacacctatactggtaagagatgatgtttcaaaggtgggcccatcacatggtgtcttgaaggtcttggtggggactttgggaattattttgaaggcagtagggtgccatggagggttgtgaggagaaggacctgtggagtgtgggattcaagctgttcacacggcatctgaggatgtgggaagaggggtggggtgggggaatgtcaatgaagtctaaacgaggccgggtgtagtggctcacacctgcaatctcagcactttgggaggctgaggccagcggatcacctgaggtcaggagtttgagaccagcctggtcaacagggtgaaaccctgtctctactaaaaatacaaaaattagccaggcatggttgcacgcacctgtagtcccagctactggggaggcagaggcagaagaatcgcttgaacctgggaggtggacactgcagtgagccaagattgcatcactgcactcgagcctgggagacagaggtaggctctgtctctaaaaaaaaaaaaaaaaaaagtctgaatggatcatcccatattatttgatcactttcttatacctggggacactgcggccaagagagaacagttacttgtctgtagccatgcagctgccaggcagcacccacagagcagcccggtacccagccaatgccaaatgg

SEQ ID NO: 71497 - DNA, 1046 bp, Homo sapiens
gtacgctggaacccagactcagcccaggacataaggtagccccctgcgaccaccatcacccatcttatctaacaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaaggtatggggtggggtggggtggggtggggcaggcaggaccgtgccacccctctccactggagttcagggtcctagagggacagcccgagcccaccatcctctcctcccacagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggtctgaccctactgccctttgctgaagggggtggctgacactgggtagagggtagaggcttgctgcagacccaggggtacaggtatcttgttctgtgtcctgtcagcacttgcctcaagactgatggtgtggtctctcttggtcacttgtcctaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctct

SEQ ID NO: 71498 - DNA, 1144 bp, Homo sapiens
tggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagcc

SEQ ID NO: 71499 - DNA, 1041 bp, Homo sapiens
tcaaggcaggttagttgacttaattctttggtgctggtgactgttagtttgtaaaagttcaataagtcagatgaaggaagggatggtgccgggagctgtcaagctgtactggtggggtctgtaattagagctaactggagggatcatgatgtctactgtccagtttggtgttgagccatggctctcggtagaagttgccggctggggcctggtcaggactggaaggagagtggtgggatgtgctgtgcctatggtgggctagctgcagccagtggggtgcctgccccacactgctgcccaccccttcatcagctgattctgctcccacataaagaaaggtgttggcttagtgtcacttcttcctagagccatgggagttttctgtcagcatgtttttgagctgtcctggtaacttggacgggaagcagtctggaggtgggtgccttccaaatctctgccacagaatctgaacttgcactttgcagcctgttagtcagagctgctaagtttgctctacctggtgtgcctcttggcaccacctgagagatgtatgtagagaggctgctaagaaatgagtgcccctggcatgaagacgtcatatcccagatgtttaacttctggctggagggagggaacttaatttggttcattatctactgggtacctttcctgtgcggaggggaggaccagtgactttccataataagctttctcctttaaaaaaacttcagactcttacttactcttttggttcacactaattagcattcattttccagagaaagctgcttgactttgaggaaataaagacaggtgtccttaaaaatggactgcaaatctggatcagtgtcaggtctgctttagggtccatgaaatcacccaagagtgttggtactaaaagtggtgtaggctgggcgcggtggctcgcgcctgtaatcccagcactttgggaggccaaggcgggtggatcacctgaggtcagacattcgagaccagcctggccaacatggtgaaaccctgtctctactaaaaatacaaaat

SEQ ID NO: 71500 - DNA, 2599 bp, Homo sapiens
tgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggagggactgtgacgatcagttcagcatcagggcctgaggcttccgggagccgagtctgtgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctgacatgtggggggttattaccatggcagagtttgattgtagctctggagaagatactgctgagaaagcgctgtggatggactggctttgagtgtagcgttagccccagcccctgaacaggggagagcgccctgtgattgtgctctactacttgatggctgccatggcgatacttcacagtctgacctgttattctgaaagcaatactggtgcttggctaatatttggggagggggtttgttaaggcctttttttctaccccatgaacaagtcttctgggagttttatctgaagtggttttacgtctgactggtttgtttctacccacccacccaaccctccccactttggtgcagatgggagggggaaaagcgaattcaattttgagttttgttcagctagcacgaggatagtttacaatcatgtgctgcagagacactaggctgatgtgtggtgttgccagttttctgtttcaatgttcgcttttctttttacagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgatcaagttagtgtgtgtctgtataagctacttctttgtaggatacttaatatcaaagcaggtgtgctaagggtgcattttgaatatcccggaaggtagctgtgaaatgatttttcttcttcacccttagttctggttcaaggtatctctaga

SEQ ID NO: 71501 - DNA, 1039 bp, Homo sapiens
ttctcctgtactttccagtgaccctcatcataggcccaagtgtgcaaagcttagctttgtgggtatcccttggctgcttttcattaaagaagttttcctctcaattctttcctgtcgctttgcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagtaagcagctagaggctctcccagctaggaaaccctgtgtgtcatgccatttgcctgtctccctttccctctcaaatacacgtgatctggccctaagggaatgtttgtgtggttttgtcatgggatcagtgaaggtgctgattggtcagtcctttagttttccaactgagaccttaaaaatatctttgactctggaatgcaacccagtccttctttcctttctgtgtctgctttgctatgtctatatagcctcactactatatatatgtgtacatatatattcccctacacacttaccttggaagccaggcagggatgatggccttcacagagtctcagctctccgaagtgactaccggggcctgtcaacttgattgttactcacatgagttccagacacatctctccaattgttttccctggttatccatatatctgctttgaccataagttgtactcttgagagggcttggccttggacattggtgcagtgtaactagaagctggaagcacccaggtggtcccatttttctttaagagcagccctggaagcactttggagctcacctccagtgtaagctgctacaggtgaaaggtgtgcttgccatctcagtggttgctgtctgcat

SEQ ID NO: 71502 - DNA, 1065 bp, Homo sapiens
caaaaaacaaaaaactgaaagacatgaagaaatggtttttgtaccaaggtttggcccacgctgagattcacaaagaactggctttcagttcttatctttattttgatttaaactggcccatcatgttgtcctttgaagttagtctagtaaatttctttccaaagggctggggcactcagaagggagtttacttttctatatttatttcataaagcaaagatgggagatcctccattagggcttgggaaagtaaactgagtggcagaagggctcctgtgattagctgagagagactgtggtccttcggccctgatgatagatccctggccttgccacataccatacacagtgcccgcacccccatcccccaccacacccaatatagtctgtgccctcaggacattgctccagggcagtagcatggtgaggttagcctgatgatggccttgagctaaagagtgtgcacctaaaatgcacttgtttgagtagtttctgcctatgccttcaagttgcctttttgggaaaacctagtgaccgttaagagtaaatgcaaactaatttgattttaatatcatatgtagagctgtattatatgaaccaaatgctagtctgttaagcaatagctacacttattttttcaagacaatggatggtttaaatggagtcatctatagaaattggtagtggcgtgagttatgcattgtaaccatcaagaaagttcagttgatgaagtgtagaggagcgatggaggttgtcagacatcggttgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagtcctgttcaggtaagggcaactcagaggtctgcatggagtggcttctttatcctagtatctgagtgctttcttcaggtgccaggtatcgcatcgtcagaacacatggcatgtccaccctcgtgaagatggat

SEQ ID NO: 71503 - DNA, 1039 bp, Homo sapiens
ttatcttggacagcacaggtcccctctccccacctggcaaaaagtacagaaatagttgctccttcatggagaaagtctgggcagagctttcttctggaaatgaacttttaaggtacatttttcctatttgtagggcaatttgtaaaaataagggccggacgtggtggctcacgcctgtaatcccagtactttgggaggccgaggtgggtggattgcttgaggccaggagttcgagaacagcctggccaacatggtgaaaccctatctctaccaaagcatggtggcacgcacctgtagtcccagctacttgggaggcggaggcacaagagttccatgaaccctggaggtggaggttgcagtgagctgagattgtaccactgcactcaggcctgggcaacagagagagactctgtctcaaaataaaaaataaaaataaggctagtcttggactttggtatttaaataggaaggagtactaatatttgtagaaatcctttagaaatttgtgccattaatattgtcaccttgtatgaaatgttgtgttctagaggatattaaggattcaaattttatgttaggcacattttgagttattttggggtgactcaatgtctgactctactaaatgccatattagcatttaaaatgcatttgaccttaaatctttgttaattatgccatgacttggtatccaaaaataagctgatacatacatacatacatatatgtgtgtgtgtgtgtgtgtgtgtgtatatatatatatatgtatgtgtgtatatataatttatttggtgctaggaaatgttaaatttaatcctttaatagatgctctttaaaaaggagtcttgctgtatgtatatactattaaaggggaaactatgtctgtgattgtagtgtgtaaaagatagtaggtgattttattatgtactcaatttgaggtctcaaatgtagttatcctcaccatcttactgtctctgttagtagtttggtgttgttttcctggtaagtagctaaggtccttaatcattaacacctaagc

SEQ ID NO: 71504 - DNA, 1029 bp, Homo sapiens
aaggctggtaaggcctaactcttaatttttgtaccatataaaaaaacttttaatatggtaaagggattttcctttataatttttgcttttgtgtgatggtagggtagatagctaaggacttggggacccttttcaatatatattcgaaggttactgatgattgtaagaggttcagaggaaacagccaagaaagatttgagagtttacagctgtttctggaaatctggaaaccatggagttaaaaatcttaactaaagtctgcttggctctatttgcagtgttaatgtgctttctttattttttgtttgaacacagcatcctcatgtctatagtcctgtaatacagggtaatgctagaatgatggcaccaccaacacacgcccagcctggtttagtatcttcttcagcaactcagtacggggctcatgagcagacgcatgcgatgtatggtaggaagcactttgtttgtctcttccagtgtgtgtgactcttcttaatttaagtttctgaaaacatactctatctaagaataacctgaccttttatgacattgagggtcaagaatctgaaggaaaagatgaacccatttctttgcctgacttgctttataacttttggcaaatagtttctacttctgtacctggtcttcagatctctttcctgctttaactaaaatgtaatgatgtatataatggcaaagcatctttgtggagaaaggtacctttctcctcttcctcatcaatattatgctttggtatatcctgcctacgacatgcaagagaattttataataataaaagcataaaggtgttctccagcatgaaaacattttgcttcactacttgatctgagggtcactggcattacatattttttttgctgtttgttataatgataatactatgtttctacatcatgctgtattttaatggttgaatattatgtcatattagatatattttagacatgagtcacactttaaatataaccaatgtgaacagaatgctgaaatgaaaatgagaagtatttt

SEQ ID NO: 71505 - DNA, 1051 bp, Homo sapiens
caggcgtgcaagtaagtcatagaatttgatgttcacttagcctccccaattgtttgtatctgacaccaagcactctttaggttttcagtgacttgagggtgtgatggttatgcatatgcatttgaaacagacaggcatgcagagattcagtgtgttgttaagtatgaggacctaaatctgagaatgttttctgtgaaaaagatggtttagatttactgtagtttggggtttgttccttttagctgtgggtatgatctaattttttaatgactaatggagaatcaggaaaccttctcatgcctagctctctagcaatataaaactaagagtgacagaataccttgttattatcataggtgcctaatgttaattttttttttaattctctcaagcctttatacccaatacctatgacgcccatgccagtgaatcaagccaagacatatagagcaggtaaaggtgagaataatcctgcctgtgtttgcttgtagtttgcatgctgcatgaattgagtaactaagtttataatgaataaatagttgtagtttagctctgactttttgatgaggctatgcattggcttttgatgaacaacattacatagatattcacatggattttatgaagaaaaacaggggagaaaaaatgcccatcagttgtgattatatagtatcctcttcaaaaagagtaattggaggcctggtgtgatggctcacacctgtaattttagcactttgggaggccaaggcaggaggattgcttgagctcaggagcccaagatcagcctggacaacagagactttgtctctactaaaattcaaaaaaattagctgggcatggtggcatatgcctgtagccccagctgtttgggggactgaggcgagaggatcacttgagcccaggaagtagaggctgcagtgagctgtgattatgccactgccctccagcctgggcgacagagtgagaccccgtctcaaacataaatactggctgggcatggtggcttatgcctgtaatcccagcactttgggaggccgaggtgggtgtatca

SEQ ID NO: 71506 - DNA, 1044 bp, Homo sapiens
agaattgcttgaacccagaaggtggaggctgcagtgagccgagatcatgccactgcactccagcctgggtgacagagcgagactctgtctcaaaaataaataaataaataaataaaaggatactgttatgttaagaattgcttttaaggatatttcataagtagctactgtcttttcagctcaagtgtttgttgattggccaggcgtggtagctcatacctgtaatcccagcactttgggaggctgagtcaggcagatcacttaaggtcagcgtggccaaaatggtgaaaccccatctttactaaaaataaatattaaaaaaaattagctgggcgtggtggcagtctcctgtaatcccagctaatcaggaggctaaggcaagagaatggcttaaactcgggaggcagaggttgcagtgagccaagattgcactgctgcactccaacctgagcaacagagtgggactctgtgaaggaaaaaaaaaaagtattttttgattgcctttgagaggaacggttgtatattactcagatttttaaaaaattgttcttttatggctgtattctttaagggattaaggaatgggcaatataagtgtatatgtttcaataaaaacgattagtgatcttctagtgagaacagtttaaatctatatttagcaattttttttaaattgtcaggtatggaagattttagagcaacgtaaagtccatgtagatttcactggcctttatattttttttaggcaagttaggaaatcaacattgaatcccaatgcaaaggagttcaacccacgttccttctctcaggtaggtttattactttctttgaggttatctagtcccaaaaaaagaaaaattattagtaatagtccttcttccatacctgccatctgaattttgttttagtgtgctgaaccaaccttctttcttttttttacatggccattaatgaatactttttaaacattaaaaaaaggtctttgttttgtcatcaattagatgtgatcttgggcaaatctttgaatttctctgacccagaatt

SEQ ID NO: 71507 - DNA, 1049 bp, Homo sapiens
agactagctgacactttactgagaaacctttcttttttataggttgctttttctatagactctcttagcatttactcattttattgtgaagtgtctgatcttatttaaatgacaagtataagaggatagaaactatttcatatttttctcacccagcaggcacaatttctgacatgtggtaagcactcagtaaatattgaactttagaggctaggacatttgagtgctttggtgactgtggttgtgctatataggtactctgttattgttagtttatagtaaaagcattactcttaaagtatgaaaaaagccttattcagaacatttcatgcgtatagttaatattacgtagcttgtgctcatggcaaaaatgtattactaaagttatttaagatatttaagtataattgtttcctttatttagttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagtgagtaaacctggaacttagaccatcctgttactcaattaacttttttttttttaaaggcatttaggtccttccaactgtgaagaatccatctggacttttagactactttatacattgcccttagtttacaaacagctagtccaaacaaatgacatcttaagtaaatgaggttattgcaccctgtgctactcttctgttcttccccttttttgtaccccagggctagaaaaacaaggcataaattaagaaaagtttttctgtaaatgaacaggagttgaaaaattatcaattcaggggacctatctttactggattcc

SEQ ID NO: 71508 - DNA, 1070 bp, Homo sapiens
attccaaaatccaaatttaatatttgaaattattttctgatcttatatcttattctaatttctatcatctcatactaaaaagaatgtgatgttaaagtttaaaaataaacctgtgtcttaacagttcttaattttacaggtatatcaccagttgtttctgaacatagaaaacagattgatgatttaaagaaatttaagaatgattttagggtaagtattgtactaactgatgaatttgagttttagaaaataagcattactaaagatttatctatttataaaaatgcgttatgtatacagtcagaaacatcaaaccatatatgtagaaagcagaacatttttaaagtggtctttgcctatcctttaagtgggataactaaaatcatgagatttggtaacaacaatatgtaggtatcaaatgagagtatagccctgacatttgaaaccaccatagcacagcttactatttgatggtcatttgtactttgttcagtgaagctagatattagtagagcaaggccaagtcattaataatctagtgtggcaaatggaagatgtactggactctggtgttctgaggtagttggagatttatactttgtacacaaatatattgtggtcaaaatctttctgtaacattatttctctgtcttagcacaggctttacttaacatctctccttgattgtcatttcattcttttgcatgttatttactataggtatcgaggtagattttgagaccaaccaataaatcttcttgaaacttagcttcttagaaaggaaaatctaaataccagccttttaaaaaaagtagctgaattaaaggatgagtgaaccaaaggcaaaggtagcctttcctcagcctgtgttttagctttctaaatgttaacaatagcttcattcttgacttattggtaacattcaaaatactacttattatttcatactttagcacatgtatctattcagctttaatgctattaacagttgttaacctaagttttcatttgttggcgggcacggtggctcacacctgtaatcctagcactttgggaggccgaggtgggca

SEQ ID NO: 71509 - DNA, 1109 bp, Homo sapiens
atagttgaaacagattgctacagttcttttaagagttgacatcttattgttgatttcttaccaccaacttcatccctccctttctttaaaaataaagggaaataataaaatttatttataaaactttgtggcattccacaaaataattctgaaagaattagtatggccaaaaaaatatgtatggtgttttttttttttctatttttaaccaaggaaaaactgtagagtgagtgagtgtgtgtgcatgtgtgtgtgaatgggtgtatttagcagaaaagtagtactgatgaatatcatggaatttatgtgatgttcactgtttcttccttagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtgggggtaggtaacacttgggcataatgatggtactcattttgtcattacactagatataaagagggctgagctacaactctgtttgaggaagtgtaagtatgtatatgttaaaaatagtagaatcaccaggaattgggaaacccatatttttattctgggctctaccacttattcatcatatattaaagcaagtcagacactcattctgaagttgagatttcgcagtgagtaaagtgttaataattcttgcctagtctacattatgggattgtgatgagattcctataaggttcataaatacagatatattgtaaaactataaagttttgtaaagtacctctctaatatgaggcaaacacagtatgtaacactatttggagggaccgtatttccttatctttttagcagctttgtttatcagtacattctataaacatttatttttggcttacattgtagtgtgtttctatagcatctgtatatggcactaattcccaactatatttccataataaggaatatcaaatacaaataaagggtccaagttttatttgtgattagcataaggaatatgctgacagcagctataaaagtataa

SEQ ID NO: 71510 - DNA, 1018 bp, Homo sapiens
tatcatttgatactcacaggagtcacaaactctagaagagtaatgttttatttctacttaaatgggacttgcttaataagattccaaactgagttctgggttcaagtgtaaacctgatgaaaatcatagataattgtaaggaaccagcatttctaattggatataatagctactgcttattttcgttatgcctcagagttaaaactaatacagtaaataatcttactcctgagtaggaattattgtgatttattatgtgaaattatctagtgtatgttatattcctttaaacaaccagttactgagaaacagttatagaagcaggattaataggcaaagtcttaactgtcttcttcaatagtgtgtatagatcctaattaaccctttgggaacgtgtattcatttaaacagacttaatcttaaggaggttaaagtaaaatgtgaatttatgtcagttaagttatgctaaaacttatcacaaatcaaatgactgtcctcaaagggttaaaatgtacaagaaatcatttttgtcattttactttttttctgtttacttttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaaggtacaataccacaatttgttcatgtttttgtttgtctttgtttaactcctatgtgagtttataattacaaaatagtttcctcttcattatttaataacctataatttctgtgttttaactttagtttattaaaactatttctattaaccttttgttcattagagagaaatttgataaatgtgtgaagctataa

SEQ ID NO: 71511 - DNA, 2512 bp, Homo sapiens
tttacaggttagagaaaagagagaaccctgatctgaaggctattttatgaagtaattaaaatgttctaaactttaaaaataactgctcaaataattgtgttgtatagttacttatcaactggaggggctgataagtatttttctaaaacatttttaaggaaattttttcctattttctaatttgctaattttgctcaagtagtttgttagatattgttaatatagatgttggttataactgaatgaaagggaacaactactttgacattttgaaaaacaagcttcattttcttctagtctaatggatgggatcccaatgatatgtttcgatataatgaagaaaattatggtgtagtgtctacgtatgatagcagtttatcttcgtatacgtaagtttgaaaagtttgtttttattttagtgcatttgtctttgattttcatcagcttaatttatgatgaataaatgtttgttagtttttaagttaaacaattacatgaaataatttttctcttattaccaactgtgataaatttccattaaaaaaagggaataaatgtagtttgcctataccctgtttttatgctctaaacaaattttggttttgtctttttttttcttttgagagggaatctcgctgtgtctccaggctggagtgcagtggtgcaatctcggctcactgcaacctctgcatcccgggttcaagcgattctcctgcctcagcctcccgagtagctgggactataggcgcgtgctaccatgcccatctaatttctgtatttttagtagagacggggtttcaccatgttggccaggatagtctcgatctcttcacctcgtgatccacctgcctcggcctcccaaagtgctgggattacaggtgtgagccactgtgcctggccggttttgtcttctaagttgttaaaaaatatctaaatttgcaagggcagagattatggtgaacagtttaaccagtttttgaaatatgttcctctggagaaaaggtaacagaaaaaaaagttagaattttgatttataaatacacagatcactataacttttagttttagttttagttttagtttctgtttttaccagtattctaaactctaaactttcttagtagttgattatgacagatacataaactgtggctttaaaggactcattttgcttttcttttcctcatgtttcagagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactaggtatttaaaggaaatcatgatgcagtattttggatacacaactcaaggtctgtgtgagacggtgtattgttattatatttcctcttcctttaatatagcttaggtagagaatgcaagtagaattggtttaagatctgttagagaaaaggttatggtgatcttggaaaatatgcttttgagagtaagctctgtggagccaagtgttggtatatcacggtgagcaatccaagatcttgaagagcttgttaaaatagttatctggtgggggacacgtgtaacaatcacagcagtacaatatgatttgcttggttaaaggcatgttcaaagtactaggaacatacagaatgaggaggagctagcataacctgtagagtcagagaaaacctcattgaggaggtgacattttgtgataagataatagggtctttgacacttagagaagagttgggagaagagtttatcacctgatgaaaagccatgtacaagcatggctatgagaaaatttggccagctcaggagagggctggttgttgcatgtgtctggaacacaggatctgtgtcaggtgcagcagtggcagttgatagtaggaactgaggtcattaaaggacttggcatgtcatgctaaagagcaccctgttggaaggagatggggtgaataaaccctggggcattgaggactggctgagacacagagaacagttagtgcactgaaatagttcaactgtgagaatttggtaaccacctagttaagggatgagcctgaggtttatttgataactaagtgacttaatggatgtactggtaagagagagaggaaacatggagcaagtttgaggggaaaaacagtgactccgtttgtgcagctaattgcatatgtgggcttgtgggtctttcatttattcataaacgtgttgagaaatacctgctacctatctagtaaagtaagagatgcatcctctcttaaaggcagtcagcttagagtctggtgatttgaattgacatgtccactgatagatgttgacactgtgagactggcggttcagtttgaggtttcatcagcattgccgatattggagccatgaaaaaccaaagaacagccagtgagagaagagatctcag

SEQ ID NO: 71512 - DNA, 1077 bp, Homo sapiens
aggttgcagtgagccgagatcacgccactgcattccagcctgggcaacagaacgagactctatctcaaaaaaaaaaaaaaaatgcttcgtgtggcttaaaattatatgaaaagaaaatacctttactgatagtcatctgtgattccatttgctaaattaaacgtgaaagcatacttttactgaatactatatattccgtatcagtttagatagcagtttatcttcacatacataagttttaagtttacctttattatagtgcattggtcttttgttttcatcaacctaaattatgttcaataaatgtttctgttagattttaagttaaacaattatgtgaaattcatttttcgtaattgttttttaacatatgtctttgttggtaattcacgtgtgtgagtgtaactgattgccagattatataaactttcaaccaaaaccattctttgcagatgcttttactgactctgctatcagtgctaaagtgaatggcgaacacaaagagaaggacctggagccctgggatgcaggtgaactcacagccaatgaggaacttgaggctttggaaaatgacgtagtaagtaacatctttgtaattattgctagactctggtcagtatgacatcctgtcacttggttgtaatttaaatgtgcttttgttgttgttgttattgtagtgagtgtatttagagcagcaggtttgttgtataactagagactttctcccaagcaatatataaagaaaaatgtttgtcattttacttgtaggggttaagcaggagtactgtctgttcttgtggatgctcatgaattacttctttgtgattaaaataaataataagaagtagcttaaattaaaattagaaaccatgggaaatgccggtgtgttttgctttaacacccagccaaataaggtagcctaaggaaagtggtgtcttaattgttgacttcacctagagaagaggttgaagtaggacattttaagcctcttgtctgaagaaaaggttgtcattaagataaataattaggttacattggaattaaagcattacataaatttcttggtcttaaatttgg

SEQ ID NO: 71513 - DNA, 1036 bp, Homo sapiens
tgacagggtcttaccatgttgcccaggttggtctcaaactcctgagctcaagtgatctgcccgccttcgcctcccaaagtgtctgcgccctacaatttaaaaaaatttttgtagagacagtctcactgttacccgggctggttttgaacttctgccctcaagtactcctcttgccttggcctcccaaagtattgaaattaaggccatgaggcagcacacccagcctaaattcttcttatgttctgttcttggcacatagtagatgttcaacaatgtagagtcaaacgcatttggagttggaatggctctggtgttttttttttttttttaaaccagaaacacgtgcagtttattgaatgccattgtagaaaagtgtgtgaggataaacggctgatagagaacttggctctgggggcagggcgaggaatggagggtggatggagtacatgggaatcagatcacgggcagagctcctggcctagataatgcctcctgatctgttgatagacttgaaagatcaacactgggatgatgctgagcagaatggtcgtaatgatgcgcacaatcagggcccagatgttcaggcacttggcggtaaaggcataggcctgggccctgatcaggtcgccaaccatcttcttgtccctagacttcacggagtaggccaatgctatgaagcccaggcagcaggagttcatgaagtgggtgttgaacagggaccagacgacatggtcgggcacggagttctcgctgtggatggggatcacggtggacattgggggagcagggttgtggggtgcccccagcacagccacctcttgctcctccttgagcatctcatagttagggggatggccgatgttggcaggagtgaagaggtttggacattgtggttcatggtgtccagggaagaccagctgtggtcgggttgctggggtggttctcagtgggcccctccctttccctggtagtttggatttctctggctctggtggttttttagtactcattctatttacgggtgaagaaattgaga

SEQ ID NO: 71514 - DNA, 1005 bp, Homo sapiens
cgcagcctaccctgtctcttaaaaaacagtaacaacaacaacaacaacaaaaaatcctaaatcttaaaaatggaaggcaaaaactctaagctttgagagattaggggacttgcccaaagcaatatttgtaggattttattacacctctccctttatttatttttttagagtcaaggtctccctctgtcacccaggctggagtgcagcctcaatctatggggccaagcatttctcctgtcttagcctcctgagtagctggaactacaggtgtacaccagctggctaacatttaaattttttgtagagacagggtcctgccatgttgcccagattggtctcaaactcctgggctcaagtgatcctcctgcctcagcttcccaaagtgctgagattacaggtgtgagccactgcaccgagccccctccctttatttttatttttaaattttaagttctggggcccctcccttgaaataaatagaaacgtaatatatacacaagatcatgctgtgtattttaaggcaatggtcctcaacctttttaacactagggaccggttttgtggaagatggtttttccataggggcaggggatgattttgagatgaaactgttccaccggccgggcacggtggctcacgcctgtaatcccagcactttgggaggccgaggcgggcagatcacgaggtcaggagatcgagaccatcctggctaacatggtgaaacccccctctactaaaaatacaaaaaaattagctgggcgcggtggagggcgcctgtagtcacagctactccggaggccgaggcaagagaatggcatgaaacccgggaggcagagcttgcagtgagctgagatagcaccactgtacttcagcctgggggacaaagtgagactccgtctaaaaaaaaaaaaattgttccacctcagatcattatgcatttgttagattctcataaagagcatacaacctacatctcttgctatatgcagttcccagtagggtttg

SEQ ID NO: 71515 - DNA, 1029 bp, Homo sapiens
tcggcctcccaaagtgctgggattgcaggcgtgagccactgcgcccggctgtaaggtttttacttaaccattctattgttgggaattgggtttccacttttttgttatagatagtggtgcagtgaacatttttaaatagctttttgcttcagtgtaattatttccttagagaaagttaccaagagtggttttactagttcagagggcttcaggatttttatggctcttgctagcggtgctctattattctttagaagacttgtattacttccagtgtcaagaaggttgctcttccatggaatggtttctttgtagtttgtcaaatattgtggggaatttttaaaggaaaaattgcatttttactgtcaagtgcatatattattaagtgcttttgttagttactggattattgatatttgagtttaatttggttcctctgaggatttaataaggtaatatatgtgaagatgttttgaaacctgtaaccattattattaatgagggtacttggtttatctgtcgtgctgatagtactgagtaaagtgcaggaatgaaattcctgaggaactgttctaaagctttgttgttgttgttaacctttctttttcatctgaaagtgttttttattagctgctagcctatgaccaagttatttttggtaacttttttgtaatttcatggcactattgggaattttcgctggttgactcttcttcttctacattcccttccccattaaaaataaaaatatggatttacaattgttactctattcctaaacctaaataatatgacattagaattgcttgggatacaggattcagtctgaataaaatatttttcttttagtgattttcagcttagtatttttactgcttctttctcttgaggcattgcaacttaaaaattgtgctgtttagccaggcgcctgtaatcccagctacttgggaggctgaggcaggagcatcacttgagcccaggaggcggaggttgcagtcagctgagattgtgccactgcactccagcctg

SEQ ID NO: 71516 - DNA, 1083 bp, Homo sapiens
ttccctttttcgttggcatctagcgaaaaatgaaaaaatttaaaatacaacttttatagaaaaggatgtattctgtttttactttcttaggtattaggaagagatttggcagataattcaacatgttcaaatatataaacattaaaactaaggttattaagttgcattgactactaggcttaaaaattagattataagagaatttgctcctgagtagtttgagtgatcaaagatatttggaatgttttagtaccacaaggtcttttttctgttccttgaggctttacaacaatttaaggttaatttagatttttccttgctttaagttcttttacttgagacctaaatggcagcccttattctttctgatgaataggtgaaattttgtttactgtgttggatttgtgtaatgtgaagttttattcttgaacagatcgttaatgtacttgtagaattactttgaatttgaatcactttcctgcattccttgtaaataagtttcagcttctagaatctcctcacttaggtttgtgcgtatcaacagtgaaaataagtctctgagagcaagggtgaaaaaaaatgcagcattcggtttgacaagtttcgagatagcaaaatatgcttgaaagtctggaaattcacatctgctttaagaaacatttcataatttgactttgtgtgtgtgtgtgtgaatagtttttcatgactttcagaagtgatttattttgttctttgttatatatatttttgaaggtggctgttttaggaaagataatgtaatcacaatattagaacataattttactgtaatctaattttgtgtgtgtgtgtgtgtgtgtgtgtgtgtgtgtgtgtgtgttttggatggaatctcactctgtcgcccaggctggagtgcagtggcctgatctcagcttactgcagtctctgtctcctgggttcatttaagtgattctccagcctcagcctccccagtagctgggattacaggttcgtgctaccacacctggctaatttttttgtatttttagtgaggacgggattttgccatgttggccaggctggtctcgaactcctgacctc

SEQ ID NO: 71517 - DNA, 1095 bp, Homo sapiens
agtactttggaaggccgagacaggtggatcacctgaggttgggagttcaagaccagcctggccaacatgccgaaccccaatatctactcaaaatacaaaaattagccaggcatagtggcaggtgcctgtaatcccagctacttgggaggctgaggcaggagaatcgcttgaacccaggaggtggaggttgcagtgagctgagatcgtgccattgcattccagcctgggcaacaagagcgaaactccgtctcaaaaaaaaatacacttgtgttaagtagagcaaaattcttgctttgcatagctgattgcgatggcagaaaaccattctccctcacgatgggagaaaggggtctgtcctaaagggattctgaggtcatggtttctctgttcaatcccagagcagaaaggggactgtgtcagcaaatgaaaaatgtgcttttgtcttcctttgtttttcaaaaggtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaa

SEQ ID NO: 71518 - DNA, 1113 bp, Homo sapiens
ggagttaagagagtaactgcttacagttttaaacagacaataactatttgcttctctctcttttttttttttttgagacggagtttcgctcttgttgcccaggctggagtgcaatggtgtgatcttggctcaccgcaacctctgcctcctgggttcaagtgattctacctcagcctcctgagtagctaggattacaggcatacgccaccatgcctggctaattttgtatttttagtagagacggggtttcttcatgttggtcaggttggtcttgaactcctgacctcaggtgatccgcctgccttcgcctcccgaagtgctgggattacaggtgtgagccaccatgcccggctttgcttccctcttaatgtgttaatagttgtctctaaaaatatatgcaattcttaaaaaggtaccatttctgatttattatctgtaacctttggaaactaatcacatgaaactacaaaattagcaaatgtcttgaaatctgtatataaaacataaattacctctaattttgaaccctaacttattagtgtacagctcaatatttaaacaaaaaatgaaagagaaaaaaaaagtggctccaaaaatagtcttataccattctttaaaaaaggaaactgttccttttaagtttacacccaccccacaccccaatttcaaaacatcgtttaattgtcttggtcattgacatttccaacataagattttatatttcgctcccatagcttctggttatcaaaaaacccatgctttcttttattgaaggagtttggtccagctgatgttggtgtatcccttccaatattcttcatcttcatctttgcttctggagatttcctctggttcactatcttcatcttcattaaaagctgctgctcctgaaaaagtgcttggagcaagagttggaacagtttcttttggcttatttgatccaagtttgatggatattgttgatgctttctttgtcatccaactaaggcaaatccaaacttggagatcactgtaggctttgttgggaggtctgcagcttcttcttcatctgaccgtttctcaatgctgcgactggaactttcccctccattactggaagaaacagttttagtt

SEQ ID NO: 71519 - DNA, 1119 bp, Homo sapiens
taattaactaacattcattcaagaaatacttggccgggcgcggtggctcacgcctgtaatcctcacactttgggaggccgaggcgggcgggtcacctgaggttgagagttcaagaccagcctggccaacatggtgaaaccctgtctgtactaaaaatacaaaaattagctgggcgtggtgacaggtgcctgtaatcccagctactggggaggctgaggcaggagaatcgcttgaacccgggaggtggaggttgcggtgagccaagattgtggcactgcactccagcctgggcgacaagagataaagtccatttcaaaaaaaaaaacaaaaaaaaaacttatgctcatatctgctggagccttccttgtgtgctgaatcagacagcgtctctgttttaatggcaccagcagtatcatggaggaaacagatgaattaaataagtgcagaatatgtgtagaattacaactgtggtaagtgctgtgaaggaaaggagaaacaatttgggaaagtattacaagaagatgtgtttggtttggagagagggatgggggcaggtagggatggtgtcattgggaacttcctgaggacgtgacctttgaagctgcaaattaaagattgaatatgactttatagcttatgagcacctttccaaaggctaaaagtggcttctgagttctgagagtcagctaaattgatattagccgcatatagacatctgcatgggtcagtcatgtagtcatttattcatcaaacatttagagggcttcctctgtgtgctcggcactgtggtataagggctgggaatacagtggtgggcaaaacaggccttgtccctgccctgacagagcatgtattagggatatttcagttaagtctccaaattccgtttcccttttcatgtgtttcattgatttaagacagtaatcacagatgttcatggcttggttcatggcatgagcataagccaggatgtttaagactacccctacaagtttttgaaattttgtttttttaatggacttgatagcttcattttgggctgaacacaatttcattttatcaggtgttactaaaatgttagctcatctgggcatgatcactgttgcatcttctctaagg

SEQ ID NO: 71520 - DNA, 1142 bp, Homo sapiens
gtggggattacaggcatgaaccattgctctcagccctggacttcttacctgggggctcagggctccaaaatagtgtgtttcaagagacagagggctgggcagaagctgtatcacgttttctgacctagtctagtttcaggaatccctcagcatcacttccacgtgtcttatatctgttagaagcaagatgcttcactgggccaagcattagactctaccttttgtgggaggagtgtcaaaggatttacagatctgttttaaaaccatcacagggagggagtaattcccggaacccagagaggctagctctctggggaaggctgcagagaaggagctggggaaataaataaccaggccctttcccatctcctgcttttgattggctgagtccagctggaagccagagggcaagggagcctttggagcacacagcccagggagctcaggcacccgggcacagaggggatgggagggtggggagccaagcctaaagggcaaacagaccacgcagaatccaccctagccggcagttttcttagtgctgtctctattcctcctgcgacttttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtaggaactgctgctggaggatagtgggggagcaagccagttctccaagcatttgggagcaaactcagctgaagtagtccgtgattgggcgggggaagtgaaagtgaggtcctggtggttctggtgggaaacataactagaatgcagtcctgtcacatttacgggaaagtggatataggatgtgttttaagtgaaaagtatgcctgtataggtaccgcttatgcttttacacagctaacttctatttagggttttaaattaaaaacacattcattgtggctgggtgtggtgtctcatgcctgtaatcccagcacgttgggaggccaaggcgggtggatcacaaggtcaggagttccagaccagcctggccaacatggtgaaccctgtctctactaaaaatacaaaattagctggacgtggtggcgt

SEQ ID NO: 71521 - DNA, 1046 bp, Homo sapiens
ggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggctttgtggactttctgtgtcatacaaagagaatcgagtggagaggttcccttcagcgccttcatgcctcctcctgcctgtgtttcctcgaggtccaggccatcatctcagccccatacatgctgggagcacagaggccacgggtccgataagtcccgagttggctgccttccctcactatgtagcccggggctctgtgctcatacatactttacccaggagctggcatgtgaggcccctgcagcctccacctgctccatagtcagaatatctgggcgaaggggaggtggtggcccattcgccattacactttggagcacaatctctcttctctgaggagagtggaaatgcttactcacttgcagtctgagctccttgagaaacccagcgacatgcagaggtgagccaggggcagtgaggccccagcctgctcgtctcataactcgtggtggggtagccaaaactcgtctcaggttagaccagacgggcaggaaccatcccccccggctgccaccttgcagaggtgaccctgtgggaactgccttccctgagaatggccagccaggatcagcaccatgaggggcccgtgaatgggctcctcagacccacatgcccaggggtctggggaggcaggtcccccttcaccacacttgagaaactgcttgttgctcaaggaagttaaaccccaaacaaatgcctgtcacaatgacagccacactggccaggagcccactgctaagctggcaggagcgcagcagctgagtgctccctcaggctccgggaggagaggttttcttcaaaaaaaaggaagtggtcgtggcctggcctgtctcatgggcctaagaatgtctttcgtggcctctgaggtt

SEQ ID NO: 71522 - DNA, 1125 bp, Homo sapiens
ccgtgcctgcccccaaccagcagcccgaggtcttctgcaaccaggtgagcccaccggccgggctcgcgctttgttttccggcccgagtcccccgcaggcccctaggaaggccccgcgccgccgtgggccttagtgtactcatctggggctcgaggggtttgcagaggctgacctggaagcacatctgccccctcctctcctgcaagcattttagccccttcgccgcctctgacagtccccgtcccatttccccgtgacttgggccccctctccgtcttcgcccagcctcggtctgttttccagggccaactctcggggttccgttctccccatggtccttgctttcgggtctccgcagggtccccaccctcacccactcagaagacgcgaccaagtccctctttgcaggaactttcctgtcttttccttagtcatcccctttaccccctgactcatgccctcatccaaggagttcaaaaggaaaaaccaggaaagaggtgatttgcagccacgttctccagttcaccatgggcgaggccacgctcggctgcttccattgctgggagtagggaatcctggaggaccttcggccccagggggccgaccccaaggggtgtctgcggcttccaacgccggcttcgaccaaaccaaggaggagctttccaggataaaactgattcctgtggtccatttattgattgctcaatcagtaatactttggaatattttttgttttgatctttgagtttggttaaagttctagacttcacagaggctgaaattggttatgaaagagtttgttttgtttgtgccagtgcatgttggctgccttctctgacttaagctttttctcctataaatggaaaggcgctctgagggttaggttcacacaggccctcatcaaccagtcacttcatagttaatcacagctcctgtcctgtctgcacagcctttgtgcagcactgttctaagcgtctacctgttttgcaatttaaggtaatttttacaacagcctcagtaggaagggactgtaattctccattttacagatgaagagactgagtcacaaagaggtttagtgactcacctaaagaccaaagtcagtggcatagttggggttcacag

SEQ ID NO: 71523 - DNA, 1004 bp, Homo sapiens
gaggtggatgactattggccccagctgtcctcacactgtagccacacaagggaactctgcccagatgagcccaaccaggggactctactgtgggagataagaaatcattttaagccaccaagttttagggtgctttgttacacagcaatggataactagaacaagtatgaacattctcttcattttttaaagaaaccaaggcactgagaagtcaagtgacttacccaaggtcacttggcagagtgagcattctggcctagattgtctgcaaggcctgtgcttttcatttgtaggctacaccactctgaaattaattcatatttgctttttcttgtttttttttttccttacaatactggtagtcagtattaggttgacagctggtcctgagaacttctttccttctcattgtagattttcataaacaatgaatggcacgatgccgtcagcaggaaaacattccccaccgtcaatccgtccactggagaggtcatctgtcaggtagctgaaggggacaaggtgagaactggtgacttaccttgggggagggatggattcgtcttctattttatacgtttttgtgtggtgaaagctttaccatatatgtgtattactttcacaagtaacagataccagtgaaaaattccgagtaaattaatcaatagaaacttgtctgcagacaacggtgttaattcacttagtgtagaactatagacttagaagtgaattcggcaaatatctaatacagtgtctcctttccagacctggaagttgaaggtcagagatggaaaccttgctgggtagaatttgggtctcctaagatctagctcctgtggaggtttgaattgtacagactgtaggaaccaatcgaaactgataatattctgtttaaaatttttaaattagactcttagtaaaaatattttgtgtttttggccgggcgcagtggcgcaggcctgtaatcccagcactttgggaggctgaggtgggaggatcacttgaac

SEQ ID NO: 71524 - DNA, 1108 bp, Homo sapiens
ggccaaggtgggcagatcatgaggtcaggagtttgagaccagcctgaccaacatggtgaaaccccgtctctactaaaaatacagaaattagccaggtgtggtggcatctcttgagtaatcccagctactcaagaggctgaggtaggataattgcttgaacccgggaggcggaggttgcaatgagccgagattgcgccactatactccagcctgggcgacagagcgagatttcgtctcaaaaaaaaaacaaaaaaaaagaaaatacagaaattatccggattctcattcccaccaggacttcatgaaaggaggggaaggtcatgttattcaaccccattgctgaagtctggtgctcatcagggctctgccgggctaggagcattgtttacggggcaggttttctgtgcagcgatatgctgatgaccttctggatgtgtttgtattcggacctggttattactgagaagacctgagttttccaggaaggcttgagttttcctgtgttttctaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggtgagtcctcagcccttctccccctcagatcccatgtggtgaataggctcgcagcatcctgtgaacagccaggaaccaagcatcctgtgaacagccagggaacacacatctgacacgggactgatgggaatggcataggatggacacctttagggggcacctctgtactaaccagaggagcctttcagtgtctcctttgtttttttgttttgttttgttttgcttttttgagatggagtctcactctgtcgcctaggctggagtgcagtggcgacatctcggctcactgcaacctccacctcctgggttcaagtgattctcctgcctcagcctcccaagtagctggaattacaggcacaagccaccacgcacagctaatttgtgtatttttagtagagacaaggtttcaccatgttggccaggctggtctccaacccttgggctcaagtaatccac

SEQ ID NO: 71525 - DNA, 1032 bp, Homo sapiens
tgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttatttacctatttatattttagagacaaggt

SEQ ID NO: 71526 - DNA, 1115 bp, Homo sapiens
tgagaccccatctcaaaaacaaaaatacaaaaaaaaaaaaatactccctagtgaatatccttgttcatttctctttgtgcatatgtagaataaattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtccatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttggcgggaggtgaggtaaacagttcagcctggcatcctgatgctgtcacccatctgctggcttggggccagatctcaagttatacccagaaccagtgcccataacacgctattcatagtatgtatctgatcttgtccctcctcttcagcttgtaccctctgtctgggagatcgtctgcattcctcagcatggcctgcaggccttggtgtcctggccctcagagccaggagtctaggaatgacattgtctgctccttcccatgaccttttttctttcagtcagattcttgctctgttgcccaggctggagtgcagtggcataatcatggctccttatagccttgaactcttgggctcaaatgatcctcccacctcagccttctgagtagctgggactacaggtgctcaccaccatgcctggctaa

SEQ ID NO: 71527 - DNA, 1071 bp, Homo sapiens
tgggcaacatagtgagaccccatctctacaaaaaataaaagataaaaaaattagccaggcatagtggcacatacttgttatcttaactacttgggaggctgaggcaggaggatcactgaagaccaggagttggagaccagcctgggtaacataatcagaccctgtctcttaaaaaaaaatttattgccaggcgtggttgcacgtgctggtagtccagctactcaggaagctgaggcaggagaatctcttgaaccccagatgtggaggttgcaacgagccaagatcatgccatggcaactccagcctgggcaacagagaaagattctatctcaaaaaaaaaaatttttttttaagttaaaaataaaataaagactttggggcaatacagggggtcctgggagtgtaacccataacccccaagagtgatttctgcaatctcgtttcaaattacagggtcaactgctatgatgtgtttggagcccagtcaccctttggtggctacaagatgtcggggagtggccgggagttgggcgagtacgggctgcaggcatacactgaagtgaaaactgtgagtgtgggacctgctgggggctcagggcctgttggggcttgagggtctgctggtggctcggagcctgctgggggattggggtctgttgggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcacggt

SEQ ID NO: 71528 - DNA, 1215 bp, Homo sapiens
cctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgtggatcgcgctttacagccctggggccaagggttatgggtgtgggtgtaggtgtgtgtccgactcccgccagcttccctggtgagtgtgatttgtgctcagctggaacagaggtgagtggcctggagacactattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttctaaaacctgtttttaactttttttttttttaaaggcacattttgcccactcagggccagttatctgtcttgacagctgtagctaagaaattagtcttatgaaaattaaacattgacgcttaaagtttgatgtattatttacttatttgtagtgttaagtcagcccagtgcattgaataatttcattttatcttgaaggacaggcatctattggcagcttggggttattttccccttcaagacagttactagtaatgattaagaatttacatttctaccaattctttaggtggtgtatatagtttctcaaaatcatcaagtcattccaaagaaacttaaccctttaaaggaggcatcaacatataacatatacattaaggaa

SEQ ID NO: 71529 - DNA, 2357 bp, Homo sapiens
taattttcgtagtttttagtagacacggggtttcaccatgttggccaggatggtcttgataccttgacctcatgatctgcctgccttggcctcctaaagtgctgggattacaggtgtgagcccggccgagaccctgtctcttataataaataagtgagtgaatgaattaattaattaaattcttttttatctaaaagcatatggcaacagaggctaacatgcaatagttagccaagaattccattacaactttcattaaactgtagaggctctatcctaaactgttgaaagttatttatatcagaaatatacttacataatgaaattgacagaatatatctgtacacaaaatggtggtgttggaaattagatgtttactatgatattgattagttactattttttttgaacttttaagtctcagtttattcagttattccaataatgtaatcaacttgttcagggatataggcctctacagcttggcagcatatatctgactagtctttctagaatctcataaaatatacttgaccattgtagcaaagaggcatttagtaattgatgcattttgaaagagtatcttcctctcagaaccccccaaaagcattgattgtctatggaaatgtaccttatagatgagctgaataatttccttttatcgtgaagtctttgctttcttgttggaaaattgggaaacaatgtctgagtcattgtcatttagacaaaatgtcataaagccctgtagaacacaaagttctgcttatcagattctcttagaagatgagctgttgagtgacaggtcttctgttgtcccatctctgcttattcagtttgttaactgaggaatcattctctgtcctctccctttttttatattaataggaaacttccattttagaagaatacagtatcaattggactcagaagctgggagctggaattagtggtccagttaggtaagagatccatatgagaaactatggcaaattgttggcatgtgcaaactctgagaagggccatttgaaatacatcttgaattagacacatcaggtgtgccagatttgaggaataggctgaatttaacaagtacaggtttttatgttaggctttttctcatgtatttaggaattagttaagagtgactgagtcgcatggtctttttatagagtcatttaagatgtcgagactggccaggcgcggtggctcatgcctgttatcccagaactttgggaggctgaggcaggcggatcatgaggtcaggagatggagaccatcctggccaacatggtgaaaccccgtctctcctaaagatacaaaaattagccaggtgtggtggtgggtgcctgtaatcccagctactcgggaggctgaggcaggagaatcacttgaaccagggaggcagagattgcagtgagctgagatcatgccactgcactccagcctggccacagagcgagattctgtctcaaaaaaaaaaaaaaaaaaaaaaaagggtgtcgagactgtggggccactgtgagagtcacctatagccagctgaggccattattttttcattgacccacagccccaaaagcatggcttagaagctgaggcctgagcattggctgctgggcagaggggtgagatgcttctttcccccacctgctacccttgggggcaagtttgttctggatgcacctggccatatccttgatgagaagtacaaatctcaaagaaaaagcttgttaaattaattttcattctaacatatatgatctctgattgattttttttctccaaatctagagtctgtgtaaagaaatctactcaagaacggtttgcgctgaaaattcttcttgatcgtccaaaagctagaaatgaggtatgctttattgcctcgacttaattaaatagttgaagtgcctaagaattgttcttttgcaagtaaggcagcttcctagagagaatacagtgatgcataaaaagttttatgtccaaactttacctctcttccccattcatgctatcttagtaaagtagtcctagatctgtcaatatcaaaggccattgagtcatttcctttcagccacctcttgttcttttaaaattaatgtgattcttgtaccctcatgtattcagatttacctcagttttgcttattgaagaaggtacttaaaggtggagataaaatagcacaaggaagagtcaggtgaatggtgtataaaagtgatgctacaggaggactctgaggatgtttctagtttgtttcttctttttgagacagagtttcactcttgttgcccaggctggagtgcgatggcgcaatctcggcttacggcaacctccgcctcccgggttcaagtgattctcct

SEQ ID NO: 71530 - DNA, 1151 bp, Homo sapiens
gaaatgcaaataatttctaaaatgaaatgaattgtttgccagattttcatttgcaaataaatggaacagtaggaagtaaatctgttggtgagtttttattcatggaaaaagcattaaggagataatctttgaaaacactgggtttttacatcattctaagtgataaagtttttattgtaattagcttgtacctagtatggtcagtttttggagagaaaatgttggtatcccctacctattgatacatttcctctgttctctttaaggtacgtctgcacatgatgtgtgccacacacccaaacatagttcagattattgaagtgtttgctaacagtgtccagtttccccatgagtccagccctaggtaagactacacagtgtcatcatcaaatgcccacatgtaggccaatgtgtagtggagctgtcctctcttttatgtgctccctccccttccctctccttcttcctcctaccctcgcttcctctgcccttccttctccccctccatctccctttttgtaatttggaaaatgtcaagcatttgtaaaagcagacagaattatgtaatgaatcctcaagttctcatgatccatcctcaacagtaatcctcttgtggccagtctaatttcatctatgcccctaccactcttcacatcccctgatgattctgattactttctcatttcaagaaagcatttaatgtagaatttaaacagattctatttcaaatcagtgaaaggggcccaaatattattctaggcagagtcttagaggctgataaaacaaaaagcctttattattgcttagtctaactttccttttaaagaaagaaatcaacattattcttttagttaccaaatgtttggcaagcatattgggtggcattctaagtctctttgttaaaattcaaaattaaataaggtatggtttttttggggaagactgagatgtaaacccatcatcatagcagtgcaataggcactaaggacaggcatccctaaaatattctaagcttacaaaggagaggagctgctaactatagtctgggaggagaggtgtctcacaaaggctgtgtggaagctaggacttgaaggaagggtaggaattttccagatggaaaaagaagatagaattttaaaaacaaatgggaa

SEQ ID NO: 71531 - DNA, 2082 bp, Homo sapiens
gatgttttgacaggagaaatgtgaccccttttatacttgggggtgggggtactgtgttcttaattggttgtcaactgtttcctgaggctgctgtgagatttcaataaactctggaaggaaggcatcttaactgctttgtagactgcagttatctttaggcatgtagctaccaagtactgttattggactttgcaataaaatgctgctgataccacctgaaagattgtatggtataaaaatgtattttaagagaattgtacataagatgcttcctgcatgtgagccacctttctgtgatttcttcagatttaataatatcctaagatctttgtaattctgaattattcctggttatattctatgttgacatcacattttattgctgtagaaatgatttatgtcacaaacaatactaggaatccagctgataatcacttcttgcagaggtgaaaagctaaaccctcaaggcttatcttcataccaggcaagcaaagcaaagagaattaggaagcacagcccaattgcttcttaataaaaagttcttccaagtttcccatgaaccttaagcaattttggatgcctcctttctggtagggaggaactgatacttggattgctgagaaaatgccatatggagagttaaagaacaagtaaaatctgttctttctgtttgatttttaaaattatacctttaattttttcaaatattaggattaaaggatgagctctgataatcttctataaaataaaaccccttcaaatccacataaacaggcaacattttcaacaagcatgatgagcaaaatgagtttccagtatgaattggaaaaacccagtcagctgatttcttgaccctcagctccctggagagtgccattcttgtctgagccctgctgtgggaactgcgcctgctgaccattgctcagcttaggtgtttcttctgcagtgtctgtcatacctcagatgaatgaaagtgggagcatttcatttttcccatttcttacaggatttacccatcagtttattctgacaaagaattgctgtaccatcatatttttctttctgtctgacaaaatacaagttgcagttaaactaagcttaatccattctgtttcttggtattccaagtttttcttaatttctgctttaaaattgaaagtgaacgcagtcttaatgaaggcttgttttttgacatcctgagttctctacgccaggtgtattaaagagtggtcttttctaagaagcgactgtttcattgtgtcttttttcagatagctttggctctgcggcactgtcacttgttaaacattgcgcacagagacctcaagcctgaaaatctgctttttaaggataactctttggtgagaagactgtttttctgcattttagtgctgcaactcttaacatagttcaggagtgggtgtgtttggagcgctctgaattcatggtgaaaaagctttaagccaaagtgcttcaaacagcttatttcttcaactcgttcccttgctagaggctcagagaagctgtactactgtactcccggcattgataattttggatgatactgatatgtatttgtgggacttaatgattttggatattatttggaggacctttgggaaggggcaggaatctgtatgctgttatatattatctcgtttcatttgctgttttccctttcagctctgtcccctgccccatgtctcaccagataagttgctctgtctatcatgaagcttatggcagatattaaaagtgaagtagcatcccagattgatgagaggtgatgggcttatagagtgaagggtccctaggccaagaccttgacgttagtgctgcccttacaagttctaaagcaaaaatagctgtgtgagtgggtaggaattccttacttctgcattactaaggacagttcctcagtgtgaatcattgtctccagacctggggacatgttattttcataagttcgcatctcagctggaaagaaacttgttagatctcagggtaacatgtcttacacctggattttcctttaatgtttactgagcactctggagcagtgactccttttttttttaattt

SEQ ID NO: 71532 - DNA, 1075 bp, Homo sapiens
caaacccctgcactcagtgaacaaccccattctgcggaagaggaagttacttgggtaactgagcttatttcttcgattcttcttcatggctggaatggctgagtactgggttctgaaatttaagaaatttaacttgctcagctaggggtctttagcctctgaagagggtggagaggataagttctttaaatagtatcaggagttggacactattgttatttttctgatacatctgttgccttatgtttagaggtaatatctgtccagagttggtttttggggtctcacgttgtcattacccctccctcaaactcttaaagcaccaagccaaaggacagtgtctatatccacgaccatgagaatggagccgaggattccaatgttgccttggaaaaactccgagatgtgattgctcagtgtattctcccccaggctggtaaaggtcacaccatttactaatcctctgtgtgtctgtgagtgtgtgtgtgcaggggtgggtgggtgtatgcatgcacatggcaaaaggaatggtttaattttgggttgtctgtttcatcttgtgttataagaaaagtacattatataaggtagtctatgcccactaaaaagattggacagtgggagcttagaaatgcagttaagttctgcccctcctttgtttctgtggaatttctagtttagacttaattggcagtgtcaggtgcaagcatgcaattttgtgttttcttagtttgacaacaagggcacaggttgggggatggagaatggaaaatgtgggtagggtctgaatctcattgcaggctgttaaccatttccagagcctttagagtgcaaggctgccattagctcataaataagagaatacctccttagttcagaagtggctcctgctgctactcatgtcatgggcagagtgacttacacgtgggtcctttggagtgagagctttctttcgttatgttctctctccactcatcggcgggtgaggggctattctcagcagataaatgagatgcttcacgtactaggccagaaaacagttgggttgacctatctatctccctagattccttgg

SEQ ID NO: 71533 - DNA, 1123 bp, Homo sapiens
ttttcttgatgaaatgttaactagacacctggttagtcagcttttattttgaccccacagttttttttttgagacggattctcactctgttgcccaggttggagtgcaatggtgtgatctcggcttactgcaacctacgcctcctgggttcaagcgattctcctgcctcaccttcctgagtagctgagattacaggcgcctgccaccacgccccgctaatttttgcatttttagtagggacagggtttcaccatgctggccaggctggtctcgaactcccgacctcaggtgatccgcctgcctcggcctcccaaagtgctgggattacaggggtgagccaccgtgcccgggccccacactttgtttttatgttagggcagttggaggaactgaactttgatcctgatcctttatatactcccatggtgaaacttgagcccattttacttaacacaatatatccgtgcattaggaaaacttggtagagaagattatatgcagatataaaatatctaaactcatttgttatgaaccaacgataatgagggaaaacttggacatccacatacagattttcttgaattaaagaaaaaaaccagacactgacaaaggagagctgaactgataaatggtaccctgaaaactgcagaaatgagggaaagaggcagtgggccacaaagaactttgtccttttcagagatccccagagaagccctgcccccttccccccaccccctgacagaatgttgtgtttcaaagaatgagcagattaatggatatcaagttgtgtggcctgagctgaggataaagaataatttgcctgaggagttacagtactggctggatcactacaggccttctacttggaatatcttcccatgaaagtaaaaggaatataactaaggaagattaaagttgttgctgttggaaggaagacatactaaagaaactgccgaaggccaggagagaagcaggaagagaaacacggcttgaagttctgtaagaatcagagttgggcaagaactgccaataagggagccagcgtagatctgagtactaaacacctgagcctccgagggtttgtgtgcgagggagagctctgctgatggacataggcccagaa

SEQ ID NO: 71534 - DNA, 1050 bp, Homo sapiens
ataaacacagaggtggtgctggctggaatggagatttggaccgagggggacctaatagatgtcacagtggacttgcaaatcacactcaggaatttcaatcactggagacaagagatgctcttccatcgtgcaaaacacgatgttgcccacatgatcgttgggcatcaccctggacagaatatgggccaggcctttctcagtggtgcctgctcaagcggttttgcggcagctgttgaatccttccatcatgaagatgtgctgttgtttgcagccctgatggcccatgagctcgggcacaacctgggtattcagcacgaccactcggcctgcttttgtaaagataagcacttttgcctcatgcatgaaaatatcacaaaagaaagtggcttcagcagctgcagctctgactacttctaccagttccttcgagaacacaaaggggcctgcctatttaacaagccacggcccaggggccgcaagcgtagggattctgcctgtggaaatggtgtggtggaggacacggagcagtgtgactgtggttctctatgtcagcatcatgcatgctgtgatgaaaactgtatactgaaggcgaaagcagagtgcagtgatggtccatgttgtcataagtgtaaatttcaccgtaagggatatccttgctgtccttctagtcgttcctgtgatctcccagaattttgcaatggtacatctgcattatgccccaacaacaggcataagcaagatggctcaaaatgtcatacaatttacgagtgccttaaagttcattgtatggaccctaataatcagtgcttacaattatatggatatggtgcaaaatcagcctcacaagagtgttacaattcaatgaacagcaaaggggaccaatttggaaactgtggcatttctaccagtcctgggtcacaatatgttcggtgttcagatggtaatatattttgtgggaaacttatatgttcaggtattacaggcttaccaaaaatcaatctccaacatacaatgattcaggtccctcagggagatggctcatgttggagc

SEQ ID NO: 71535 - DNA, 1033 bp, Homo sapiens
atttcctacactgtcaaatatatgaaagttccttttgtacgttcttcaacactgatcaacaagcagtttcagtccacatttgctttgatctgtcactgagttaacccaagctgcttcttcagagattctggcatcttgggggagggcaagggaggctgaagtagaccttcacagaatcatagataaactactgtagtgcagtcagagtaccagtcataatgatacagacaaacattcccttccatacacctttaaatccaagtctctggaggacttgagaagcactgctacctttttctttattcaacacagataccacagaatcatcagggtgagaaacaattgcacaaaacactccaggtatgtaacctgctacaaatgttacaaccagctcctctgtctttgaacattcaccacagggcttccgaaccacaaacttgtacaatgcttcaacagtaccttaaaagcaggcaaacttcatcatggcatatgctatctgtctcatccagagaggagcaacccctttgtagaatgtttttaggccttcttccttatacatcttgggagctgcatccctcaaagtcttggtctaacctggttgggtttgaatttgaaccttagcagcttccatagggcaattacagcaaagaattcagcactggcagaggcagccaaatacagtgatgtgcaccagagataacatgctctgggagtatgttgctatacaagactttaaagacttcataaaagccaaacttgcagaacacctgcatggagtggccaatgaaagtcagagcctgtcctttagccaaagaatgaacaccatcctccttaagtgtaactgagaatccattaaatatgcccttctacttttgggggtccacctgcatacagcatttcactaaacccaggggaatgaccgcagtgtgtgtcagaccacaacctaagaccccacgagagccacacaatgcataatacttcgtggagtcaaattcacaactgtacttttataaggcagcagctgccaggttaa

SEQ ID NO: 71536 - DNA, 1050 bp, Homo sapiens
ctgaacttgactaatagactgaccgagggttggagcgggtcccaaccaactgcctgacggcccaaaggcaggaagaaacgatggtaggccttgtcatcttcgaaggagaggaaggacagcaaacgaattgctatagcgtccccatgcgcacttggcgcttctcctcaagcggagcaggaacggaactgggcggacccgccggaagactcggcgagtgcgcgcgcgcaggagcccattttcccgcccgcaacgtggccccgcccttttacccaggccctacgcgagcttcgccgagtacgcgtgcgcagcagcttcccctccctcgccccgcccctcacgtggccccaccctctcaccctagacagatgggagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtaaccggggcgggggacgtcgcgcgcaggtgccgccggggcgcccggaagagcgcgcgcccgtggggagacgctggattccgggagctgacgggaggtggtctgtagcaacggtcccagagcttcccggcgtcctacaggcctagtggactctgagcggagaatgttatgaccaccgggcatgcacgcttcagggccccggcgcacccttgcttttgcagcatttatacttgcatccacccttgcaaagatgcagccgagggaactgggtgccccttcccttcacctgtggggagagggcggtgcctggcgagatccaaccctcgagtcccaagtgggagaaccggagggcggtgcgaggtcgacgccaccgggctcccggctgtggaagctgggaggggttggcggggggaaatgca

SEQ ID NO: 71537 - DNA, 1119 bp, Homo sapiens
agcccttggtgtccaatgggctagtgggaatcagctctaccattacctataatcaggcaactcacttctttaaagtatagataagttcattattcattcattcgttcattgagtaaaaagttactaaaggcctgccaggcaccatactaagtgaacacagcagggaacaaaatggcatctcttagctcatgaaactaacattctagtgatggtgaagggaaagaaacaacaacaaaaaagatactggaaatcactgaaaggcaaagcatggaacaaggctgccagacagaacactagtacatttccttttggttcagtcgtgatggaagagaagatttgaaaagagactggagaaaacgtttgttcattcacgcaacaaaatagttattgtgcaccttctatgagacaggtaatctgttatgcagcgcagacgatcaggaacaaaatagacaaggagcttcttcatgagcacataatattccagtgagagagaaagatggcaaaatagatttttaaaaaatcagtgatgagtgctgtatggagaaataaaacagattaatgtgactggcactttagactggggggaagataaatcaaggaagaactctaaggaggaaacacttaacctaagcccgaatgatgagaagtaactaactagcctttcaaagtttgggcagagaatattccagtcacaaggaacaactagtgcaacatatcctaaggcagtaaagagcaaggaatattcaaaagacagtaggagaatggttgggagatgagagggaagccaggagtcaggtcatatagaacttaggctactgtgtggagactcaagagtggaagcagggagaccagagaagaggctattgtaatgttgacctagactagggtggtaatagtagaaaacactgttagctttatggcgcaaagtttccctttgggtcacacttgttctgtgatattatctgattcccatggagcagggtggggtaggggtgtcattttgccagtaaaggcccccaaagcatagggtgctgtagggtgtgtctgagcatgcctgacaaccaatcagccacacctacaccattttttttttttttgagacagagttttgctcttgtt

SEQ ID NO: 71538 - DNA, 1052 bp, Homo sapiens
ttcagggcagataagctagtgagaggccaggcttgggacaatgtcttctccctagactacacttccctctggctagatctctgggttttaaactgtcagggccaagacttttaattgcagtaaaattcacataatatttgccattgtaaccatttaaaagtgtacattctgcatgattcagtgcattaagaatgtgcaaccatagaggttactatctagtgccagaacattttcatcatcccaaaaggaaaccctatactcattacgcagtcactccccagtcttcctcctcccagccccagcaaccactcatctattttctgtctctatagatttgtctattctgatggaaatgtacaatatgtgcccttttgtgtctggcttttttcacttagcatgttttcaaggtttgtccatgttgtaccatgtattggcacactgttactttttatggccaaataaatattacactgtacgatagaccacatttttgtttattcactcatcagctgaatgtttgggttgtttccaccttttggctactgtcaatagtgctgctatgaacattcacataacacattttgtttgaacacctgtattccactcttttgggtatatatacaagtggaactgtggtggtcatatgctaagtctacatttaacttactgaagaagccaaggacttcttttgatggtttctcccaatgcacaagttttatctaacaagccaccttagggtaacactgccttcctcacttccatcaactttttgttttcctaatccaagtgatccctatcaagttttttcatcacaggcaatcactgtaaataatcatgtcaaggctgagcatggtggctcacacctgtaatctcaacactttgcggggctgaagtgggaggatcacgtgaggctagaagttcaagaccagcctgggcaacatagctggcttaaaaaaaaaaaattagccagtcatggtggcacacacctgtattcccagctaaactactcaggaggctgaggtggaaaatcacttgtgcctaggagttagagg

SEQ ID NO: 71539 - DNA, 1639 bp, Homo sapiens
aactctggcctatctagccaaagcgtcctccatgatgccaactcctttgtaggtaggtttgtttatttttgtcagatttcttgttcagggtttactgcgaaaggcctcctgggatgatgagcatgacaggggctgatgtagtatgcagagggtctccttcacctaactgaaaggaaccctgaaggagaaggccttagtatgtctgcagccttgtttattctggacagggttgtgtatatctttgattagtgtgaacaggtactaatggggtgccctgcatgttgctggcactcactaaattgttaaatgagtcagtgggtgaatgaataaatattagtttgtgagagcttgcctcccttgtgggcttgtttccactctatttcttaaacaggggccccttgggaaggggaattagccccaaaagtccctggaacacccacttgctcagctctatacgccctcaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcaggtatggacaagtccaggacggctgggggggcagagagggaggaagctagaaatcgtttccctacttggaacaggaatacccagcatctttccttctgagccactctcaaggagtgtaagtaaacaggttcatggtctctaaaggaatctgctgcccacagtaggcttaacctgagcagattttgggaccatggaatctaagctcagctgtacaggtgcctgaagggaagggaacccctcttccttcacattccacccctctctgacattaaactgtgagaactttgagctctccttgcagggaacactgggcagagggggtgctatgtcccctaggggacagcatagtcagttcttctgtcttcatttcagtttatgtaccaaaactgttaggttttggtgttagctcaaatgcactgatgccaccactaatccaagggcacctcccaaccacagcgacagctttaatagtcaccagcatttagtggctgacagggtaaagatctgcacccccattgcattttaaatcttcacttgaactctgcctgagaagcaagatgtattatctccatgttatacttcaggaaaaaaaaaactgaagctcaaagattaaaggactgtgggtgatagagtggctcatccagagctccacctaagtgtttagtcccaggcaggggcttacttatttcacttccctcccagcttggatgcctccattccgtagtaagctgggaacttagtagagcgtctggtcctgggtagagatagctggcacacctctccaggacagtcagtcagatttgactcaacttcaggtaactcccttggtgcttttattagaataataataatagttaacatttatcagatgtttactgcgtgccaggccgctgtgctgagtgttttacatgtgtttcatctttgcaagagctctgtgaaggaagtcccatgtggtactattacctccattttttcaaatgaagaaatggatgcttagagtaacttgctcaagattgtggaattgttaagtggcagaa

SEQ ID NO: 71540 - DNA, 1108 bp, Homo sapiens
agttctgccacttaacaattccacaatcttgagcaagttactctaagcatccatttcttcatttgaaaaaatggaggtaatagtaccacatgggacttccttcacagagctcttgcaaagatgaaacacatgtaaaacactcagcacagcggcctggcacgcagtaaacatctgataaatgttaactattattattattctaataaaagcaccaagggagttacctgaagttgagtcaaatctgactgactgtcctggagaggtgtgccagctatctctacccaggaccagacgctctactaagttcccagcttactacggaatggaggcatccaagctgggagggaagtgaaataagtaagcccctgcctgggactaaacacttaggtggagctctggatgagccactctatcacccacagtcctttaatctttgagcttcagttttttttttcctgaagtataacatggagataatacatcttgcttctcaggcagagttcaagtgaagatttaaaatgcaatgggggtgcagatctttaccctgtcagccactaaatgctggtgactattaaagctgtcgctgtggttgggaggtgcccttggattagtggtggcatcagtgcatttgagctaacaccaaaacctaacagttttggtacataaactgaaatgaagacagaagaactgactatgctgtcccctaggggacatagcaccccctctgcccagtgttccctgcaaggagagctcaaagttctcacagtttaatgtcagagaggggtggaatgtgaaggaagaggggttcccttcccttcaggcacctgtacagctgagcttagattccatggtcccaaaatctgctcaggttaagcctactgtgggcagcagattcctttagagaccatgaacctgtttacttacactccttgagagtggctcagaaggaaagatgctgggtattcctgttccaagtagggaaacgatttctagcttcctccctctctgcccccccagccgtcctggacttgtccatacctgagatccccacctctgccaccaagagatcatcgctggaagccgagttttcagcaagacgcttgaactc

SEQ ID NO: 71541 - DNA, 1820 bp, Homo sapiens
agtagctgggactacaggcacgcgccaccatgccctgctaatttttttgttatttttagcagagacagcggtttcactatgttggccaggctggtcttgaactcctgacctcgtgatctgtccgcctcggcctcccaaagtgctgggattacaggcatgagccaccgcacccgtccgagcttaatactcttaatcacaagtagacccccagcacctagaacagcatctgacacatagtgggcatataataaatattcagaagaatctccattttttcagatgaagaacagttcagagagtttaaatgatttgcctagtgctgcatggctaggaagtggcagaggaggaattcaaacacaggtctgtatggttgctcctcactttgaaccattacacggccaagaaaattcttctttccctcagttcagctaggtcccatagcaattttctgccctgagttccttatggtcttgctttttgtgtctggtttctgctcacagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttctagaaagcagaataaagagcacttgtgccaacattcacatcttttcttcagac

SEQ ID NO: 71542 - DNA, 1136 bp, Homo sapiens
ggaaagtggagtctataccagcttagattcaaagaggaaagcaggtcatagacgaaagtataatttgaaaagaaaaaagaatggcttcaggtccacttaaccaaaacactgaaactttaattgaatgagaattacatctgtcaaagacctgggcagtacactcctctctcctctctatagcactcattccttctgaggtgtcatttcaccagccacctgagtaagtgctccagctatccccagaccagctagagacatcccaagcatggtcatgttagcatcaatgtccaggcatactcagggctcagaatcgtgggttagtaccacttttcccactacccccttatattccacaagggactcacagccagcaggttaactctcccctccctacccccaccaaaccctggaaaatcacagacagcctttttacagctcctctttctcggcccccttcttctggaaggcagtcaggatgtttaagctcttctggagctcctccttcttcccgtcactcatcttgttcttctcaatcagcctggcgatccgtgtcatctctgatgctgggaagtcctccccttggtctaagatcttccccatgatcttcaggtattgctcggcccacttcttctgagtctccttcacacttgagaggttatcttgcccctgcttcaagagggcctggcgggcctccacaccagaggccctgatgaactccccggccagggcgtcgtatacaggcaggcaaccaggcatacctaggtagaccccttgccccttcagccagcgctggatggctccaaccttaactgccccagtgtatgggactgggttctcaaagtccccatcccggaagaggtagaagactgggtagctctctttgtccagcttgtatttctcactcagctccatgttcagcttgtcaccataatctgtgagcagaaaccagacacaaaaagcaagaccataaggaactcagggcagaaaattgctatgggacctagctgaactgagggaaagaagaattttcttggccgtgtaatggttcaaagtgaggagcaaccatacagacctgtgtttgaattcctcctctgccacttcctagccatgcagcactaggcaaatcatttaaactc

SEQ ID NO: 71543 - DNA, 1065 bp, Homo sapiens
tgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgtatctacaggcttgttattgaaacttcctacttatttgatgtgatttattaatataggaagtatatattcttccttaagtaagtgaagcatagcaaatctactttaaactggatgggttaatttatataaacattttcattttaagttggcatttctgcctggttcctttttgttcagattcttagaagccacaaccttctgaatggtgtaattcatctcagttgtgaatttagggctatatcccaacatatttttaatatttgagaatttagaatttttatttgaagtcagctagtccttttgactcaaaagttagtaccttctgtacttgcagttattaattcaacatatatgt

SEQ ID NO: 71544 - DNA, 2383 bp, Homo sapiens
ttagtagagatggggtttcaccatgttgaccaggctggtttcaaactcctgggctcaagtgatccacctgcctgggcatcccaaagtgttggaattacaggcgtgagccaccgtgcctggcccagtttttctaccttatataacttacaacaaagggtacttgaaagagtaatgatgctaaagcaatagggtttccatgaagaatcacatcgaaaaatacccattcgtgatgaccttttgccttctttgcattttatgcaattgaaaatgacccactgtgttctgatggagcttgcaatgagaccaaaggtaatggcagctttaacttttatctgagaactagaatctggggggatggtttttaaacaagactaattattcttgtctcctcctttataggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaa

SEQ ID NO: 71545 - DNA, 1140 bp, Homo sapiens
tatttatatgtgttgagctactgggttcttaacataataatgttactaatcccctgtcataggtgatgcagtttttttttcagtttgttatttgtcttttaacttgagtgattttttttttgtcaatgtagtaatatttttaaaaacaaggataatctttttaatggtttttagctttgtgtgatgtttagaaagggtttttcagctgtcagtgtcatgattgcagaagttgttacctaattttcttccagtgctttgatggatttttttttatttaagtatttaatctatcggaaatttattttaatattactgtgttattttgtatctccaaatgtctagctggttattttagtaccattcattcacttgaaaccactggtttgaaatgccactatttaaattccctcacatctttcagtagcttttgtgatgtagatatgggtaatatgtttgataatgtttcaactcttttttaatctttttcccagccacctgtctttaccagtttccaagactatgttactgggcttcagactttaatttccaatgttgtggatcatattaaagggcttgaaacacatctaattgcacttaaacttgaagaacttattttagaagacacttctctctcaccggtaagagattgtaggcaatcggcaatgttttctacacacacacaaacactctgtctctctctctcatctttatcacaaggacaagttaaagttcaatttatcatttcctctttataagacttgtgactagaaggtgcttggcagtagtttcttgttgtgttgttggtggtaggttttttcccctcttcatttctccccatacgtcctcctttctatgcatttttggggttgttcttttactatgaaaactaatgccagcattttgagcaacatggaaccagccatattttgaaatccagggacaatcttcttgaatagaatttacctgctgctgagttagctgtcttccttgccacccagttatcacctgagaaaggagaaatgctggacatgagaagtaattatgtcagtaataattaggctagagcaagccaaccaaaaagggaatgaaaccaagtatggaatcaaaggtaccaccatcaaatgtcttctgatattattt

SEQ ID NO: 71546 - DNA, 1041 bp, Homo sapiens
ttacaaagtaatgttttagaagcttaagtccattccatatttaaaatcacttgttaggtccaaaagttgaagaaattcttcatttgttgaaaggctgttggattttaaaaatgaagcagtaggctgggcgcagtggctcacgcctgtaatcccagcactttgggtggccaaggcaggcggatcacctgaggtcaggagttcgagaccagcctggccaacatggcaaaagcccgtgtctactaaaaatacagaaattagcgaggcaaggtggcgggcgcctgtagtcttatctactccagaggttgaggcaggagaatcgcttgaaccagggaagcagaggttgcagtgagccgagatggcaccactgcactccagcctggatgatagagcgagactttgtctcaaaaaaaaaaaaaaataaaaataagaagcactaaactttgtagagaagagatttcttttgtaagctcctagtgaaaatcacaaatactccatagaccttttccttttatttatttattttttaaatcataaggttagtagatcctaccattcagagtgtttgaagcacatagattttaagctctcttaaggaattttaggtagtacctctggcaaaaaggtaattagtgcctttctttttattcttccttttcctttcattatcattttctttttgtctcaaaataatgaaaaatgcataagggtctgtagagagaagaaaatgtccttgcccatgaacttcttgcaggtatttatcttgcttctttatcttactaaaaatagaattgaaagtttttcattttttgtttttcaattttagaggatacaatggagattcaggaacgaatagaaaatagttttaagtctttactagaccagttaaaaggtaagttttcctactgtagattcctgtatttgtatctggttgtatggcaatagcttcgaagttctttcccctattcccaagcccaatcacccagagataagtaagtagttttaacactttggagtcaatactcctagatgccacctaaacac

SEQ ID NO: 71547 - DNA, 1050 bp, Homo sapiens
gtaaatgaaagctggaacccttcaaaggcatcttaactggtgaaagttaactttaaatgatttgaggccaggcgcggtagctgacgcctgtaatcccagcattttgggaggccaaggcaggcagatcacgaggtcaggagatcaagaccatcctggctaacacggtgaaaacccgtctctactaaaaatacaaaaaaaaaattagccgggcgtggtggcaggcgcctgtaggcccagctacttgggaggctgaggcaggagaatggcatgaacctgggaggcagagcttgcagtgagcagagatagtgccactgcactccagcctgggcgacagatcaagactctgtctcaaaaaaaaaaaaaaaaattgaaagcaatggattgaatattgaataagttagataatttggggatgtttctgtttaagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcaggtaccatcaatacatatttaccatcaaagttgcaataattatatttatgactgttttataaacaggagtttggggtgggtgagtagtaaggaattgttttgtcccagtttatggcttctgcaggagaaagaggaatattttagactcagagggaattgcagaggcttcctcaatatccagactagtgagggagaaagcaaaataactttttgtggtgttaagtttttaatagctagcaacaaattaatataaatgttctgtttttactgtaatgattcagttattagtttgctgattagtggcttttagctgaaccgctgagacaggtttttatctactagttacctgattttcttattttgtatgcatttagatggat

SEQ ID NO: 71548 - DNA, 1540 bp, Homo sapiens
ggtggcagaagctggttattacaattagtaatattagtaaaggagacatttgtctaaagtataagaaggaagaaaaacattttaaaaagctaatattctacttggtgaccaagacctttaaagattagatttaaaacttaattttagtttgagtgttttgttttggctggcaaggtttgcttacattgcctgacttgtgaactatttataccaaggtgatgtctttccttctcagacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatgtaagtattgcatgagagctataaaggaactaagggattagatcagttgttaagagccattaatgggctcatgggtgttattggcaggcttaaggtaaaatagggggaaaaaagggagagagacagtggggaaacagaacttggcacatgtcatggggaatggtagagtactgccagcaacatcttgagaccattacagaagccatttaggtcatggtcatcaatgcctggtccatattgtgcttacgaaggttccgcctcccctacaaatcaagagatttcaggaattaatgctgatcccctttgttttgtgtgggcttccagaagcctttttcttgccatgtagcaagccagtttgatctgcgcttggttctatttcaccttattatgagcccttccttcctctttcccttcctgtctagtaaaacaggaagtcctgattaataatattttctggctattttactattaaaataatatgtggatttttctctatcacagatcaaccagtttagcagaaagtataaagtcaatgaaccttaggccagaagaagatgacattccatgggaagatttgcgagacaacagagacttaaatgtttttttcagctgggatccaaaagacaggtaactggaatttaaccccaagcaatttttaaagtttttgtttgttttttgtttttttaaagagaccaagatcatagctcactgcagcttcgaactcctgggtgaagcagtttatttttaaagaattaggttgggctgggcacggtggctcaggcctgtaattgcagcactttgggaggccgaggccggtggatcacttgaggtctggagttcgagaccatcctggccaacatggtgaaaccctatctctactaaaaatacaaaaattacctgggcgtggtggcgtgtgcctgtaatcccagctattcgggaagctgaggcaggagaattgtttgaacccagggagcggaggttgcagtgagctgagatcgcaccattacactccagcctgggcaacaagagcaaaactccatctccaaaaaaaaaaaaaaaaaagaattaggatgaatctaaaattaaaaaaaacaaacttcactttacacaaatataaaataacatgtgtttgttgtagggatcagaaaatata

SEQ ID NO: 71549 - DNA, 1053 bp, Homo sapiens
ataggcatatgtgtttagagtatcctggcctcctcttgatagggtgtatcactgtcctttaatcaagctagaaggtatactcgagctttttcaggtagtccttcttgaaacctgcaggatcacaagtaatctttttaattttcttgtgtccgtccgtctttaatttctccagatactgcaggcaaacagctcgccgaggtgtcccatgggggtttaaaagccgcatcgaatgcagttgaattagcgcccgtggcgcaatcccgcggcctgaaatgaaccctgcaaggctgtatatcagagggtatgttgttgactattggcctattttcctactgggcaaattattcagacgtaatggagatgggggcagagctgattaactgaggctgtgtaaaaagactgttttttctagaaaggatcttttttgggggcagacatcagctttgagcataatagtttccttggcccaaaggggtaatctcctgtcttctgatcctgatggcatagacccacacccatgaaatgttcttccctgagattttcttctattgtgccagaatttctgcttagaattctttatcttgcctctgttctgtaatgtttgatctctgtatatgtattaagctacaattaaagcacatgtggtgaatgttcccttcacatacttgtttaaggaaatttccagcagaggtcttacgtaatgtagatggacaagaaacttggttcttgaagtctttgtcctcagaatagattatgacatgaattttgataggtcttttgtttggtgtcttacttctatcctgacgtaatgctcatatgccctgtgtttctaatacagtattcagaaataagcaaaaccaaggagcagcctgtctttttctgaaggagagtggtttttatttgggggggcggggggcaggtggttctattattctggtgcttttggaacctttgtatgaaacacagtttatcttagatgcagaaaaacatggagtaacatcccttccagaatggcactaaccaaatttttgactgatgtggcaaaacaaaacc

SEQ ID NO: 71550 - DNA, 1048 bp, Homo sapiens
agtagagttacatatggaagaaaaatgatgtctatagataacatctgtctggggttttatagaggaaatcctgcaggggcaaggtgctgagctccagttttccttcaaagtccatctcttcccagaatctgagattctgtgagattctataacatccccccacaagacctggccacttaaaatctgcatcgtttttgctgtgggcatgtttaagaatagacttaactattgaaggactctctgttgaggcgaaattctctattttggttacaggtgtatatctaaaatttgttctctgtcatttaacttcatttattggggggggtgatgatgtcaataaggttttgttttttgtttttgggaagctttcatttgctgtcaagatcagtggataatgctgtattttggttctaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattgggttggtagtatatactctgaataatgagcagccagctataccagtgtggggtacacaggactctaacttagattttaaagttgattgtgacattaagcctttctgattaaataataacctgttatgatccattgcaaaccagaaagatttttatatctcccagcattttgtggtaatttgaaaatttgcacaatttagaaatgtaagagagttttccccagagatagcaaacacctatatactttgaacccttattcttagcacacattattttgaagtgttcatttccgctttgcagttgaagttgacacatgtaatttatttattgacctcaacaaagtttgaatttgtattttgaacttgtatttagactactctttattattatgctagtatcacttaatggcattttctctgtttgtggtgctgttttaggaagacagcattatgttc

SEQ ID NO: 71551 - DNA, 1692 bp, Homo sapiens
aatttttttttaattttttggtaatctgctcttttctatagtcttcctaatgttttcattgctgtaatatatattatgttaatatgctgtaagttatggaacattttcagaagtataaaaatctttcactgcctgtagtacgtggtattgacaaatacttttggccagtaatgaatgagtgtgccagtttcattggagcttcaccagtgttgtgtgctgtcacaaattttttttgttttagctattttggtagatagaaaatggtttatgaaaggaattttagttttttttttcttgatgtctttttctagaccattcaatttctgttaattatggcctactgaagactagttgtgttttgagacctttgctccttttttccccactttgcagtttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttggtgagcaaccattcaaaatgtgcagtagttccctgatctacactaagacttagaaggcagttttttaagcacctgtagcaccctgttttaatgagttttgtaaggagactattttgtctgggaagaccatctaagtaatatgatgtaaagcctttcttaagcctggagttttaaataattctgattggctttcagttgtctgtattcttcttgatctgatgagctaactttttattagattggggctcatatagattgcatagtttatgataattatcacattttctgcttgtaggcctaaatattcttaatatatagactgtaagtgaacaaaaagaatattgtaaattgtaagataaatatttagtttagaaatagatgatcttcagataggtgtggcctttgctagatatatgtgatagacatataattgtctgactataagatgtcagtatttatctgtagtctaaagaattagatgaagtcaggagcatattgtgaatttagttatacatggcacttggcttatgttcttttcttcacctcaacctccttcaaatcttccttctctccctttgggaccatcatggataccacctctgctctggaaccctaccttctgttccagctgagtgtggtctcaccttcttttgaaccctttgaatcgtggcttatatttttctcctggtacttatcttattcttaattttcttttacttttcctcctctccctcctgtcactttcctgcttttaaaaactcctttggggtcagtaatagttgaacaaatgttaaaatagatatgatttttttcccccatagggaaaacctgtttgaaaacagaattgcaattttctgactattactgtctccttgctgtccatgcgcttattgatgtatggagggaaacaggtaagtagcagtgatttcagttcaactttactttttgcttttattgattataagtactgcattctttcattagactaattttacaatccacaaattttatttatgcttttaggttctgcttttcttgatatttctagggtgcttccagaaaaacctgtcttggccaggtgcgatggctca

SEQ ID NO: 71552 - DNA, 1041 bp, Homo sapiens
ctgcaacatccaccttctcggttcaagcgatcctttgccttatcctctcaagcagttgggattacaagcatgtgctgccacgcccagctaatttttgtacttttagtagagatggggtttcaccatgttgccaggctggtcttgaactcctgacttcaagggattgcccgccttagtcttccaaagtgtgggattacaggtgtgagctactgcatccagcctatttttttatcttttaaagactagtcaggtgcagtggtgaaaagggggaaagagtagaacaatgagttcagtctgtaactgaacaagtagttgagataacccgctatcttgggaccagttgcaagcaaaattttgttttaattgaaatgaatgttttcaaattaattctcacttaaatagaaattgcttctgttcatgagtaataaagtgattttgttccccgtcccccaggtgatccagaagaattaatgttccagtattttaaaaagtttggcgataaaccttgttgttttacagaccttaaggtgtttgttgacctcttacctgctacacagtgtacaaaagtaagtactatacagtttagaagtttgttgggtgcctctatttgttgaaacacagaggttaaatgtttgggtttcttttctaaaatgtgcggaattgataatcatgagatacaatgataactgccctgtcaagctaagtactctatgtgttacaacactgaaggcataatttctggttaagtcacaacgggagtaaagccctaacagatggtggattctcctttttttgactgtcttattttgagataattatggatttacatgtaattggaagaaataacacatctcgatttacatgtaattggaagaaataacacatctcatatatcctttatctgtttgtcccaatggcaacatcttgcccaattatagtgtaatataattaggaaattgacattgctctcatctgttgaacttactcagtttttgccagttttgcatgcactgatttttgtgtgtttgggtgttgtgtatg

SEQ ID NO: 71553 - DNA, 1243 bp, Homo sapiens
tacttttagtagagatggggtttcaccatcttggccaggctggtctcgaactcctgacctcaagtgatccgcccacctcaggcttccaaagtgctgggattacaggcgtgagccaccacgcccagccaggcagtatttcatatatacaaaattatgcattctttttttaaaaaggtaagttatgctgcagtaatcaaatgccaaaattgagagtaatcttataacatgttatctgttagaatatgttcatagttctcttttattcctttttctattattttatattatcaaagtcgtttttctctttttaaatgagtttggcttgactttaagcttcgggaaggacaatagaggcaataaaattcctttttcatgtgcttttcctcagctctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtaagaaaccatgatatctggtaagcctggagaatgcccttaatacccaagtgctatattcattagttgagatctacactggacagagtcatgtttgggaagcagatgtcttcatagcctgaaaatatttgctaatgaatggatcacttataaaattagtcctttatcatatattcaccttggcttaacattaacttatctccctgttccgtcagagtctttgtcaggcattctgttgctgacccaacaataaagtcaaaatcagctggttgcggtgtctcacgcctgtaatcccagcactttgggaggctgttgtgggtggattgcttgagctcaggagttggagatcagctggggcaacatggtgaaaccccatctacaaaaaatacaaaaaaattagctgggcataatgacgcacatctgtagtcccagctactcaggaggctgaggcaggagagtctcttgagtccaggaggcagaggttatagtgatctgagatcgtgccttcactccagcctgagcgacacagccagaacctgtctcaaaaatttaatttaaaaaaataaaaaaacctggctgggtgcattggctcacacctgtaatcctagcactttgggaggccgaggtgggcggaacacctgagctcaggagttcaagaccagcctggccaacatggccgtaaccc

SEQ ID NO: 71554 - DNA, 1079 bp, Homo sapiens
cctgggtgacaacaatgagactccatctcaaaaaaaaaaaaaagatacttgtgccaccatggtgctgaattctagttagggcttaagaatgaacactgaaaatcattaatttctcaaattcagtattcccctaaaagagagaggcttcattctttgctacaacacttctctccccttccctctattttggaagtgcttatgtggggacttttctgttatgaatattagttttctagacctggtcattttattgaaggaaagagtagtttactactctttacaaatacaaagtagtattactttgaaaatgcccttttagatttgcaaaggaaacatggagtgggtgggggtaagccaacctactacatactaaaatataacttacaaaataaattgaatatcatggttcctaaggaagatctgtcacaacttgggtttaatcctgtgtgcatcattcaatctgattttagctcagatgactggcagttctatctgacttatttcgattctgtctttcgactgattgaagaggcctggagtcctcctgctgaaggtgaacagtaagttgtcttctttcctgaattataacagcactttttaatatagtgtagtgaaaggatttcattataagccaattgaattctctttttctgtctcaataaagtattcctttcaaagtaagacattttttcatattttttaaagtataaaatacacaagttcattctaaaaatcatgttagtgccaaaatatgtggtgtgctaatttccacttatcctaccattccaaaaataactcttgttaatagtttggtgcctttccgtgagatttatttccatctttatgctaagataatttttctttttctcctttttttttttttttttttttttgagatggagtttggctcttgtcacccaggctggagtgcaatggcacgatcttggctcactgcaacctctgcctcccagaagcaagcgattctcctgcctcagcttcccgaatagctgggactataggtgcccaccgccgtgctcagctactttttgtatttttggtagagacggggtttcaccgtg

SEQ ID NO: 71555 - DNA, 1074 bp, Homo sapiens
gtgagcagaatctggtgttattaactttattaatttcatgtgttaattgttgttaccaatttaaggtaactagctactagtaaactgtgtaatgaaaggaattggcatttctcttctagtatgtgaacatctcaaagatacctggaaggctttcctcttcaaatacctgataatactcataaataataaacagcataggcatgctccctctttacattcttctagaaaaatgtataaataaccgacttaaatgctaggttgtattgtggaagctcagtatttcaagaacacataggataatgaatctttagcaaagaaatcttttgtaaaacaaactgctccgtaatgtacctccttggcagggaattcatattaggtctgatatttgacatggtggattgataattatgtgcccaattaacagtaatgttaatatcaatagtgcaagcaggggagaattagaatgaaacattatttttcttctttcagtctatatcggcacaggatgaaaacctctcaaaaacaatgtttctgccccttgctgagagaatggtcgaaaaaatggtgaaagaggacaagatagaagctgaggctgaagtgagtattttaagccttacttttgtgttttcatttttttgctagtgctacaatattatgttataatactatgaactgttgttttgttccagtttgatagctgggtcctcacttttggcctttgggtaaatctgaagccctcagcgtaggtctaatcactgacctgtttccagcaagtactctaggctgagatgtgtatagacgggagagatatagatggagaagatcctgttacctgcttcgtactgtcagtttcatctcatttgaagacatgctctattaaataactttttaaaaacctataaatgactgtctttttattattgaaaagtttcagaggttgcacttcttgttttttttctgtaaggttgaactttattatatgatcctggaacgtttgggaaagtaccaggaggccttggatgtcatcagagggaaattaggaggtaatttttaaacattttcttaaagcttttt

SEQ ID NO: 71556 - DNA, 1404 bp, Homo sapiens
tttaaatgcctttgggacagggacgcgatctttgaatctttgtcaggaatagatagtttcttctacttcataggacctccatgtaatttttgaattagattggcagtaggcaaaagattaaaaaacatatgaaaattacctgatggagtttttagcatcaattactagttggctaattatggatagagtctcaattatgcttgaataggtctattcttttttaaaagcatgttcttgcttttaagtatttgcatattatacatttcataatgaaagatttcagttctaattattggaatcttgaaggaaccatattattttcctaagctaagaagaatttttgaattatggcatggtaatcttttctgatattgaagtttaagtatattctctgggcatgtttatttgtttttgctaataactggttagtatggtatcttaagtaaagtttattgatgtacacttacaagccaaattttgtgtttgctttgtagtctcctagaactatattggattgcagcatattctggaaatgttggactttaattttagtaaattctggttcaaaaagtaaagtatcactcataacatgaaaattcacctttgtgattactgctgttgctaaagccatcaagtcactaggaatttacactaactgggatatgtaaatatattgctgttctcccaagaaactttttgtcgtgtatctagatcattaatccccttctgtatggtgttttctaaataaaatatttatggttctcttttaggctggcatggctctatataagattgtccccaaaaatccctactacttttggtctgtgatgagcttaattatgcaagtgagtatggcattcagaatgggattgaggtttggttttattttttatatagttattgtcctcagtgtgtcttctgaactggttttttttgtttgagacagggtcacgctgtcacccaggcaggagtgcagtggtgcaatcatagctcactgctgccttgacctcctaggctcaagcaatccctctacctcaacctcccaagtagctgggactacaggtgcacaccaccttgcctggctaattaaaaaaaatttattttttggtcaggtgtggtggctcacgcctgtaatcccagcactttgggaggccaaggtgggtggatcacgaggtcaggaaatcgagaccatcctgaccaacatagtgaaaccccatctctactaaaaatataaaaattagctgggcatggtggcatgtgcctgtaatcccagctactctggaggctgaggcaggagggtcgcttgaacccaggaggcggaggtttcagtgagccgagatcatgtcactgcactctagcctggcgatagagcgagactctgtctcaaaaaaatgttgtagagac

SEQ ID NO: 71557 - DNA, 1025 bp, Homo sapiens
tttcttttctatttgatctaccccatcctggttttgtgcctcatcacctcaccttttctttcttcctattttgtctcttcacagtactgctgagatactgttcctagaagagtatagatttataaatatcacttctctattctgtataggctccttttttaataccttacaacaaaagtaccttggtctacctttcaacacttttcctgctactcttaattgttttagccagacatcctacttgttttatcagcatacatccctttactttcttgaatgttttttgttcagactcatttttctcctacttcgcgttgatacatttacccattcacctcaaatatttgtagttttatatgtatcgttaccacaccccgcaccccccaccccccgccccctgccaccatgttatgtttgaccttcaaagtcatctgaaagatggctactttggaggggctttaatgataatgttctcctctctactttcccttaaagaaagaagaggtaagaaaatgaacaattttgccttccttggaaataccctaggatggtgttttatataggacatttatttttatatttagttttattattttgattttgagacagatttgattttaatttgttgcccaggctggagtgcagtagtgtgatcatagctcactgtagccttgacctccctgggcttaggtgatcttcccacctcagcctcttgccagtagctgggaccacaggtgcttgccaccaccctggttaacatacatatatatgtgtgtgtgtaaggttttacaatgttgcccaggctggtctcaatctccttgggctcaaatgatcctcctgtctcaacctcccaaagtgttgggattacagtcatgaatcatcatggctggcctaggacatttattttttatttttatttatttattttttggagacaaagtcttactctgttgcccaggctagagtgcagtggcacgatctctgctcactgcaacctctgcctcccgggttcaagcgattctgtc

SEQ ID NO: 71558 - DNA, 1075 bp, Homo sapiens
aaaggagaattcaggcagagcgaagagtttagaggcatagagttatgtatgatacatcccagagaatctggtggaactacaaatagtttgtggctacatgataaagtgctgagggaaagaggagacagaggccagatcctataaggtcttatatgttgtaaatgctatgagaaggcttgacctattccatgcttcatttaaacaccacctaaccaagagatgaatgatgattggatgaggcaaagcagatacttcttctataatgataggagacatctatttctgccaaataggaagaacattaaatgccattagaatgttcttgaagtataacttaaatcttatttctctttatcttagcggagttagttacaaaactttatgaggcagctgtgaagaaagttcccaatagtgaggagtatcactctcacctcttcatggcctatgccagagtgggtgaatacaagaaaatgcaacaggtaatttgatccccaaacctactgggctatgggatttactattagaggcaaaagtctctttcttgtgatttaactgcactgggtatgtgtgtgtgtagaattgaatttatggatttttctgtgtggaggtcagtcagttgttttccttatgtgtttaaagttgaactattattcaagatctttaaatgttttatttggaaataagttgattgttcttttgtggcctgatgttatgttttgtttggttttggtaattcagcttcagattgtcctactgcatcagattgctgttaaattttcagaaaatgagcagatataccagagcaaaaaatgaacaactatggaaagagtaactttaaagtttacatctaatttgtaaatttaaactgttgatagcctgctaagatttttaagtccaccagggggaaaatccttgttgcctgggatgtttctttttaaatttattttttgttttttgttttttggtttgaggcagcttatttggcagctaccatattgtagatattctttacatacatctgaaggagcctcatttgaacacatttgaattaggttgcgggtaaagctaacatctc

SEQ ID NO: 71559 - DNA, 1070 bp, Homo sapiens
tccagtgtgtctcccgggtgacagtcacttctttgctgagttaggacatttctcttgggtgcctggctcaggtaattattccactatagttcatagtttaggagttcctgaccccaggatggtgtgtgatactggtctgtggcctgttaggaaatgggccgcacagtaggaggtgagcagcagggtgttgtgggggagagcattactgcctgagccccgcctcctgtcagatcagctcttaggagtaggaacacaaaccctgttgtgaactatgcatgtgaggaatcgaggttggcgctccttatgagactctaactaatgcctgatatctgaggtggaatagttttatcccgaaaccatccctccctgccatctgtggaaaaattgtctttcatgaaatcggtccctagtgccaaaaaggttggggaccactgctctagttcataaatgaaaacttgcaggtcctcaatcaaaagtggtatttattctgacctcctcttggacagtgtggtagctttgtgagtctggtcctattttgcctcagaagtgacagggtaccttggtgagtgaagactatcttgcgtttctgtagaaaagtcacttggcacaacctatttttttccattctgaaaatatgaccatttaaaaagccctgacttactagaacttctctcaatgaatctagaacttccatcaccattggatggctgagaccacctctgccataccaaaaccttgctcataaccaaaacagtccctgttggtcttttgccctggacctgtgacattctggactatttttgtgttcagttttggccaagtgttaacaagcatacaaagctgggcacagtggtttggctgggtgaggtggctcatgcttgtaatcccagcactttgggaggccgaggtgggtgggttgcttgaggccaggagttcgagactagcctggccaaaatggcaaaaccccatctctactaaaaatacaaaaattagccaggtgtggtggcaggcgcctgtaaccccagctactcaggaggctgaggcagaagaatcacttgaacccgggaggc

SEQ ID NO: 71560 - DNA, 1042 bp, Homo sapiens
tgtgagccactgtgcctggcccaggctcaccttcttaaccactgtgctagaaactacctcactttgagctgaagacactgatttgcctgaggtcacacagatggtaagtggcagagaaaggactctgatttcctatttccccggggctgcatattctcatgcccttgccctccagtgtatattttcagagggcagagatatatatacaaggtgggtgatggaaggtgagaactgaatccagggttcatagtttgtgactcattacagctttgtgcagcagctgcctgcagacttttttttttttaaactaaaaacactcaatactttcaagaataatttgatttttaaaattgttcttgaggaccaaagagaatttctttggtcccatagttatttagaattaatagtgttttgactgtctaatgggaaacaccatgtccatttcacatcactaaacatcaggatatattaacaagttatattctcaaaactgaagtcagaattatgtagcttttgtaacatgtacatgggaagaggattagaagaggctttcttcagtaattctaaggcgattagtataaactggcaggactaggaaaagaacggtacagactgtccgtgaattcagcacttaagcacatttgacttttgaactccacacttttgttgtttaaatacattactacccccaaacaaccatggttccttgaattcagacattctgacaaatgaacaaactcatctatggtggtacttgcccaccagccaaaaattcaacaactatcagcattaattagtgtttactggtgggctgactgccctattaggtaggtaagattattgtgatcaaactgaagcctagagattaacttgctcaaggttgtagctaccaagttgtagagctgggatttgaacatagacattctcactgagagctcagctcttcaccaagttcagattcagtagcatcactgtctttgtacaacagtatttgtactgccaaggtttcaggatttattttacaattgtgttggaaaccttg

SEQ ID NO: 71561 - DNA, 1026 bp, Homo sapiens
atcgttaccgccgctcctagggagaccggagatctccccgaaggtggaagccggctccggcacgagggtgggacgccctgcctgagggaagattccctaccagagatttttttttatttacgggaattgggcctagagggttgtctgactaggtgggcttcggtgcataggagaaactgaggtccggagtggggaaggggctgacgcaaggtcacccagatcgagtcaggagcaggcccgagattccaggctcccaatccagagctgttgggtggagaagcagctactctggtcacacgtgggaggcggggggagggggtcttgggcctaaaatagcggtgaagagattgtgatagctcgtgtcagaggggcatgcagagctactggagggcttctcctttctgcagcttctctgtggttttctctgcagctttccttccctgtgctaagcagatccctctccacaactcttacctcaacccgcagacttgaagaccttgatgtcatctcatccatttaccctggtagtgaaaaatcacagattttgagtttgggagaaacccttttccaataaccgaaatgtgtaattggattggtcctttttgcatttcctttcctcttagatggttttatggtcttggtctatctcacttaatggtgaggaagcttcaaggtcagtggtttttacaaaagtagacatcgtatttatagacctcatgtggatgttactaaattggaggcttctctccaaggtgggaatcgttttgggagcggggggcggtggttaactttgtttctggccacagttagtccggcttttatttcataatttgtgtgatttttttttttactctcacatctcatttgattttagcaacaatcctatagctaaggtttatagatgactcattatgacagtcactggccttggccttttatatgggttatctaatataatcttcacccattctcaagaggtggctactgttttttcctgcccctgaaccctttaacaacaacaacaac

SEQ ID NO: 71562 - DNA, 1042 bp, Homo sapiens
gcgccattgcactccagcctgggcgacagtgcgagacactgtctcaaaaaaaaaaaaaaaaaaagactgaattggaatagttggtaggggacagggacattggagctttgacaaacatctgacttgctatgattcttgttatttgctcctgggcttctctggctggttttagattactaagtaatgtgtgcacaaaacaatatgatagttagggtggctgagtagtgggctccctctaatattttattttcctttatagaacattgtggcaggaacaaaaggggaagctgtgactcttaaataattaaatacattaaaaaagggtaggagaatcaagggttggaagagaagattgcagtagatactcttggctttccttgccctatactaaaacacacctctcctagatatgcatattaactgcctcattcctctgttttgtaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtgtgagttgtgcttgggattagggaactagaatggtatcaaaatcccaaggcaaatgggaacagggctttggggccagatagatcttgattatagaaacccgactgtagctgagtaacactgggaagaatacctctctttcctataaaatggaaataacctccattggattatagttagggttcataatggtg

SEQ ID NO: 71563 - DNA, 1027 bp, Homo sapiens
tgccttccagccaggcctccacctcccaacctctgtttctccatctgtaagaagggactgaattgcgcagtcagtgttcacagggttgttatgagggttgattccaggctcagaactgcgcctggaacatagccagtgctgcatagtaattactgttactattttcatttgcctcaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacac

SEQ ID NO: 71564 - DNA, 1018 bp, Homo sapiens
tctactaaaaacatagaaaatagctgggcctggtggcgcacgcctgtaatcccagctactctagaggctgaggcaggagaatcacttgaacctgggaggcggaggttgcagtgagccgagatcacaccactgcactccagcctgggccacagagcaaggctctgtctcaaaaaacaaacaaaaaattctttgcccattttaaactggcttatttgtctttttattcttcaattgtaagagcttttacaacgttctattatattaccttccagactgagttgtgttcttgcttggttataacaaaactgagggttctgttaaagcccgtagagctattttattttattttattttattattttatgtttatctggagagctattttagatgctaaatgtaagaacccagatgcagtggtactttttcctgaaaaacttctccctctacactcctcaggtctcacagtagtaacccgctctccagacagcaataatgtagccagcagtgctgttggaactgctctgccaaaatttgccatccgagggatgctgaaaacctttgggcttcatggagtcgtcttagatgttgattcagtgagtgaacagccattctgattaataagctattttatatatactgaggctgtcatacccagattcccaggtaccttaaaaagtgattatacagatgagtttctcttcaaatcagggacgaagacacaaagcaaaaatgctctaatgccaattgacttgcctgagctttcctcagggactcagatcagggctggcagtagatggtaggctctccagtctcaaagctgtggccgccttcagaccacaccacctctaccattattttctgtccgacatgttcaaactgttcctgcattatatctacccaagttcccagggaaaagtccccattgtccttgatgaatggatgatctgtcattgccatgatggtcatacagacacaaatcaaagaaataggctgggcgtggggctcacacctgtaatcc

SEQ ID NO: 71565 - DNA, 1027 bp, Homo sapiens
aaaagcacttacagtattcagtgctacttagattattgtagacatgtctgaaataactggtttcatgatcaaataagtttggaaaatgttgaatgtcccctgcttgtggagaggccattcgctttacccttactgaaggctctgaaaagtcctacagtagtctgttttaatttccctaacccaggatttcctagacttttctggagtgtggaccgctgttttggaggcacacctaaaacttctgtccagcagtcttgcatagtctaggaaacactgagctggatgttctccaagatcccttcagttctggattcatccagatactctagagtttctcaagaggcctctcctgctcagccactgttcttgacatggttcaggaagcctgagctttggtttctctttcacagaattgaagaactcacatgtggtgggatggtcgagcaggtccaggaagcctttggcgagaccatgacctctgttgtgtctctgtgtgctcgttaccctatcgcttgcgcaaatagcattggactcttatgtaccataccttacaccaggtaagtacggaaaggccttttgttgtatgtaagttaccctgcagtatagtcgattaagtgaaagtatttttaattttaaaaattggattttttgctttcattatccagagctagctatacaaaacttttctcctgaaagacacttaaggttcctatgtaaatttcttattattgagttccaacatgactaaatgcagccattagggttatattacattgtgaagatacagaggttcaaagaaaaataaaaggtccctaggaaattacttacatatttggcagaaatattttgcatatatacatttatttcctctcttgggtcacttagttactaatttgaagatgtcaagcattcattgaatccccttaggacaaaatacatgatttttttccatcatggcaacattgagttgattccatcgatttttgctgtatataaacaaaccagaatttgaagttccttgttaatg

SEQ ID NO: 71566 - DNA, 1855 bp, Homo sapiens
gccatgattgctccactgaactgcagcctaggtgacagagggagaccttgtctctaaagaaataaaaaataaaaataaaatacagtattgagaagctgagagcatggcatatatctgactgatttccattgtgatcacagagaagtgattcagccagacgtgatggaggaaatggtggtatcttgtgttattaagcacttgaacttggttgatgcactgcagtctctaataaatttccaatatcaagaagaacatgctgaagaatatgatttattatgtaaaattatgggagagacctttaagaaactcaatgccatggagagacagctgcaggtaaatgtctgataactgttggaaacaatttcttttatggaaatttaaagaaatttagaatgtgatctaatttttaaaattactattgtgactaaaattttgaatcatacttgtttttattttgcatctattttaatgtatttattagagtgttgcagaactggaacaaaaatggcaaagtgaagttgatgatgccatgcaggggaaactggagaacaacatgcctttcttttatgattaccattttaatgaggtgagcaaattgtatgatttgtcactggggtattgccatttagagagcaaaggtatatactgtgtgtgtgtgtgtgtgtgtgtgtgtgtaggtaaaataatgtcatttcctaaaatgttgcacactccaaaaatgtacccattctttaaaagaggttaaatgaaaattgattagatcaacatgcagtatacaaataattactcattaggttgtttttttaactgattaatagttttataaagatatataaagaagttgtcatcatggtcaaattttgctttcaagccttaaaaaacaaaaaataggcaaaattataagccctgaaagaattcccagaaagtagtcaatgccatttttaatcattaaaatatcaaataataacttacaaatgagtttcaagcatagaaatgtggaccaaaggtggtggtttttctctgaaattttctgttcattttaatatatgtatagtaaaacttggttcttgcagattctgcataccatcttttttttctttagaacaaaatgaaagaactagaacttttatgttcaatgaaggaagtctcctttgatgggaatgatcttgaaaacatggtcctatcactgaggttagtcgtattaataactattaaggctattatcaccttgatgctcaaaacacactgtaaaggtctagtctcttaatagatatatttttaaatgttgtgaatttactaaatattttagagttggaactcatttggtaaattggaaattttggttttagccttccaaagttagcataggcatttgaaacagaaaaaggagccagaagtggccagagtttctaacagtgttacttggatgaggaaacagggaagtaagcaatgttgattaggttacttttgcttagtttcccctgtgtcttctcttattctttgtaaacatttttttttaatagttgtttttgataagctagagaacaactcaatgcacatcagtctttctttatagggagaagttcctacaagaagtgaattctcttattcagaaaccctcacacccactggctaaaacaaagacgttagtgaagagtttaatgaaccgagccgagctgttgctgcatgtcaccatcgcagcccagtcgggcctcacgagaagcatctctgggacccctgctgaaacaccaggtactgctcaaagatagcccctaatcggcttctgttatatgaacagagaatatactctgttcatataagacacacagctatattttgaaaaattcactcttgg

SEQ ID NO: 71567 - DNA, 1042 bp, Homo sapiens
atgtttacaggatgctaaccctgtgggatttgcaaagtggccaatcttaaagatcctttacagtatcttttttttttttctgagtacctttaaatgagaattgatcaggtcttctcttggatatcaactgggcttcgcccttgaaaaaaagagggaaaaatgaaaatatatctctgcttcttgtcctggaaaaaggcaaaaaagaaaaaaaaaagcaagtataatatctgacaacaaggaaagaaaaaacccttaaatgtaggaatttttaaaatgtttctgattgccactgatatcaagcatttaaaagcctcagtgttatcatactgcatgctgtggaaaattaaagagcaatttaatgtttacattgtttttcctttccttggctgctaagctaaatcactttctctttttctgtttagaatgttagaagagaaggaagagccaggatttctcactggtttaaagattcctgccccatgggctgctggaaagactgtggaaacagtccaccccgtcagagacaactataaatttaaagaaacggtccatatcccaggagctcgctgcctgtaccttagatttgatagcagatgctcttcgcaatatgactatgacaaagtaagtaagaactgggttactattggttccacctcgagtaagctgattcttagatgcttcttatttttctttgctgctggtcaccattcttgactgatttctgtctgcagatatctctaaggagaactttcctaagataaagttcttatctttgaagggtagtgattgagggagttaaagaaacaccacctctgcagtctaagaacaatgttttaatgatatgttgaaagtgtactttgtaagctttcaggtgcttagatatatgagaggaaggaaatgttccttttcattctgcttaccccctgccctccctccgtgcttgaagttaccccagatgtgtgatgtccattcatctagaaaggtctcactgcccaattcttggggcttctcatgtatcttttgggaaaaggtggctttttag

SEQ ID NO: 71568 - DNA, 1023 bp, Homo sapiens
cgttagcatgttaaacctaaagcatggaccagttgaaagataatagattccacagttcccctcagaactgataattgcacatttcagttttatcagtaaagtaagttgggcctggggaaagggtctttagcaaaaataacagatggaacttacttaggagatcttggttcagagtaccatccaaattgctggtttatgagaaaggctgagtatgtgtgttagagctggtgaaggggacgaaggtgttgtttttatatgttatttataaaatactttgactttgtagttgggtgccatttgatttctataagtttgatttaaataatatacctagttgttagcattattactaaggtgatttgcttaagaatcaattatgtatcttttatttgtcatcttatactaattatataaaatttatccttttatgaataaaccatcaatattttattgttacatttttcctgcattttaaagactaaatgatgaacttttacactacattctgaagattgttgtacgagaatcctgtatcttaatcaccaagtgccaaactgtctctaaagatgattttcaaaagctcctttcaactgtgcctgtaagtaaaaatgtgtttaatgaaagcaaaattatatcaagcatccctgttttcattttattatattgacaggtgtgtgtatacatacagacttacaataatttatgaaaggccgggcgcagtggctcacgcctgtaatcccagcactttgggaggccaaggtgggtggatcacctgaggtcaggagttcaagaccagtctgaccaacatggtgaaaccccgtctctattaaaaatacaaaaattagcagggtgtggtggtacacatcggtaatcccagctactcaggaggctgaggcaggagaatcacgtgaacccaggaggtggagtttgcagtgagctgagatcgcgccaccgcactccagcctgggtgacagagcaagactccgtctcaaataataataataataatttatgaaagtccgt

SEQ ID NO: 71569 - DNA, 1050 bp, Homo sapiens
tccagcctgggcgacagagcgaaactccgcctcaaaaaaaaaaaaaaaaaaaaaaaaccttttcagacaagagagcagaatttataggccattttctatttattgtaagtcttttttttttttggtttgtttttttagttcagtgaactttttttctttttgcttgtttgagacggagtttcactcttgttgcccaggctcgagtgcagtggtgtgatctcagctcaccgcaatctccgcctcctggcttcaagtgattctcctgcctcagcctctcaagtagatgggattacaggcatgtgccaccatgcctggctaatttttgtatttttagtagagatggggtttcaccacgttggccaggctggtctcgaactcctgacctcaggtgatccacccaccttggcctcccaaagtactgggattacaggtgtgagccaccacgcctggcctcagcaaacttttatacaggaatacagccttaaagtgattaagtataatttagtgtccaagagagagctgaatggttggtctgaaagatctgtatgacaggggtgagcatagatgacaggaagttgttttccttccacagcacattatgcttcgaatctctttctgtggagcattaaggcaatgattgaaatctgatgctctgaggaaacttttggaggggatgggtatattcactatcttgattgtggtgatggtttcattggtgtatacatatgtcagacttatcagattgtacactgtaaatatgtgcacttgattaaatgttaaacctcaattaaaaaagaaaagaggctgagtgtgttagctcatgcctgtaatccccagcactttgaggggccatggcaggtggatcgccgaggccaagtttgagaccagtctgggcaacatagtaagaccttgtctctacaaaaaaagtaaaaacaaaattagcccgatgccctggcaagaacctgtagtcccagctatttgggagactgaggtgggaggatcacttgagcctgggaggtcaaggctgcaatgagctgagatcacaccact

SEQ ID NO: 71570 - DNA, 1016 bp, Homo sapiens
aatgaggctaggcgctgtggcccacacctgtaatcccagcactttgggaggctgaggcaggcagatcacctgaggtcaggagttcgagaccagcctggccaacacggggaaaccccatctctactaaaaatacaaaaaagttagctgggtgtggtggcaggcgcctgtagtctcagctacttgggaggctagggcaggagaatcacttgaactgggaggctgaggttgcagtgagctgagatcatgccattgcaccccagcctgggcaacaacttaacttttttgaaactctgtctcaaaaaaataaaataagataaaattaaaaaaaataaatgcaagaaagaaacaagtatttgaaaaaataaactgagcagagaaatcagtaaccatgcaatgcaggagaaatgcagatgttggactgatgactttaaagtcagatgaagacttaaagcagccattataaatacatttaaagaactgaaggaatccaagtttaaaaaaattaaaggcaagtatgatgactatgattaagcaaattgagaatttcagtaaagagattattttaaaaaacaaaacaaaacaacaacaacaaaaaaaaatggaaattccagatttgaaaagaaaaattcagtagagtggctcaacagcagatctgagctgctgggagaagaaagcagcaaacctgggccatagattagtagagttgttctgtctgaagagcagaacaggacacttggggagtactggtcacacatttgcagaatagaatttccttccctgtgggttcatctgatgctttctcatggttagactgaagttacggattgggggaagaataccacagaagaggtatccccttcacattacttctattccaaggtacatgatattgacatgacttattactagtgatattaaaaactgatcactttgtttaaatgatgtctgccagatttctccactattaagattccacttctccctttccacactctgttagtctcgaccacactgaa

SEQ ID NO: 71571 - DNA, 1023 bp, Homo sapiens
tgattaggttgtgtgatgatgcctataagaaattctcaggtttatgccacaaaaagtttatttcctgtgaggaattggtatacctgttattgttagaaaatgaacattaagtaatatactggactttctctttgccgtgggtggtaggaagcttatttctaagttttgggctcagttattagggctttttattttgcattaatgttaattggtcctattatacctgtgtttttaatgtaagccacttaaatcctctttggaagtaggtcacagataaatcagttactaagagctatctattttgtgagatttactcctcacacaggagttaagcaaaattaaaaattaaatgctggcctttgccgagtcccaacctagtgccttaccaaataaatctgtgggactagggttgtgggttgtcaacattagagagcatccttgcccttccactttgtagcagtgcttgtgagaaatatgtatacaggtagctggtggcatggtgactgaatacagtatgctctttttgcaggagcgtgttatgacacagtgaacaacatgctatggacatgctcaaatgactatatcgatcagtggtgtaaccctgggaatcaagccttccattatgtctgccagagacttggagtcagtcacattatcactgagcccaaaggtgaggtgcactcagggtcttgcaggaaaagattttcctctgaaatatgagagaataccacagcattagtaggtgaaaacatagcccaaccccagaatgtgtcaccagttttccctctttgaacttttgaaacctaaagtcctttgttatctgtaaccatgaaagatgagttatgattaagtaaataagtatgtaaataaatagagcttttgaggtggtccatagacttttttaaaggaaaattgttatgtccttcctgaaattgttggaactttgttgcaaaaattgattatttgtatttggcatgggattatttgctgttgtaatgttttgcattggtaatgacttaatta

SEQ ID NO: 71572 - DNA, 1035 bp, Homo sapiens
gacagtattttattttcacaggcttcttttgtatcaaaggtaagtggcaaaattgttaatagtttttatgatttgggtaagtggataattccaactgtagaagatactttctagaggacagttttttttgtttttgtttttgttgttacctaaataaacattttcatgacaagctgaaggcctgatctgggtttgtcccttgggagaaaatgaaatcttaccctaaacaatggaaatactaaaagaatgcttgttgaaaatatgtataatatcaaagaaagacctcagaaggcaaggacatatttagaatttggtagaaatgtgcacgctttggcagcacatatactagaatttggtagaaacgggtatctgtattctaaacatgtggtctcattgtactttttttttttaaaaaaaacatgaggtcttgttatgttgtccaggctggtctcaaactcctgggcttaagcaatcatcgtacttttatgtggattctttaacgtgatgttgctacattaaattaaaaattcaccagttataaactaagaaacttttcaaaagtaagcgaacattcaaggtgtctgtaaggttttggccaggggcagtggcttatgcctataatcccagcattttgggaggctgaggtgggtggatcacctgaggtcaggagttcaagaccagcctggccaacatggtgaaaccccatctctactgaaaatacaaaaattagccgggtgtgatggtgggctcctgtagtctcagctactcgggaggggctgaggcaggagaattgctggaacacaggaagtggaagttgcagtgagccgagatggctccattgtactgcagcccaggcagacaacagtgagactcagtctcaaaaaaaaaaaaaaaaaaaagtttttattccattaaaaactaatacctattgccatcttaataagcatatgtctattgaaaacatcttggtgaaaatggtatactcacaaagttgctaattttccaattattgctgtctttaggtttcttaccagt

SEQ ID NO: 71573 - DNA, 1145 bp, Homo sapiens
agcaaagagctggctttacagtatacgttttccatttgattgtaattaaaataatttttggcgttgactattttgggatatcattaaacatattttcttccttagatgactttggtgaaagtaatatttacccacttctccatcgtctttttccttagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtgatgaggaaactttggccctgctcaaacgccagggcttgttgcagcaacctgagcaagcgcccttcacatcgaggatggggctcctgctggtcttcccccttattcagtcccagagtagaacagacccctctctctgtaacataactgctgaggtgctattgaactgccttcgtgactgccagcctttgagcttgaccaaggagcctgctgactgtctcaatggaattgaaactttgctgtgctcttggctagaggagacttctgacacaggccgacacatcccacataagcaaaaagaaaatgctgctgctgccctggtggctttggcttgtgccaggtaaggaaaatcgaatgtatcatttggtgaccttgtgactactgccacctgggttgggtgaatgaagaagaggccaagtatatttgatagaagtcttaacattcagaagtccttctttgctttcagtattgaatttcacagccttgacagtgcatgagatgctttcaccaaacttggcaccaggtgcctgagttggaaccaaagttcatgttttctgtttctggtataccatgataacatcttaaccagcagaaaatggagaatcaacccttgacatatctaattgtcccttagatggttagtgttttacatcaagtagttagcagaggatgttatgtctacttctcctaggaggatggtcaaaactttatagagctattaatttttcatacctgtctataagaagtacatcagcaagctagtgggctattattcacctggactcagtcacaaaattggtcacaaatta

SEQ ID NO: 71574 - DNA, 1036 bp, Homo sapiens
gaaaaatagaaccctggtcaaagggacagcacaaaagatgaaaactgggcaggggccacaacaagatggaactttcatggtaaaagaatttgaacagtaatttcttatgtattggagtcctcacaattctgacaatcctgctgtcaccagcagttatatgaagatctgggaaagtcaccatatgctggagaaagttttgcagggcttagccaaaactaaaaaatctagcaagaagtcagagtccattccagttttggcatccagttagaggctaaaactcatgaattaaagtgtggaaatttaatatcctcgttctcagttaggtttaagaccctttttacaaataagagatgttgaaaagtgagtttgaataaacacatatttccaagttggataaggtcgtgcagcttcagggtctaatttaattgataagtgatccaccctggatttgggctttagtaagagagaattccaccctcccatcatgatgtacttacttggctcgcatgagagcttttcaagtctttgttgattgcaacatgcaattcaatttggctatgattgctgtcttcattatgtgaaaaatggtagaaaaaaaatctgtagaaaggtttaagcatctattctaacatttgagagggtttcagtattctgcctttacttaaaagttttgtattggcagggcatactggctcatgcctgtaatcccagcactttgggaggctgaggcaggaggatcacttgaaccccaggagtttgagatcagcctagacaacatggtgaaaccccacctctaaaaaatgtttaaattagctaggcatagtggtgaatgcctgtagtcccagctacccaggaggctgaggtgggaggatcacttgagcccaggtggtggaggttgcagtaagctgagattgcaccactgcactccagcctggatgacagggcaagaccctgtctcaaaataaataaataaataaataaataaataaataaataaataaatagttttacattgaggttgcaagtctagccagtc

SEQ ID NO: 71575 - DNA, 1109 bp, Homo sapiens
tctgcaataaatgatctgccagtcctagtgtctggctttatgcaatttgttttcctttgtggatgaagtgggagtaagacttgttgctgtgaggatcagatgaagtggctaggatatggacacactttacttgaattggaaaacaagccatgtatccctaatctgcaaaatgtggcatgtcacacgtgtaatctctgaggtttagtttttgctcaagattgcaaaggtgacttgcttgatgctttctttgcttgagcacacatctcattcattaaatggtgtctccttttttgcacacaggatgcagaagcataattgaccttttccaagtctacttagcagaaatgaaaatggaatcatataaatacagtattatactttaaaataaaaaggctgtagcaaaagtttggctgacatagcttgcttctagtaatctgaatggcttatttaaataagttggatctatggactctccacagcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaaggtgagagtacctgtgcttggggcgcttcactgcagctgcctggggtgcctggtggcaatgcgtttgcacgctaggtgtacttttcctttatttacctatgtttggggcaaggggaaatgatctgcaagatacaacttagttgttgcaaataagaagtgtaatccatggtgatttattagccatttcctgctgttgattatgttacacatgttcatttactcaaaaacgtgtttatgtctggagtactaccttagtagcttgctgtggttgcttccagaactgccgagctgtatacatatacatgtagaaatttcctttacccaaatttagatgcctgtgattttatgaattcagaagtcagtttttaattgcagaaaactaattattttctttttaacttacagagggtggttttcctgaagcagctggctagtggcttattacttgtgactggtaagaaaatccttggattgtgatgttctgtga

SEQ ID NO: 71576 - DNA, 1311 bp, Homo sapiens
ttttttttttttttttcttttttgagaatcttgctctgttgcctagagcgcagtgtcgcgatcttggctcactgcaatctccacctccagattcaagtgattctcctgcctccgcgcctcgactggctgtcattacagacacgcaccacccacgcccggctaccttttgtatttttagtagagacgggatttcaccatgttggccaggctggtctcgaactgccaacctcagaggatcctcctgcctcggcctcccaaagggctgggattacaggcgtgagccaccgcacccggcctaggatttactacttttttcttaacggggaaatactacattccccatgatgccccagatccggaaggaagtgagactcgcacttcccatgattgcttatagaccggaagccgggaccttaattctctttcccatcttgcaaggtaagaatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagagggtgaggtagaatgccgtagtggctccctccggttcttcgccactctcttgggctgggggaacgaggccctttcggggacccgtagcagactggtgggtgttagaggaagcggggagacggcgcgtgcactgtgttcctggtcctgggttccagaggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagtttcttgaaaagagacactggtcttaagggttaagacgaaaggtactgaaagtaagggatttcaagttctggtcttggtgcttctaacctgtggacacattctgcatctaagttttctaattcgcaaaacagtaataaaaaataatggttgtacggacttctgaccgctcagtatttggcaaaaaacctaataggtgtgaggtagtttcaaattctcaaaaaaaaagtttatagtgtattggggagacaaaccccaaatgagtcatagtgaaggttggagtagaatgggtagagtttgagaggaaggcctgtatcttaccgggggagggattgtagtctggggagcccagcccattcatgtacaggttcattattgtc

SEQ ID NO: 71577 - DNA, 1047 bp, Homo sapiens
cagacaaacacatgactaaatagggcaatttcaggtagtaataaattctaggagggaaaaaatcccacagaaatgtgaggatgggagaatgcagttagttttgataggtggtttagagaaggtgatcgtgtgagctgacacctgaatgacaattagtagtctgaattttgttttgcttaattatcaaaataactcctcttgggttcggcttttatatgcatccagtaattaaaatgtaagtatattcaatgtactgatatctctcagcatcataggtaggaaaactaaggcattcagcaattaagtgactcctcccttgatcatgtagcagtgatagtactggatttagattttgaggttgcttctctgcccttttctgcctttgtgaaaccaacaaagctgcctgtattttccaactcttccttcagcatgtggtacctcctttacatctgtttttgttgctctgaaatccatacgcgacgatgagctgagaggggcagaaaattgagcttgttctgagactggaggcttttggtttatctcttgcaggtcaagtacattttgtcctgggctctccctggtggccacgtttgtttatctcctgcgggagtaaataaacttgccttgctgaaaaataacagttctgtgtctttgcagtggaaactgggatgtctttattaacgttaggtcctgatgtaaggccaagtttttggttagagttgctcaagtgcagaggccactgctaagatgacttacccctcgtgtccatggtcaatgtggagactgttatgagtggcacatgatgctggaaaagcagagccaactcatgtttgtaattgtcctagcaggccgtggtgtactttgttaggcagccacagaacaatagagaaactcagcttattccccttccctctgggaaacacagacagtacttgccatccaacgccaatgtttttaaggaagaaagaggcaaaaagtgatgttggcaaggtctctgggagttgtggaccccaaccaaggattggagaccctgaaatggattcagat

SEQ ID NO: 71578 - DNA, 1040 bp, Homo sapiens
aatagctatttcaatttctaactatatattacttatttatttatttatttttgagacggagtttagctcttgttgcccaggctggagtgtaatggcgtgatctcagctcactgcaacctccacctcccgggttcaagctattctcctgcctcagcctcccgagtagctgggattatagacatgtgccaccacgccaggctaattttgtatttttagtagagacggggtttctccacattggtcaggctggtctcgaactcccaacctcagctgatccgcctgcctcggcctcccaaagtgctgggattacaggcgtgagccaccgcgtccggcctcttaactattgtttgaaataatgtagagacagctccagagccatgaagaagtgtatgaagaagcagtgttagcttaaatgacatacatgtcacaattgcctatgtgaaactatcataattatgcatgagaagtatctatcctgcataacctccaccaataataataatgttaataatagtgaaaactaatgtttattaagtccttactgtctccagcctctgtgctaaatactggttactaagtttccctgaaaatactattctcatctgtttgttcttaataacaggatagcataattgtaagttgtaaatgaaataatacagtttatgtaataaaagggtaaaagagaagaccacctaccttatcttctgttgctgatctggatggatgtaggtggtgtttacctagtttcacctttggcagttgaaactactttttttttttttttttttttttttaagagacagggtgggccaggcgcagtggctcacgcctgtaatccccgcactttgggaggctgaggcggacagatcacttgaggtcagaagttcgagaccagcctggccaacatggtgaaaccctgtctctactaaaaatacagaaaaattaactgggtgtggtggtacacacctgtaattccagctacgtgggaggctgaagcaggagaatcgcttgaacccgggagtggaggttgcagtgagctg

SEQ ID NO: 71579 - DNA, 1040 bp, Homo sapiens
gtcatccaggctggagtgatcttggctcactgcaatgtccgcctctcgggttcaagcgatttttgtacctcagcctccctagtagctaggattacagatgtggaccaacatgcctggctaatttttgtatttttaatagagacagggttttgtcatgttggccaggctggtcttgacctcctgacctcatatgatccacctgccttggcctcccaaagtgctgaaattataggccactgcgcccagcccaaaatttcttggtttgaaataattttggaactcataagaagttacacatatagtagagagaattttcttgtaccttctctgagcttcctatatacccaatgataacatcctatatacccatagtatatgatcaaaactaggaaattgtgaagatggcattttgagacatcaggcagtgttcacgttactgttttgcttacctgggctttaatttttatgtgtttttttttcaatcattgaatgaacaaaacttggactaggctggggagtaactgatttgaactgttttttcctgaagcagtccaggacttatgtgaccgtggtctctttttcttctagttgatcataccagggttgtcctacacgatggtgatcccaatgagcctgtttcagattacatcaatgcaaatatcatcatggtaagctttgcttttcacagtgttttctgaccatacatttctagcctatttttgtattttaaatccttcctcatgtcctgaaagtaactttaaggtgtttgaaggattttcttcctaaatttctagcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaaggtaaatcacagaaacttcttttctgctaaactgtttttaaagtatcagacatgtcagattggccatgtttaggaattgaataaatga

SEQ ID NO: 71580 - DNA, 1023 bp, Homo sapiens
acggtttcaccatttggccaggttggtctcaaacctctggtctcaagtgatctgcccgcctcggccacccgaactgctgggattacaggcatgagccactgcgccccagctgattctttacagataaacaaacattgactctgctttgacatgtgcttggatcaggtaactgcaccagctgcctttctcctcccacttctgcctggtcctccgaatgcctgcttttcttatttgaactcttctgtccttttctgaaaacctaacagatgcgaaacaggccattttccatgttggtggttattaagcaagacttgaacatttgtttgttgcttgtttaggcttttatttcagagttcacagaattaactttctttttttctgatctcttccagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagtaagtatattgtcgtattctagagactttgggaactgttgatggtgtgtaggaattcagggtcttgccgttactcatgtttgcatacatgcatgcattcgctcactcattgattcagtagccatttattagcttccttctatgtgccaggtacagtttaagcagtactggtacattgtgaacaaggcaggtagtgttcctgccctcatcgagcctagggagatagacaatttaaaaacaaataactggccaggcgccgtggctcaggcctgtaatcccagcactttgggaggctgaggtgggtggatcgcttgagccggggagttcgagaccagccctgggtgggagactgggatagggtgacctgagtggctacaaggtctgttaggaggcctccgcaggggcctatgttgatggcctcctctccaagtatccacagacttcagcagttgttcttttttgttccttcctttggaatggaatattatataaaatggca

SEQ ID NO: 71581 - DNA, 1031 bp, Homo sapiens
tgtcttggaaaaaaaaaaaaaaaagaatgatactatagtctgtgtttatatggtggggaaggttgagtatcaaaaaaataacaaagaggaatgaatgtcttaagtgaatgcctgtttccccatctgcttcctcttctgctgggaggagagacctggatccctagaggtttcagttgcctccagagctgagtgccacagggatgcaggggaatagggatgttacctgtcgctggtaattcagagagatgattcagggtatagttacctgaaagaacaaattgccatgccagacgtcttggttcttatgacagaggcaaagagttgcctccaggattgcccaaaaggagacgagttctgggaacctcacgaagaggacctttcagtggaacctggggagattctcttcctctccattggatttaggaaagcttagaaccgggtgattcctcaacctcttgatttatttaattcttttctggtttttcttggctctactccaggggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcaggtgacagctcctgctgcccctctaggccacagcctgtccctgtctcctagcgcccagggcttgcttttacctacccactcctagctctttaactgtaggaagaatttaatatctgtttgaggcatagagcaactgcattgagggacattttgatcccaaggcatatttctcctagaccctacagcactgccattggccatggccatggcaacatgctcagttaaaacagcaaagactaagtcagcattatctctgagtccaccagaagttgtgcattaaacaacttcatcctggctctgcagtttctccttattcttcatgatgtttgctttgtagctgttgactgctttgtaggtattgaggtggtgggggtgtg

SEQ ID NO: 71582 - DNA, 1080 bp, Homo sapiens
gcattaaacaacttcatcctggctctgcagtttctctttattcttcatgatgtttccttcgtaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcaggtaccagcctgagggctggcatgcggattctcattctcttgctaggcctcttggatacgctctccttttgagcaggaggacaggctctgatagacaactgtttgatttcggaatgggaaacaaactcccaactaaaagggcctctggaaactgtcaattattctccacttctcagctctgatttttcactgcagaggagcttagggaagggcaccatcctatcagcctggcctgccagattgaagaactgccatgcagaaaggttctgatgttctcaggctcatgtggcaagcgtaaaactcaaagccttgaagtttctagcctgttccagccttgatccaggccatgtttatcctgattccatcctttaaaacgaatgcctcactcttaatagcgcacggcagtttgaaccactaatttggtcgagttggaaacagtgaaatttcaattttaataagctgtgcataatgaagaggaatgtggaattggagcctttccatctgaagctattcataacaggcacaaagctgagttaattaggaatatgctgagatgaaggaaatgaggagagctgctcttttgggggctgtgcttctctccccaacccctcaaccccattgccatgctgcagatggggtggtgtctaaacatcagtggcgagtgcctgcattactctgctcgttgccttccagagaactcagcttctccaaatgctgagctcttttcagaatgggacctgccaccagtatttgaaagatttctagcctagcagaacagcagccacgttatcaaagtttggttggccaaaggaaggtacttgctaattagtttagtaggttttcagtccgcacagacatacgggat

SEQ ID NO: 71583 - DNA, 1038 bp, Homo sapiens
tgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaattaagccagtgcctgagactgtcagaagttgacctttgcactggcattaaagagtcatagaaaaagaatcatggatatttatgaattaaggtaagaggtgtggcttttttttttttcttttttccagccgttgaccaattatagttcggctgttgactgagaagtttgtggtgggaaaacgtttgccatattttctttgcatttgaataattgtcttgtacttagaaaaaaggcgtctatgaatgaccagtgtttttggtcgccaaatgttgctgacaaacttatcccaaaactttagtggcttaaaaaaacctgcccccaactgttagtcaatctgagctgggctcagctgggctgttcttctgccagcctgcaggtggccactcatgtggtcagcaggtcggcggagagactgggatggctgggcttctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatg

SEQ ID NO: 71584 - DNA, 1344 bp, Homo sapiens
tgaaacttatggtcatctctcccactgaaaccaaggtcttttcaaatgtggctaaatggggatgaggagacacgggtaggactttcttggtgtgtgtgcattctttaaagagccaagttgcttcggggaaacagccaggaaaatggtcaagattatttttagaggttattttattggggattttaagaactaataacatcttgagttatttttaattcagggggatgtggaaaggtttgcaattgtcaagtgttttgttgtagcttagtatccataagggaaacttagactatagacataactacaaagccagtgcagcttttgttttctgtatgttgttgggggatcaactttcacacatagcaagcacatggcctccctgatgtcaggatgcctttgttaggatctgtatttgcccttaattttgttgaaatcttttttccttcttcctcttgaaaagttccaaaatatagtttattgtatctttcatcactaaaaatttgttcctttttcactatgggcagttcacacaaggcaaaaactattgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaaaaggatccctgattaagctgatgactagacctacaattaattttcctgcagtatatgaagtattgtaccagagtattaaaagatatgtaatattttattgataaatctatcctttaaaaggaatacgttttaggatgtcatcattttgatgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtagagaaacattagtggatgttaattgtctccccacctatatttatgggtgttagcgcaactgctttgctagttgcaaagctgtattatcagagtaaaagtgtatttgtaaactgtatgggaactaaaaattaggaataaaaccattttcttatatgatggcatttgtcgtttgcttcatcagaaatgtccaggaaaaaaatgggattattggtcactccacctctcacactggcaaaatactgacatttagcagctcttatctagaagtgacttggaacatagaataaaggcatgagttcctgaagaattcattgagtgtttcctgtagaaatagctttaggagataggg

SEQ ID NO: 71585 - DNA, 1038 bp, Homo sapiens
tcttgagtaggagaatataatttttgttgatttcaaaattaagatgaggaactaattggtagtggaaagaactcttagattgggaggcagattctagactttagattctaaaaatagctgttaagttcactgaccatatggactggggtcaggctattctttctgaaccctttaatgaagggtacattctgatataatttgtgatcacacaagtaatacagaaatacattcttataaaaaatgagatttacaaataaggctaacatcatctttgaccacaactccctggtgtccctgaagtatcctgtcatatgatagatttatatatttccagatgatttgtatgcatttgtatattaacttacagtattgttttgtgaatgcatttcttcaaagactgtacagatactatcagattgtatcacaacttgccttcttcacccaacattgtgtcttggagttctttccacattaatacatatgtatttctgatattgttaaatagcttcatggcatcccataatacagatgtatcatgacttatttagtcattttgttgttattgaatgtttaggctattttcagtttttccctattacagaccaggttgtaatgaacatctttgttccagcctcccctcaggcagacactgagaaatggagtggctgtctcagaattctgtcattcttttatttatttatttatttattttagaatttctttttgtttctttctttcttttttgtttgttttgttttgttttttgagacaggttttggctctgtcactcatgctggagtgcagtggcgagatcttggctcactacaacttctgcctccctggctcaagtgatcttcccatctcagcctcctgagtagctgggactacaggcgtgcaccaccatgcctggctaatttttgtttttggtagaaatgaggttttgccttgttgcccaggttagactcgaactcccgagctcatgtgatccacctgccttggcctcctaaagtgttgcagttgctaggctcatgcctggca

SEQ ID NO: 71586 - DNA, 1062 bp, Homo sapiens
gaagttgcacagctttactgataaaaagtttctcaaacagttacagggaggagagtggtttcttataaaagttttttgcattcagctgcaatctggcaatccactcagacttccctctccacagtggagacagctttcttcttttgcttactgaacttttgctccaagctcacgtttgtgtccatgttccttaattttcttggatgcaggacaaagaaccttgggtactaattcagtgagaagctgctacattaaggtgcactggcaagactgcaacagtattggggattatggctgaggaaattggaacacagagtagttaagtgacttgctcaaggtcttgcagccagcaggtgctatttgctttcaaaacatatgattcttcactgcagaaatggtgagcccctagcctggccacgaattagcaaactgtttaccagagctgggattcagttccctatttctgaaatgggcatcgcccaggacagtggttcataaacttcagcgggaagtaggggggagggtcacttgttaataatagggatgtaggatttcaccccagaatctattttaacatgctgtgtggataaataagaaaccaccatcccagaagatctcagctctctgtactcacatttgcaccctgggttctaggtttttgcttctctctctctctctctctcattctcaatctcaactcttgcacattcagccacccctcccctggccaggcaggcctggactcacctttaccaccttggacacacacacagggtaggagctacctcggaagcacctttccttcaggaacccacagatgatgtcaatggcatggttgatttgcatgcggaaacacgtgtctggcaagagatagtcttcaatgaacttgtccagagatttggctggggtatttctgagatccatcattgacaggagagagagtggcaacagaactgcctcccagacctgtttgcttttatctcttctgctgactgagcttggactgctgttggtttcgtttcctcagaagggaggagctgtctttgcactttccttttgcaa

SEQ ID NO: 71587 - DNA, 1363 bp, Homo sapiens
cttgtagagttcctagttattttaaagtctgtgttcggtctttcagcatttaaagtttgtaggtttattactatttctcttctttctgttggtcataactcttagtgttttgtttccttgtgtgcctggttacatatgtgctggtcattgtatttgaaaattatgtgtgaaataatttgaggttttggattatgtatattcctccagaaagaatttcatttgcttctgtgcatttcttaggaacattacaagtccttcttctcagttaattttcgtagtatctttatcagataggtgctattacaaccactcacttagcagatgaaaatcatgaggctctgagagtctaagtcatctacttagaattggacaatggtgaagccaggattcaaacccacatcaataagaatccagcgctcttaacaaggggccagtacacttttttaaaaaataaaaggctagatagtaaatattttagactttgtggactgcacagcctctgttgcaactactcaaccctgcctttgtagcatgaatgcagtcataaactatacataaatgaatgagcctggattcgttccaaggaaactttataaaaacaggtggcaggctggatttggcccatgagaagtgtagtttacacaaaagttgagcaaaccaatttttttctgattgtttttcctcttctcagtgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggtatgctatccccacatggcttagctcccctatgtaaatgaacacctggatacaggtacagtgccttggaaatggaggaggtgggagggctccccacttagtgagaatctcctgttgcccatcattgtactgggcattttactactgccatctgttttaaacacctacctccaaccctgtgaggcaggcactatgccaattattttacaggtgagtaaactgaggttctgagaggtaaggagcttgtccaacccttaacagaaaatgagtaaaatagctgcagtttgaactgaaataagaacagcagcaacaacaatgatagtaattgctcccaggtattgaaagcttgttgtaagactaacacatgctaatataatagtaaaaattattagcaatattactgatatgtatgttatgttctagtcgctgtgctgagcatttc

SEQ ID NO: 71588 - DNA, 1112 bp, Homo sapiens
aagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaggctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccatttattgggtgtttattaacttcaaggcacagagccaagaagtacagatgcatatctaggggtattgtgtgtgtatatacattgattcaacaagaaatatttattgagcacttactatgtgccaagcatagctctgggcactgggaatatagcaatgcacaaaagcagacagaaatccctgtcctcatgaccctgcagagccaagacttccagaattt

SEQ ID NO: 71589 - DNA, 1191 bp, Homo sapiens
agtatttatgagagttttatattttagagtcttatgaatgatatgttgattcttggtcccaaggacagtgtgacaatgtggcaatgtaagtcagtatagtcgaatctttaatccagtgatttaccttggaggacagagctgtccaatagaaatacataatataacacaagccacatgtatgatttcacattttctagtagccacaattaaaaagggaaaagaaagagatgaagttcatttgatttaactcaaatatatttaaaaattgtcatttcagcacacaattaaaaaaattatcagttggcaagaacttggcattcttttcatttgtactaagtctttgaaaccaagtatataccttgcactcacagcacatgtagatttagactagctacattttaagcatttgatacatgtggctagtggctgctgtgtcacacagggaggttctataatttttctcagagatatggagaaaggataaatcaaggatgcttatttcagaattattagtaataggaaaaccatctaacattaagatgttttgcacaaatgtcaactccatgaggacagggatttttttatttaaaaaattctggaagtcttggctctgcagggtcatgaggacagggatttctgtctgcttttgtgcattgctatattcccagtgcccagagctatgcttggcacatagtaagtgctcaataaatatttcttgttgaatcaatgtatatacacacacaatacccctagatatgcatctgtacttcttggctctgtgccttgaagttaataaacacccaataaatggtatttgctttatttttattgttattgataatacattagacattaccctcccatcaggtgcacagaagaaagtcaaggctggaatttcattctcttatctaaatctctctgttctctctcagggaatattttcagagaataggtggaatgaagtgaggctgtggagaatgttatctatgataggatagagggcatagaaggccaggagtcaggagacctgggttctgtcctggattatacaccagctcactgaggagctttgtcctctctggatcaagagtcccacctgaaaatgaaggaactggtccagataacactggagccctttcccccaagatgcactggcattcagaggatggtgcaggtccagtcctcttctgc

SEQ ID NO: 71590 - DNA, 1068 bp, Homo sapiens
tcaattgttttgtttctcgtagccaatgttggtgtcaaatttaaaaaattgatttggcaagaacacataatggattgtgctgtgtgctctgtactgtctcatgcctggaggcacaccatgtttggctgtcccttctgctaacactgagattaaactgtggatttggtaccaggaatggtggctcatgcctgtaataccagcactttgggaggctgaggtgagaggattgcatgagatcaggagtttgagaccagtctggcaacatggtgaaaccccgtttctactaacaaattttaataattagctaggcgtcgtggtgtgctgttgtggtcccagctacataggaggctgaggtgggaggatcatttgagtctgggagattgaggctgcattgagctgtgattgtgccactgtactccagcctgggtaacagagtgagaccctgtctcaaaattaaaaataaaaaaataaaaataaaccctgtggatttgggaggtgacatccccccaccccattatagccttccccatcatttcatctaatggtttcacccattgataatctctgcctaaatcatttattttattgtaggttgcaaaattaaagccatcctcatagggttaacgtgaattctggacagaaatattgttgtaattaagcattaatcatgctgcactttggtccacttccttgtaactgaatggcaggagcactagatactgaccatttacatccccattgttcctataggatctctgacattagaatcataaggcttttggccaggcacggtggctcacacctgtaattctagcactttgggaagccgatgcaggcagatcacctgagctcaggagttcaagaccagcctgagtaacatggtgaaacccagtctctacaaaaaaatacaaaaattaggtgggtgtggtggtgtgtgcttgtagtcccagcaactcaggaggctgaggtaggaggatcagttgagcctgggagatggagtttgcagtgagccgagatcacactgctgcactccagcctgggtgacacagctagacccctgcctcaaaa

SEQ ID NO: 71591 - DNA, 1077 bp, Homo sapiens
atcgtctctgcctcccgccctgggggtaacagccccgcttccccagcccagacgtccccgagccgctcgcgggcccccagcgggagccgggggtggggtccctaagcacccgcgttctcaccgcctctcttcgtctccggctccggctccggctcgcgctccagcaccgccgcctcctgggctccccccggagtgggagggagccgcggtcccgcctccgcgcccgttccctcccaggcccctcggccgccgcgccgagctttccgcgcgtggacagactgcccggccgacggacggacgcaggagccggctggcggccgccgggatctcgcgggtgggaggaggcctcggccgtgctccgggagggagaggggagggggcggaggaggaggaaggggaggagacagatctcggccctgagcgccaccggcgctgacacgcgagtctcggggcgccccaaatcctcggccaggccctcccgagaccccaaggggccttctgaccccaagcagagcgtgaggcagggagtgggatgtttaggagtcaccggcttgaatctttgtcatctttatttccagtctcccagtccagggcctggcactgaataggtgctcaataaatgcttgaatgaatgaataagatccagagactgtctaaagaaagatcttgaagcattcagagctagcctcctttcctcctctaactattcctgggggtgggagggtgctgacaaggcctgattcagactcagttggaaccgtggaatctgaagagtacagatgaggagactgaagccagagagagtaagagccaggcccaggatcacaaaagcttagagcgatgcccagacaccaaccccgatctgaatctcctgccagtacccagttcccagccctgagcccacttcccccaaagcacccacctgctccaggtgagaggggtgggaccaggggaggggaccctggccaggaggtgagatcctggaggaagagaagggcaggccctctgccatgtcattcacagccacctgcaaacaactggtgctcaataaatggtgggtgagcattggttggatgg

SEQ ID NO: 71592 - DNA, 1027 bp, Homo sapiens
catctgcaagcgagacgggcaacctacttggcacttggaggagtgggaaagaggaaaatctgggcttgatggagagggagtggagattggagagcaagcagcccccagggtggaggccaagcttcgaggggtccctggggaggaccctcaggccaggaggaggattctcaacatcagcgttggccagctctgcagcaaaggactctgggagcccgtcagggccagctagcccaggcctccctctctccagggctctatttaccaggtatcgattttcctgcctgtttactggtagttattaaaggctgtgtccctggagtccttttgaaacaagattggaacctggagagcaggagtaattagggcagctgctgtcctccccgctgggccctgcaccccgcagcgcccgccgctgcccgcctgcccatccgtccgcctctccggcccaggctggccatggaccaggccgagggggtgggcagctggttccttggtgacctgcctggacttcgatctcaagatttctaagggagcagtggtggaaatgctccttctcctccgcagtggccatggcctagattttcagccagaacaatgggtctaagaaggggctggagtttcttcagcctgggaaagaggctgggcctcaggctggtggcccagagcagaccacaccccactctggccttcagggcaccctgctgtgctggccacagggtctgcgtcccccaggcagttaggggcctgtgacaaacatgggctccgtgcctctgcctcggcctgtttttgtgtctctgcctttgttgtcttccccttctctctcctccctagttgcttaaaaatgtttggcagaaaaattccaggcttcttccagctgaactggagaaaggggctttggtcagtgtcagctggaggactgcacaagctgggcccctgagaccgggtgtgggggcggccacagccacagctgccagtgactgcttcatgcctggggcagagacagggtgacagcaggatggagagagac

SEQ ID NO: 71593 - DNA, 1014 bp, Homo sapiens
agagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaagaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctcctcgcctggtcttttcctgccaagagaggggtgggtggctctgttcctgggggctgcagtcagccccgttggggagtgatggcttgcaagagaatgacttcagggtccttgcctcgggctggaaggggtgggggcggtgaag

SEQ ID NO: 71594 - DNA, 1082 bp, Homo sapiens
gagctgatgtgaagactgaaattaccctggactacagatggcagtggggtagtggtgggacagttcagggctccagatggagggggacagttcagggctccagatggaggggaagatgctccctctgggcagttctaggtacccagctcctacaggggtcactgccaaggccaagatgccccaggaaggtggcacacgccccggggagggcattgtttcatgtgtgactacaacctctgaataaacacaggcgcagactctcaggctaaatatagcctggcaagtgtgagaggtgggtggggagctggtttggggggagcaagatgcacccaggatggaggggcacccttccctgagtcacctctgctggtgctggggaaccagcgttacctttagatgggccaggccccggattcacatggaggggaaccatactctacagtttgtagagggcagaggttggaggtggggaggtgcacacaggatggactctggagcccatcagactgggttcactactgagcctcagtttcctcatctgaaaaaatgggataatagcacttacctacccacatggagttgtttgaggactaaatgtgatagttcaggcttggtttctaatacttagtgagggctccttggtagctggtgttgaatggcaggagagtgtggtgaagaacagagagttcaaatccttggctgggcgaggtggcttatgcctgtaatcctaggactttgggaggctgaggcggctggatcacttgagattaggagttcaagaccagcctggccaacatggtaaaaccccatctctactaaaaaaaaaaaaaaaaacacacacaaaaaaacctaaaaacaaaaaaagcaaaacaaaaactggccaggtgtggtggcatatgcctgtaatcccagctacttgggaggctgaggcactagaatcacttgaaactgggaggtggaggttgcagtaagcagagatcgtgccactgcactccagcctgaacaacagagcaagactctgcctcaaaaaaaaaaaaaaagaaagaaaaaaaaaagaaaaataatcaaatcctgcctaagtc

SEQ ID NO: 71595 - DNA, 1022 bp, Homo sapiens
accatggacaaaactctttctccttgtgcctcattttcctcatctgaaaatggggataattacagcacctatatcagaagccagggtcttgacacatttttaattttaattgaggcaggacatagtggctcatgcctgtaatcccagcattttgggaggccaaggtgggtggatcgcttgatctcaggagtttgagaccagcctgggcaacataatgaaaccccatctttacagaacaacacaaaaattatccaggcatggtggtgcacgcctaaagtcccagctggtcgggagggtgaggcaggagaatcgcttgagcccaggaggcagaggttgcagtgagccaaaattgtgccactgcactccagcctgggcaacagaaccagaccctgtgtcaaaaaaaaaaaaatgaaaataatgttaattgaatttttaagttaacacaatgcccagtacatggtaggcgcttcataaatgttagtgcctgtgcccttcagggattgacagctggattaacttgagccgagtggacccagatgcagaagtgcagggtgagatctgcctgtcagtgcagatgctggaggatgggcagggccgctgccttcgctgccatgtgcttcaggccaggtatgcttaaggtggaggtggtgtggagggtggtctgagaatgagcaggagtcccctgggtctcccctgctgcctggcgtttgggacctcctcagtcctggggcacttctgggctggcagtcaggttccctgtgtggacaaacagtccaagctcactgggttgtaagttcctgggggcaaaatcctgttgagtccccagggactagcagcaacagaccagacactcaggatgacaggtgacaggtgagtgtggaggtgtagtcattaaattgtaactgacaaatacccaactcatactggcttaagcaaaagagctactttattggcttatatgactgacatgtagcttcaggcatggctgggtccaggtgttcaaacgatgccattaggaatct

SEQ ID NO: 71596 - DNA, 1048 bp, Homo sapiens
cttgggtgtgtgtgtgtgtctgggcctctaactgggttcatgtggggggtctctgagtgtgtgtgtgtctggattcccgtgtgtgtgtgtgtgtgtgtgtgtgtgtgtgtgtgtctgggtctccaggtgtctgcctcctgtgtggcccgaggaccccagccccctgcacctccttttgcaggacagctactgtctggaggagcctgggccccttctggggggaggagtacacggtgcacctgcctctggatttccaccagctggccttctacgtgctggatgaggacactgtcgggtttgtggttggggaaagtggaatgtgtgggttagggacccaagcctgggcacctgaggggagaggggatgtgggtccacagcccacgagggtgtgccctcccacccagaccttgacacctgcccccacttctcttggggcggggcaaaggggcccctgactcagaccttcacgtgcccgccttcctgcaggcacgacgacatcatcggcaagatctcgctgagcagggaggcgattacagccgacccccgaggtgggcgagggacatgggcagagggaggagggggccatgcccagggtgggcatttgcaggggcatagcacatggcacggtgaagcacagagccttcagtggaaacttatttctcttgttgcttttgtctttactttttgtttgcttttaattgttgttgttagagatgaggtcttgctctgtcacccaggctggagtgcggtggtgctatcatagctcactgcaatcttgaacctctgggctcaagcgatcctcccatctcagcttctggagtagctgggattacaggtgcacaccaccacacccagctaattttttcagaaatatcttatagatacggagtcttgctatgttgcccaagctggtctcaaactcctgggctcaagcaatcctcccaccttggcctcccaaagtgttgggagtacaagtgtgagccactatgcccagccttgtctttagtttttgagcagttaatttgtttgcctagttcaacattcagat

SEQ ID NO: 71597 - DNA, 1711 bp, Homo sapiens
cacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagc

SEQ ID NO: 71598 - DNA, 1041 bp, Homo sapiens
acagcaggtgtgatggcccctggctgtgctgtccccttgatttgatcacacaccacagagatcttgaccccgtctattctttttgctggcaagtctttctagacagggctcaggacccattcgttcaggactctagcgtctggagagtgtatgtgactcaacccagggtcacagctgggtagggggaggggattggaaaccctccaggaggcccttgtccctgagccaggccccagtgctggcggcagtcctctgacctccgcactcccttttgagacctggactgcagggagaggtgaggagggatagggaagaagcctttattgagcgccaactgcatgccagacatggctgcactgctttcctttaatgctccaacaacctgacaagagggtcgggtgaggagacaggccccaagcggcagccggcactccaagggtttccctccacggcagccgtcccaactccctctcctgcagggaccgtaagaagaagcggtttgtgggacagtcaggacaggaagacaagaagaagattaagacagagagcggccgctacatcagcagctcctacaagcgagacctgtatcctgaggggcgtggctggggaggggcggggccgaggagcttcagcaggagcagcttcaattaagtggaacctgggggcgggggcgggggcggggaggagggggcggggctgagcggcttaagcagccgcatctccaatagatgggacctggtgctgggggcggggccgagcagcttcagcagcagcatctcgaactagtgggacctgtgctgggggcggggcccagcagcttcagcagcagcatctccagtaagtggggcctgtgctgggggcgggcccagcagcttcagcagcggcatctccaataagtgggacctggtgctgggggcggggccgagcagcttcagcaacagcatctccaataagtgggacctgtgtgctgggggcggggccgagcagcttcagctgcggctgggataacggaactctgtctgctggggcagtgtggggagg

SEQ ID NO: 71599 - DNA, 1469 bp, Homo sapiens
gagggcccagtgggcccagccccgagccgcccagcactgcaggagaagcagcctgagaaggaggaggaggaggaggcgggagagagtgtggaggtacaggttccaccctggggaccctggacctggggtatggggaaggggtggctaagtcccagcagcccatgaggctgtcctaggatctttgagcagtggatggaggtggatgcagtcagcttcccatctgcagagtcggggcatggttcttgtccaccatccctcgtttaaaactctggggccagatctttagcctgaggagctgtgcacgacatgacaccctcagtggggtccggggcatcaccagccaccaaacacatcagggcttctgcagtgagacgtgtaggtctccactcagagggaggaccatgaagtgtcccattcacctggtgggtgggtcctgggcctgtgcgtcccccaggatgtccctctctcatgttttgtttggacagagggttcagtagccaagaagaccagttggagacccctggcctagtccatgttgttcagagcaggccaggcgcagagaggggcagggccggctgtcacatagcctggggtgcggagctggaatggggagttgggtctccctcggccggcactctcctcctcacccagctgtcctgcctctgctggtccctgaggcaggggttgcactgtgtgtgcagatgaggaaactgagggtcccacaggagacactgtcacccagctaagaaatggcaaaatgaagctttgaaagtccccgagaagccactggcccctcactgtggccaggctggtgggtagggaggcagggggaagtccccagggggcagcaggcatgacactgggccttggtctgtgctctgccaggacattttctcagaggtcgtgggccggaagcggcagcggtcaggacccaacaggggagccaagaggcggagggaggaggcccggcagcgggaccaggaattctacatcccctaccggcccaaggactttgacagcgagcgggggtgagtggctggctgggtcctgggtggggcagttgggtccgctgggtcccatcaatccaattatgtctcccactctccctctgcagcctgagcatcagcggggaagggggagcctttgagcagcaggcagctggcgctgtcctggacttgatgggggatgaagcccagaacctgacgaggggccggcagcagctcaagtggtgagtgatcgagtgagccgcccctccatgctcggggtgagtgaccgagtgagctgctcctccgtgcctggggtgagtgatcgagtgagccgcccctccctccatgcccggggtgagtgagtgagtgagccgcccctccatgcccggggtgagtgatcgagtgagctgcccctccaggcccagggtgagtgagagagtgagctgcccctccatgcctggggtgagtgagcgagtgagcctc

SEQ ID NO: 71600 - DNA, 1028 bp, Homo sapiens
cagatggcctgtggcctggggtcacacagtgacaacggtggtgccaggactcagattgcactcctgacccccagcaggaccccagcagggattttcatctgagcttcttatagcttcttaacctgcagccttggctctgacaacctctcttgagatgcaccttgttctggaaccatccctgctggctcacagcaggtcctatggggcagccattccctagcacttacagatggctcacaaggggaagtgacatgcttctggtctgttagaggcctgaagagctggctttcctgagcttctttccctccttcccaactgttgactcccattaggcaccccatcttgtgcatatggaaggggatgcacaaaaggaaagacctactgaggagtgagtaagcctgccagccagctaggatcaggagaggagctggagagagtgtcatgtttaagagcaccggttttgaagtcaaatggacttgggttgacaagctatgccttttcctagcatgtgaccatgggctggttactcaccctctctgggtttttgtttgtttgtttttgaaacagggtcttgctttgtcacccaggctggagtgcagtggtgcaatcatggctcactgcagccttgacctcctgggctcaaacgatcctcctatctcagcctcctgagtagctgggactacaggtgcatgccaccacacccagctatttttttttattttttgtagagatgaggtcatgttgcctaggctgctctcagacccctgggctcaggtgatcctcttgcctcagcctcccaaagtgctgagattacaggcgtgagccacggtgcctggcctgggtctctctgtgtttttgtttggttttgtttttgagatggagtctcgctctgttacccaggctggggtgcagtggtgcaatctcggctcactgcaacctctgccttctgggttcaagtgattctcctgcctcagcctcctaagtagctgggactacaggtgcccaccaccacacctagctaatttttg

SEQ ID NO: 71601 - DNA, 1091 bp, Homo sapiens
caagtgatctgctactttggcctcccaaagtgttgggattacaggcgtaagccaccacgcctggctgtgggctgttagaaagcagaaagcacaggaatcgagggatgtttgtaatagctcagattcataagatgtagtatctcctgctgttcatctaccacccttcctaggtagtaggtgccacgtctgttttacagatgggcaaagtgaggaagtgacaggttagagtttggcaatgattccatagtagagctgggatcagaatccagtctcctgcctcattccatgccttatctcacagtttatcccttaaagggcagcccctttaagggagaaagtttaaggatgccgctattaacactcttgattctcggagagtttgcttttcagtgcctttgtctccattgtcatttattctttctgaagtttgtgattgtcagaaaggcctccctgggctagtcctggcccaggactaccctggctcctacaggtatcccaagggtgctgcagaggagggctaaaattagggatttgtgcccaaagggtttaaggacgggagctgatagagatccatggaacctgggttctagttggggctggtagttctggggttagttgctgggggcactgtgggtggaaggcagctttgttgctatctggaacaacagaaggagtgaattgaggtctgtagttgagcccatctcttcagaggaactctgttgttaccattcttttgcatatttcagcttgtatctcttgtcagggcaatgcctttgcctcatacctcagcactggcctttcctcagttccaagccttgggtctgtgttcctggggatggggtgtgcagccttgcctggacatttggttatgggaagggaaaccaaagagacctgttctatcaagctaaccccttctctcctctctaggatggaagaccagtttgcagccctgcacgaaaatcccgacatgtgagtttgtggattggggatgactccctgagatcccttcctagtggtgggggtgtaagagaactgtggtggtggccctggccctggggtcacctggcctgtgcaccctcttccagaattat

SEQ ID NO: 71602 - DNA, 1445 bp, Homo sapiens
gcagtaagacctcatctctacaaaaaaaaaaaaataaatacaaaataaaaaaattagccagatgtggtagtatacgcctgtagtcccagctactcagaagtctaaggtgggagactcacttgagcctaggagttcaaggctgcagtgagccatgcctgcactgctgtactccagcctgggtgacagagtaagaccctgtctcttaaaaaaaaaaaaaaaatgtacttacttttgggattgagattcaaaccgagacagtctatctgcagaccccactctaaacttctgtcctggcccagccaaaggagaacttactagcaaaaaagtgacgtgatctggcggaagcatcattggcttgaatgggggagagagggcaacagcacaggccccttccctgccccctgtggtcccactgtgcctggagtgacaccacctctctgtccttccctcccagctgggacctggaagacccctgcccaccttccccacctcggaatgcacctcggatgtggagccggacacccgggagatggtgcgtgcccagaacaagaagaagaagaagtctggaggcttccagtccatgggtgggtgcaacttggcatcagggactctgcgggagtggcagctggaggtcaaccccgcctctgcactccatcactgatgtccactctgggcccagcactgtggttgggtagaccggggtagcagatgtggtcctccagtcattcagggccttctagtggggcagcgggcctgacacaggagagggcagttagaacaggcctcaggaaaggcaatgcagatgcaggaacaggcaaagacagtcggggacttattgcctgcagagggacatttcagaaggagggaaaggatggaatgggtgggtggtgtggggacacctggctggccagaaataaagcctgactctgttactctttacaaatcagtagcagctggagcaaggatttaaatatcaagatgagtgctgggtgcgatgactcatgcctgtaatcttagcgtttggggaggcagaggtaggatcacttgaggccaggagttcaagtccagcttgggcaacaaagtgagctcccatccatgccctcaccaccaagagggacaagagtccctccccacacccgggtgattctgaagttcattccagacatcctcattgtgtccacacacacttccaagaggcgcaggaccttaccacgcctaaaacgaaggcacagcttcttagtgtcacctaagaccccgttagtgttcagagatccctgctgtctcatgacatcaagagtgggttcacatcagaaaatcagataaggttcaggtgccccagtcagatctgtctcctaagtctcatttcacctttcagtttgtgctttattgcttttttttttcccttgctgtttattgttgatgaagctgtcatttgtcctgtaaag

SEQ ID NO: 71603 - DNA, 1052 bp, Homo sapiens
cagcccggaatgcctggggccccggacccccggcagcctaggccgtcccggggcaccgcgcgcggacggactcacccgaggagccggcacaggctacgtgtgaacggcccgcgaatccagaaacccagaacccagcactttgcacccagcaaccagggagcagccagcagcactgcggacgcggcccggaccattcgcgcccgcggatggggggagtccgcccaggggcgggcgccacgctcctgaggcccaggaggtccctaaacatggagagggtcctctggtgccactcactcaggtgcgtgtgtactaggccgccgagggccgcaggcactggcgaaagctcagcggaggtcacgtggtcaccgcacctcccccccccccacgcagttggtgcgctcctcaggccacgcccccttctgcgttcccagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaaggtaggcgcgtggggctgggacgcatgttcgggcccgagacccggctccgggcagcgcctcgaggcctcagtttccccagctggggattgggctccgcagagtgtggggagggaggctgccgacccgaggaccggtcttgggaccgccggcctgagcacgtgtctcggggcttgtcaggctcagggttccgcggccagagccttgggatcccggggctggagcctgcgggccttcctgccgggttttggtcgcgcgtctctcattggctgcctcctgctcgtggggcggatcctggctccctttcgcccaatgaaaagtgcgggtgcagaagatctgactttgagagtttggagcgttcttgggaggttgaattaaggggaggccagactgcgtggcttgagacagtgtgacgcctccaaacctctgggaaacgaa

SEQ ID NO: 71604 - DNA, 1028 bp, Homo sapiens
agctttataggtgtgacctacacatgtgacttcacctcagttttgtgatccgtaaaatggacaaattcgaagctacttcacagtgctgttgagaggattaaatgaaacaatgcttgtaaagctctttgcaggaggtaggcatgggatccacgctggctgtcattgcccccacccccatcagtacacataggaaagtgcctgtctcccctaccaccatagtgtgttttctggttggtgcctaaatagacacaggtgtcatctctccttcaccgccagagtcattctgtaaataattgccagtagcccccctttcaccaccattatgacaactaaaaaaaagccaaagaaatttccaaaatgccccctgaagttgacagctcccctttgagagactggttgagagagaactaaacccttgggatgagaacttcagacactaccggtcttcctccattagcacttctgtggctcaggggtgctactctgacctcctctcacagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacaggtaatggggtagggagatgcaaatcctgtactcagtgcagccacctggattccagttacagctctggtgttcacctgctctgtgaccttgggcaagcatcttgacctctctgagccagtttactcatgtggaaaataggaccaattattcctacctaggggg

SEQ ID NO: 71605 - DNA, 1043 bp, Homo sapiens
catcatggccatggcagcttccgggctgcagctggggtctggtttcccactaaggctgaagtaaggaaccataatctctgggctgacaccccaggctgcacgctcctcatggaaacaccatctgtgagctggacacacacagcccacagccctgggtaaagagatttattcgtagagcgttcccttcaatgtggcttcaaatactttttaatttattaaataaaaacatgaaagccgtgaatttagtgctctccatctcgggccttcctggcctggtctctgggaagataagggtcaggagcgggctgggtggagagctcatttcttgcccttgcccttctccttgcctttctgcttgcccttctccttgtcctttgctttgcccttgccccgcttcttcttggatctgagcagggagcgcaccagatagcccttccatagggcctggatgagcgtggccgcccgtaccatgcgcaccatctcctgctctgcctccatccttttcttggagttgatctcccgctcttcccggatctgcgcaaactctcccaccagcactttgtgcctccgcctgagctcctccagcgagatcttctcctccctgtgaacagcgtccagatcctccaactcctcctggggtgaggggtggggctggggtcaccacacatagagtgcctcctcccaccctcctccctgaggcccccttacccttcccaaatggtcttctgccccagcgatgcccctaagctaagctgttcagcatctctcggtcccagtgacatggatggggagaggggatgggctccatcctagctctaggaaggacccaactgaaataatttcaggaacaggaaaagaacatgggcttgtgagttgggcagacttagttttaagtcccagctctgccacacctcaactgacttcacctttcgggccttcgtttttcctcatctgaaacatggggacgattccgaagccaggggctgtttctaggattaaatgacccgatggacacaatgtactggacatgatgccaggcacac

SEQ ID NO: 71606 - DNA, 1007 bp, Homo sapiens
gggtctgtctaccctattccttatagcccttgtagggcgactgatttcattgacttctcatttttccttcctgtgtttcttttggtaaagataagtcgatgtatttatgttttcttgtttcctcccttttgtacacattagagagcatactatttgtactcttttgtacttgcttttttcacttatcaagagaaaggaaaacatttgtaaccagctgtgctaattcttgccattatcagtacacagcatggaggttgatttgaagatgacgggatgtccatgtgagcatatgaagggactgccaggcttttcttctgccaaacggtgtctttttgctcttaagcctgggtgccaagtgaatctctctcctcttccaatgcagatggcggcagctatgccatccacgactcccaggcccccagtctcagctctgggggtgagagttccccctccagccccgcacacaactgggagatgaattaccaagaggcagcaatctacctccaggtgagtatctccagtcaggccctggcagttgtctgcacctgttggtggggtggggcagccaagactctgttaggtgcccagaaattcagttccagcatcagttcatgctgctgctgctcgtgtgtgagcttcaggttcataagatgggctgacctgactgtgctcataggggaaaactgctgtgcaccagcttgtcttcagacccctgtttagggctgtgccaacccccacaatttccggagtctggccactcggccttccctgccaccctccctcttctcagggcacactgagaggccacgttctcaggagggaattctttacatactgaatgcggtagctttattcctgtttaacttgttgctgctttcctgtttgctattttaggaatttttttttttttgaaaaatatatttttggccaggcatggtcgctcatgcctgtaatcccagcactttgggaggccaaggcctgcagatcacttgagatcaggagttcga

SEQ ID NO: 71607 - DNA, 1019 bp, Homo sapiens
ggcaccaggggtctcaacatgttgcccaggctggtctcaaactcatgggctcaagcaatcctcctgccttggcctcccaaagtgttgggattacaggcatgagccaccgcacccagcccctcccctcttttttaagagatggtgtcttgctgtgttgcccaggctagactcaaagtcctggctcaagggatcttcccgccttggcctccggagtagctgggatgtcaccacacctggctgtctctggacccttttagtctttggttcctccgagtggtttttaagaagcagcaaatctcttgagcccatcagcaggcaggagtgagacctgaccaccgtgagtttcgcgaagatcattttgattttccagcatcttctgtctctggcctgaatctctcctcgcctgcctggggccttcctttcctcccctgcccgcggctcctctttggcgttggatgggtctccaggcttacatgcccacactactctcatcttttcaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtgagcgcacatgctcctcatacggggggctgggagccacggctttcagggcaagcgatggaactccaaaaaggaacattctgggagggcaaacactgcaaacggacttaaaacagagagatacgaggtggtcatagaggccttgggagcggaaatgcctgggtgtccctgctggagtgaatggccttcacccagtctctctgggattctgcccaccagtaaattccagggaggggaagtgtcccaggccctgctcaggaccagtgcccacaccttggctccgggtggggagggcacccagtggacagtcccactactctgtctccagcctcaaaggagaag

SEQ ID NO: 71608 - DNA, 1062 bp, Homo sapiens
gcggggcaggtgcggggaggggtggtggcgtctatggaggaaaagcctacccccttggcgtgtgggggtggcctggggctgctcctgagtgtccgcctccgtcccgccccctgccacccttcttcactggtgagctccattgcccccgctccccggggcacatgggcttctccccgctctttcccaggagcaaggccttgctcctgtctgagcctgcagctctactgcaaggagatgtggcctggccctgctcctcttcgtggaaggaccccgcccagccggtgtcctggggctgccaccatcccttccctcatgcatgaatcacctgagcccagctcagggttggtggcgcccaagggagtggacgcaggtggaggagaggccctcacctgtcttcaccgcatggcgtgtggaaggcggggccggcatgttctgagggcgggggctgaggcgtgcacctgtgtgtggaggtgacgggtgtcctcctcgctcaggttgtttaagttgaaggagcgctaccgcaacgtgctggacaccatgttcgagctgctgccccggatggccaggtactgccagcccccaccctggcctgcaggtccaggtgccgtgtggcagtgccccgtgggggcgggagccgagtggcagtcgggggaaaggagttccacaaaggactgcaatcgagggcctgacggggctccaaggagcctggaatcttgaccaccacaggtctcctgggcaccatttttctccactgacctgtctgacatatttagtagggagggcagggagctgtcaactcgcttaccacctgtgtctacattcacaggtaaggggtcacctgtgagtctaccttcacaggtaaggggtgaatctctgggaaaggggcatttgttcatagcgtcctgacttgagctgtttttcaccccagagctgccccacgaggccccttccccgcaggcactttccagttggtgaaccgaccaggggcatggccctgcagtcagccccacgggtccgaggaggccggggctgcagaggagccgttccctcctgccggccccg

SEQ ID NO: 71609 - DNA, 1078 bp, Homo sapiens
aaaggggtcactcggggggccctttagtgaaggacaaaaggttatgctcacaaacaaggggtgagggttgttcctgcctgggcctgttagagagctgttatgcgcaaacctccagacactagggaaagatttcattgtcatttttgcctctggggccacattcaaaattcccagcatttctgggcctgtgacgggggtttcagtaccagctgggtgaggctggcagccctgccccttccagcctggatgctgtgggctgtgtgaccttgtggggtgggcggggcagggggtggggtgcagccctcagcaccccttctgctctcttctccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacac

SEQ ID NO: 71610 - DNA, 1003 bp, Homo sapiens
gtgcattgttgttgagggtgcattgttgttgaggctggattgttgttgaggctgcattgttgctgaggctgcattgttgctgaggctgcattgttgttgaggctgcattgttgttgaggctgcattgttgtgttggccacagacggggcggggcctgtgacgggcagtgactcagcctctctcccctcattcttccacagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaac

SEQ ID NO: 71611 - DNA, 1066 bp, Homo sapiens
aatatgaagcctctggaaccttcatatttgttaatggagagtggacttatttgggtacctctcagtgaagaggctgggtttgactgtcaggttcatctcatggagcgatgccatctactggtaatgcctggctggagggagctgcctggaaatgcagttggatggaagtattgtgcttgattagtgatgtctgccatgaaggtggaagagggtggtggtgttagtggttatagccattcctatcctagttccacagcaacaggctggagagagtcttttttgtgtgtctctctttttctttcaaatgtgactaacttgagggcaggggctgcattttaaatttttctgcccccatgaagtgtctaggacagggctgggcagataggaagtgtctacctgacatccaaatagtccattgtaagtgggtgttgaggtgctgggaaggtatcagctccctttctctccctttgcagatggtgtctatgagataggcggcctcgttcccgtctgggtcgtggtggtgatcgcaggcacagccttggcttcagtgaccttttttgccacatctgacagccagccccccaggcttcactgggtaagaagcccgggttctccgagatggggggggagggatgctgatgtctcccacacagatgtcctgtctgcatctctgaggcactttgaccagtttgatcaggagtcacacaaagacaggtaaccgaactttaaagctgcttttgagagtgtttgtatctatacagggtttttttctttttttttttggtaatagcttaattttgttgagatgtaattcacataccatacaatttacccatttaaagtatacaatttaatgttttttattatagttacagagttgtggaatcatcacaatcaattttagagaatttcatcaccccaaaaagagacctcatgcccataagtcactccccatttccccaccccccacatagcccctggcaaccacgactctactccgcgtctctatgggtttgcctatcatggacattttatataaatagaatcctacaatatgtgatttcct

SEQ ID NO: 71612 - DNA, 1216 bp, Homo sapiens
gatccatttctgttaaacaaaacaaagtgtgtaataggatatatatacaaatataattgatctgagaaatgtctgtaaggatgtgcttcaaactaattatggtgggaccactggagagggggatttacggagggcagggataagaaagcggaatttagaaatcttatgtattggtttttttaaaaaacaaatatgtattcatgaattacttatgtcaatttcaagcagacgtttatttttaaaattaaaagtgcatccatagttggcacccagagggtatggtggccttggagaccaggctgaagggacattatgtttagctgcttagatgggcctagtctagttctcagggaagtctctgccgctgatgtccccctccctgtcttcctgcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtgaggccctgccctggggggctggtgagaggggctggtgtctccagctggacttgactctcccttcctcgcccgctccccacccaggtttcctggctgctctacctgtttctgattctgggagtcaccgcagccaagttgtgagtttggctctgggctccggtctggcttatcaatgggaggaggggtcccaggaggctgacattcggtcaccctcagtttgggggaaggataggggtccggggccggttactacggaaatgcttcccgtccgctttttctccgtagtttctgccccaacttgtcggccatttctaccacactgaagctctcccacaacgtggcagtatccttttgtccagtgtcctgcaccctggagggagggcagttgtggggaggctgggagatagggtcatgtctatccccgtgtggggaagctgggggatagggtcgaaggcctgggtgggctgcagctgcgatcctggcccgccttgacatgctccccacatggcgtcaccttcctggcatttgggaatggtgcacctgacatcttcagtgccctggtggccttctctgacccgcacacagccggcctggcccttggggcactgtttggtgagagcagccccagtgaggggggcggggaaagcagcaggagagggtgcagggt

SEQ ID NO: 71613 - DNA, 1010 bp, Homo sapiens
ttctgcaatcccgcccactgcccacttcccacatgtatctcacccacctgccccagaagcctgagactctgaatcttggctcaagtcccaagtcccttgcagccctggcattctggcctcaggctgggggccaggtgggactgggtaggttttcatgggttctcaggaagaagggcgtatctgatctgcacgctgaatgggcagggccttgggcccctccagcgagactgtgcagaacatggtttctccgtcagcttaactttgctgccgggaggcaggaaggcagttccttaactagagtcttccagccccttttgctgtgtccatgggttttcagtaatgttgtccccctttctcactcccaccttgcaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagacgtgagtatcccggtaggaacctggggttgagtggggctgtgttcctccaatcgataaatatctattgagcatctactatgtgccaggcactgaccgcagcctgggatataccggggaacaatagagacaaaattcactactctcaagaagctgacagtctcctgaacagacagatcaagaagtaaacttatacactttgggaggccaaggcaggaggatcacttgaggccaggagctggagaccagcctggccatcgtgtcaaaaccccgtatctactaaaaatacaaaaattagctgggcatggtggcaggtgcctgtaatcatcagaaccctgaggcaggagaattgcttgaaaccgtgaggtggatgttgcagtgagccaggattgtaccactgcac

SEQ ID NO: 71614 - DNA, 1018 bp, Homo sapiens
tggcgaaaccccgtctgtactgaaattacataaatcagctgggcgtggtggtgcgcgcctgtaatcccacctactcaggaggatgaggcaggagaatcgcttgaacccgggaggcggaggtggcaatgagccgagatcgcgtcactgcactccagtctgggcgacatatggaggttttgtcttgtctcaaaaaaaaaaaaaaaaaaaaacttggggaagtgtgctaaaccgggtttgcgtaggtggaaggggcggccgggctctttaaggtgggtcccgccccgtaggcctcccctcgcgccagcccctcccatcccggaaaggctcagcccaagcccggccccgcccgccctcggccccgcccatggcagagcgcagtcacgtgacccgggctgcggggcgcagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtaagggttggcttatccccacgcggggccatcgggggagggggatgcgtgggcgccggacctcgcctgttcccgggaccggcctcttgccgggtgggaacgcccgtttctctgggggtcagctactcccgaggctgcagcaccgccctgcgggccaagtaccctgtttgggagctggctactgcggcatccctcacctcatggggccagtcccttgccttcagccagtggtgacagtacttctgtccccaagaagccagttccctaccaccgaggccgcagtgcctgcatctggatcaggtccatggctg

SEQ ID NO: 71615 - DNA, 1784 bp, Homo sapiens
ctgaggttacaccactgcactccagcctgggcaagagtgagactctatctcaaaaaaaaaaaaaaaaaaaaaaaatttttggagccatgactgatgaagtactgccacttggtggcagcatgcctaggctgtgcagcagcccccttgaccttcccacaggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcacgtgagtgggcttctggccctgtggcttcccctgcaccaagagatagaccaacctcccctttaacactcacactcctggggaccagatgtggcatccgggccacacaccccacgccctcctttgtttcatacatggggagactgaggctagggaaggaaaggatttgcccctcccctgcaggctcctcagcctaggaaggggtgccttggtggcagtacaggaagagcacttggaacctgaagactctcaaggggacagtggggagggctgtttgaggaggtggacgtgggtgggtggcagggcctgtgagccagagacactggaactgggcagtgcagatcttacagcatccggcagaggagctgacctagggagccacagaatattctggaacagtcaagcagcatgacgagagaggggtttgtggatacctggtcatgctgcagcgtcagggtgtcagttgaatggctggacaaccccaggcccacttcctgtaattcctagctgagtgggacactgcagggtggggaaagctggggaggtggctccaggctctgttcagtcctcccttcccctgcccggcaggtataacaaccagtggatgatcgtggactacaaggcgttcatcccgggtgggcccagccccgggagccgggtgcttaccatcctggagcagatcccgtgcgtaccctgggagggaggggtgggggctcggggcagaggggactgccagggtgaaggcccagagccgtgctggcgctgtgcaggaagtgaacgatctcaggagggtgtggctggaagagaaggtgtccctggtgggggctgaagttcaggacttaatccatcctccaggcaatggggagccatcggggctccccgagcagggcagtgcccacaggagccccttttctgatcacctccaccccatctctcttctcggtctcagcggcatggtggtggtggctgacaagacctcggagctctaccagaagacctactgggccagctacaacataccgtgcgtgccttctcactccgctccccgtcaccctccagggcatccacctcactccttgcccagctccttcctaggcaatgtttttaaacccacagaacaaagaatcccagcctacccccttttctggccaggagagcccagacagtttggcagtgtagttgcatggcttaagtcagcatccatgtgacctctggttctaacacccagagcagggtggtgtggggtggccaggctcagggactggcccctgccagggtctctgactggatctgccttactgggctgtacagctgtcacctcctgaggctcacttactttacctgcattttctcatttgactcttaaaattgccacatgtggtcactagagttcctgttcccatctcacagatgatgaaactgaggccctgagaaagtacctcactttcccaagcttcccctgttggc

SEQ ID NO: 71616 - DNA, 1048 bp, Homo sapiens
ctgcttcccgggttcaagtgattcttgtgcctcagcctcccaagtagctgggattacaggcacgtgccaccacgccggctaattttttttttttttttttgagacggagtctcgctgtgtcgcccaggttggagtgcaatggctcgatctcagctcactgaaacctccaccttccaggttcaagtgagtacatgcctcagcctcccgagtagctgggattacaggcacacaccaccgtgcctggctaatttttgtatttttagtggagacagggtttcaccatgttggccaggctagtctcaaactcctgagctcaggtgatctgcccgcctcggcctcccaaagtattgggattacaggtgtgagccactgcacccagcctgaatgtcgtagttgtaagtaataatgtcctggtgtgactgcccctcccctccctggccacagccttggctgagtgaggccagtgggggtcatgggtgaccatccttgtccccggcaggtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtaggtgccagttgggtggtgggttggggagagggaggccgcaggaacacagaacttcctgtgcgctttttgtaccaactcattcaaactttgctgccagccccagagggccagcagggggtggtcagatgttggacaccagtgcagcagctcggtggccgctctccacttgggccctgtcactgtcctcatagctaaggggaggatgctagacatctgttgagtgacctgtactgctaggcactatgcttggtaccaggagcaacaggtagaaaacctgtgccccactgtcctgtctcttgggcggtgcagaaatccatcaagttcttgcactggtgtcaatgtgtaaagatggctgtgttccaagagaggctatccaggaacaaacgggtgcct

SEQ ID NO: 71617 - DNA, 2080 bp, Homo sapiens
gtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggccccatgctgtgcttcttggggtggcagggaaggtggggtcagcgctttttctcctctcaggtttgggttctgcgccatcccccatgcagcctcctgtgcagccctctgtctgtccttctgtccattcattcatctgccaacatactcacccatcatccatctgcacagccttccacccacccatccgtcttccatcatccatccatccatctacctatccatttatcatccatccactcacccatccaaccacccatccaaccattcagccatctccatctgtccattttctttcttcttcttttttttttgtttttgttttttctgagtgggagtttcactctattgcccaggctggagtgcaatggcataatctctgctcactgcaacctctgcttcctgggttcaagcgattctcctgccttagcttcccaagtagctggggttacaggcatgagccaccatgcctggctaattttgtatttttagtagagacagggtttcaccatgttggccaggctggtctcgaactcctggcctcaagtgatccgcccgtcttggcctcccaaagtgcttggattacagatgtgagcccccgcacctggcctcatttgtccattttccatccacttacccacccacccatttactcatccagccattgactcatccatccacctatgagatcagacagggagggatccttttttgtattggtctgtataccacagcatggcttacgaagttcttatctatctatcacccatccacccacccatttatctacccacccattcatccacccacccatccaactacctatccattcatccatccacccatctgccaacgcatccatccatccacccacccaatcatctacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcacccatttacccatccatccatccatccttccaaccatttatccacccatccaaacatttccatctgtttttccatccatctacccatccacccattcactcatccatccaccttcctatccatttatcatccatctaccc

SEQ ID NO: 71618 - DNA, 1050 bp, Homo sapiens
atattattagtagagacagggttttgccatgttggccaggttggtctcgaactcctgacctcaagtgatttgcctgcctcagccttccaaagtgccggagcaaatgaaaatgggcattatatatgtactagatcccagtttcaaaatgttaaaaagaaaaaaagttcatcttaaagctggagaaataaaatcataggtcattaataaatggtaatcgactatgtgaatgggtggttgcaggaaatgacaatacagtagaatgtagttaaatactcactatgctcactatactcaccaatactggaagagttagaaaaggtatccaccataacaagcagagtgcatctgggaagacttcctggaagaggcagcctatgagtgggaataagcaaaaactaagttatctgacttggggagagcaagaaatggtggttgggcataaggggtagagtcttgataaactaggaggctgtgtgaccaccatcatccccctccttaggtaatggagaatgtcagaattatccaggaaggtgacttctacgtcagctcagagaagccaggaccagatcagacatgagtcccagggcatgggcctgcaccaggctaggcccacagggggcttaaggcactggtggcaaagcagcctgggttcaaatcccagctgctccttagctgggcaactctgaactggttacttggcttctctgggcatcagatccctcctcacccaggaagtagggcagatgacagggctctgaggtcaggcatgtgcagaatctggtgtatggaaggtgcttcataaatattaaatttagaataggatgtgatttctttctttttttgaaaagttttgaaaggtaaaggccattagcttggaggcagaagacagacctccctgactgctgaattcctgccggcctgaaattggagcattccaagctcctcagatgagtcataagccaccaagattgtgagcctctgggtgagtatgagtagaattagatacttcctttgtggggctcagtgcaaaatgcaaatgagaggtcggcg

SEQ ID NO: 71619 - DNA, 1026 bp, Homo sapiens
gtaaactgtcagttgtctagaaggcctggtggggcactgaaagccactggaatctggggaaaggtagggggtgggatggaagccggagcccccatgggggcaggatatctgctttccagacggaacacaaaggggctaagctcagtttgaatcccgtcccaggaggagatggggaggaggagggagtttgctaagaagcttctggcttggatgggctttgctttgactgctgcccatccgggtaccacattccagagctgaaacctcagctggctcacattcctgcctcttcagagacttatttcccctcaagggcagagggaagaggtgggcagtccccagtcccagccacgcagttctggacctaaagagattgggtttggattccatatcaactgtgtcctgtgtgacttcgggcatattacctaacatctctgagcctccatttcctcatctatgcaatgggaatggtaacaccgtctttgagagttactgagaagatgcaactgatacctagagtggtgccctgcatgtaatgggtgcttcctcctaccgttattgtaattgtccctcagtatccatggggaattcattcaaggacacccacccctctcccaccacacacagagatatcaaaatccatgaatgctcaagtccttgatataaggcatatactatatggaatagtattttcatgtaacttacacacatcctcctcatactttaaattgtctctagattacatataatacctgatgcaatgtaaacactctgtaaatgcttgttataccatattttttgcatttttaaaattgtatattggcatttgttattttttttaaatattctttatccaaggttgggtgaatccacagatgtgaaaccatggatatatggagagccaactgtatttcatttatcacgtggaatggtcgtcttttgtctctactagccattcatggactccttgggagcaaagactgtgtcctagacctagggccactctggaggcacctgccaccttgt

SEQ ID NO: 71620 - DNA, 1468 bp, Homo sapiens
caaatagagttgcttttgtgataaaagctaattgccattcaggccccataagaagaaagaaaatagctgctttagtgttagtttattttatgaccaggaaagtcctgaagtctgagataaaagtgtttgtaaaatccttaccacaatactatgagccccataaatgggagttgctatgagtcccataaatgggagcttccgaggttactggctccaacttgggcttctgatggccttgtctggaagatttgagcccaaatggaagaaattgggtctagcaaatcctgggagaagttttgagggtagttagctaaaccctaggatcttctgctttctagtaattcaggtcccctatttctcataagagaaagagtgggaaaatactaatgaaatagccccaaacttcccaaggtgggggtgcatatgcaggggaaggaaggggtgaccatcctttggggctttaaaggctccttttgctttaaaaaaaaaatcaaaatccccttctccagcttctcttcattctttttttcttttccttttctctttattttattttattttattttattttattttattttatttttgagaaggagtctcactctgtcacccaggctggaatgcagtggcatgatctctgctcactgcaacctctgcctcctgggttccggtgattctcctgcctcagcctccccagtagctgtgactacaggtgcgcgccaccacgcccggctaatttttatatttttagtagagatgcagtttcaccatactggccaggctggtctcgaattcctgacctcgtgatgcgcccacctgggcctcccaaagtgctgggattacaggcatgagccaccacacctggccgcttctcttcatttctttgactttgttacaccccctcctgtcttagggccttggcacctgctgttctcttttcttgaaatacccttccctgcccattttacctaattggtgtttactcatccttcagatcccagctctgatgtcctttcctggggaagcctttctctatagcctgacttttccctccttagacacactccttcgtgccaggttgtttgtgatctggtaacatcatctcctccactgggtgataaaccccatgagaacaatgagtaatggtgtctgttcatttatcaactcattcattcattcattcattcactcaacaaatatttattgaggacctatcatgtgccagaatggatggtcagggagaccaggaagcaggaaaaagggagattcttataagaaaatgaatgcaaaaaaaactgtgactgggcaaagtgagtgagggggcgagagtgagagaggggaggagtgggaagagctgagatcaagggggaggttggctttaatacaaaaagtaaagggagactgtctcagtcagtgagtgctacaataatgctgcaaaacaaattaccccaacattccgtggcttaaa

SEQ ID NO: 71621 - DNA, 1055 bp, Homo sapiens
ggactgacagaggaagccagcctggattccaacctcgctcttttcctggagggccaaggggccccacacgtcctctcctgccaccattgatccccttggagttctctgcctagaacccgagactttcataaaaagcagaaagactgtgggcttaggtgtgactggggttcgaatcctggctccaccgcttcttagctgagtgacttcagacctgcctgtccgtgcctcagttccgtctcctacaagaggcagcataccacctgcctgtggggttgctgacaggagtggagccatggttcatgatggtacctaatcaggaggtgcttgtggggctaagcccaccatgccctttcctacctccgtgcttttcttcatgaccctgaatcccctctcctcacagaaaactcctctgcattcttcaaagcccaagtcaaatagtcctcctcttcaaagccacctctaattgtcattccctccacgcctcctctggaatccttgagctttgcatctgttctattcacccaccacttatcgagcacctgttgtatgccagccatgtactgcaccattagcctggcctccaagaaaacagaaacaacttctacttgtctccccagccgttgtccactgcttggtccagcctctctgaagggtttcagcttcctccaagccaagctctgacctgctgtgaggaagcagcacaggagaccctttctctcttttttctcaagggaatcctttcccctgcgggtagaagatggggaggggatggccagggaagcaggagagtttctgggggtgcgagggaggcagccccgccatggtgatgctgagactaactctagtgtttctctctcctcctcatttcccctttgattctctcccctactccttatctttcttcattgccccatcctctctccacctccctctgtatcttctctccctccgctctccccaacttccctctcttgcattctctcgcttctgttctgtctccccgcacccttgttctgctcatctctcccctctccctccttcctctgtcatttctc

SEQ ID NO: 71622 - DNA, 1023 bp, Homo sapiens
ttttaataccctcacacaccctaggcgtgtagatttcatcaccattcagtaactgcagaaactgagaggagcccagagaggtgaagcaacttacccaaggttgcccagccaggagcagcagggtttgatcctggcagctcacccacccagcaccctgcatctagcaccctccaccctgtacctcaggcctctccactcagaatccagccctgggcttcctggcccagtgcttttcccctccccggactgttcacgcctgcctcatcccagggttcctttcagaactcccttctccccttatcagccacgctcttctcccccggcttgcctttcctcaacgtctgcttccagaacaaaaccccaagaagcgctttctcttgtcctcccgacgcacccccccgcccccccgccctttctccctgcctgcgcctttctccctgcctgcctgcgcctcccatgcagggccgacagcgccagccagggaagggagagacacaggctggcattctgtcaaggaattaattgaaaaataaaatcattaggtgggaactccagaaatgcaaaaatggtggttggaggttggtggggaggggggcaggactggggggttgtcgggggatggctgagctttttgtcaagttaatttctcgggtattgatgtttggtgacattcacttgttgtttatcttcgggtgcagctgtaatactgaaagaaaatgcacagcttgtttcgtttatttattttacacctttctccggttctgcattatgtttgtttggtgaaaacccactgaggcttttgatgtcggggaagtgggatttcagcagctgttcgctgcaaacagggtgctcctcaaggaagcagggccagcgggaggtgcggggtgtcattcggtgggaactcggggcctgacatgtcctccagggggcagttgggggcccagcctgaaccctggcagatatgccaggcccaggagcacggaggctggcttatgatacatgagtacatagttggcaggtaaa

SEQ ID NO: 71623 - DNA, 1047 bp, Homo sapiens
tgttcaaagcaggcagagaagccagcagggtttcctcctggggccttgtctggcctggcaggaagcccagcttgtattcaaggtgcagtgggaagctcccagaagatttgaagagaagagtctcaagacccaattcacactgtcagacctcatcccctgcattgtagaggggcaagaatggagggcagaggtcccatccaggccaataagggccatggagcagaggctgtggaggtggggaagcaggtggattgagcattttgggtaaaggtagagccagccagacttgcttctggaaggcaggagaaaaatcaaaactggtgcataggtttttgctccaagccactcacgggatggtggtgctgcatggtgagcagaggcccaggaagctgggaaggacaggtggctgggcgggggtgttctgaacgtgttgaagttgagacacctattaggactcccctcgatgtcaggcagatagatctatgagttgggagctcaggggcgaagtctgggctgagatataaatttggaagtcatcagcagacagatgatatttaaagcctgcaagagttaaccccccctccccacttccataacttaatcattcacaggacagtacattttcaaaagactggagaccaagagagcccgttatccccacgtcagcctttgcgaataggccaccttgatcttgcccatgaaaacataatcatcgggctttaaaactcacagtcaggaaagttcaagcaaagatgtgaagccacagaatttgttattcaaaatatcctttggtcgtggttccttccatccacctggagacagaggttttctgtaagcttcccattttcattccttcacctgggtccttcttgctttctcctgaagacttgactgtagcagcccttcctccagaggtgttgaaggcctcagcaggaggcgggcaaagagggaaactgtcccggattgccatagcgggtcctgacaggaaaggccgagactgggtggggtgtgggaatatgtgggtgatttatccctgacctctttgaa

SEQ ID NO: 71624 - DNA, 1085 bp, Homo sapiens
aatgacacctcctccaggaagccttcgctttccctccccctccacaggtatcagtaatttctccatcctctactctcctcttctgtcaccgtgccttcttgccacgttgtaacttatttctttacgatttgttatcctctctggacccgtgccttccccacatgggggctgtgtcgtgctcatctctcttagtgatcagttcttccctgggtcccccgtgcccagcatagtacctggcacatgccaggctcccagtctcagactggggaatattcgagctgaggcaaatgtggaaccagagaaatgaaggctaaatacacagttgcaagctcacaactcaataagaccccaaatcctgatgtgcagaaagagagcctgtccttatcgacaaccattgacaagcccaaatgcgcccgtcggcaaatgtttgtgtaagggactctccctggagtggagacgggggcccatctgccccgccacccccatcccccaaccccggggccagccgaggagtgcaggctcagcggttctgccctgccttagagagaagcccccttcaataaattgagttccaaagacagcactattgcctcgccacagtggaaagacttagctggcagcatttctgtgggattgactgtctccacagccacttaccagccaggccaaggcccagacaggggcagatagaatgataacagtaacaaagacagttcttcatttgcctacatcttcccattcactccctagcagctctatgagatggacactattagccccatttcacagatgagagaactgaggcctgccaagcactgcagtaatttatgacgactactgtttattaagcacttactgtgcatcagggggccatcctcacaccggcatcatctcagtgctcacagcaactgtagcagctgtaggcagtgctatgtctactcagcaaggaagtggcagagctcagacttgatctccagaccggctgtagagcctcccaccccacccactggccccaactatgttatactagcaaacgtcactcaagaaaaaactcctggccaggcgcagtggctcaggcctgtaat

SEQ ID NO: 71625 - DNA, 1026 bp, Homo sapiens
aaaagttagcattgtagtgttattgaaattatgaatgaatggataaccaattactcttggaattgggaacagaaaaatgtttcattgttcatcccagtgaattgatctcttgttgccagttggttaggtgcagagacatgatctgaacactctagtgtccaaaggcatcatgtctgtgtctgtaggatgtcacttgcctgtccctgaagtccagtacaggcactgaaatctcttcacggttctatcatgatacacatgtatgtacacgtattaaaaattagactgtctaaataaaaacagaaaaacctgaaattgtcctacaaaaagagcaaatcctctccacccccaccccaccctcaacacacatgcacaggtatatatgcccaaatgtatccgagaggcagcagaccctaattagagaaactgttccattaaatggactcttactttagtccaaatttcaggttccaggatacctgtcaggttcacttagacctgtagatctttttcccagccaagcccacctgtggttgaaatgctgctggttttgatgcaatttacctattggagttagtcattttgctacttggccaccaaggttaaatgaagcttctggtgctccttggcatgtcctgtgagtctgtttacctgggaatgggatgtggccagaggctctgctcaggtaatcatagaagtcaaagcaagaggttgctcagtgaagagggaagggctactacagctggaggctttgtgcacagtcaagcctcagctggtagcgtagtgattcagatggtcagtactgtaatctgcaggagtggtggcctctaggattgtgcagtattcaacctgcacgaccaaacatggccgccctgagagtctatcagattggtgtttctgtttgcttttaagagacagagtgttgctatattgcccaggccagtcttgaactcctggcctcaagtgatcctcccacctcagcctcccgagtagccgggattgtaggtgcgagccaccacacctggctag

SEQ ID NO: 71626 - DNA, 1045 bp, Homo sapiens
aagccaaggcccccccacccaaggcatgggcagggtaatagagagaccatctagctctcagaatgcaaaggcagatgaagtcagcttcacctaaacacattgttgaggcttcggtgggatccaggactgctcgggggacctgcagcaccatggcctgcgcgtgggtgaacatttaggattctagacactaggtctcgttcgttcattctacacttgcacaagggtccaagagtgaagcctctgttagagttgccagttagcatcttgcaaggtaatctgtggttacaaaatcagccttgtgttttggagatgagaaacaattatctttgtgtggcatctaccttctttgctctcactctgtagtttgaagaataagaagtcatgtggggaacttcagatatctttgtcctccttttcccctctgtttgttctaaatcatacactagtattcagttcataaacagatgtggtgtgtggtgagctgggatctgaggcagagaccaatcctgccagtatctgggaagcaggatcttagctatgatctccgggtatcctgcacagcaggaatagcctggcgagatggggtcatgacctggggggaggtttcccatttccctaaacctcgactgatcagtcgtccctccaggaaggtacatatccttagcctctcggtatgtctgcttgtttaaacatgctctgctttttaaaaggagtccaacttaagaactgccagattaaaacgggcttgctaagaagagcgcatgttgatcgggaaataatatcccgctgaaatgacagtttcacttggttctgcagtatatttaggatgacacttatccggggaaacaaaagaccacaagggaagagagagcactttgtgtgatctcatgtattatatttatttttagaagacagggaattagtgtccactgaacataattacatgtggtgactcttctccttgccattgttctgatgagagttttcttaaaaccctggaaacgtaagaccttcttggagggccgtacctgctattgttgttcac

SEQ ID NO: 71627 - DNA, 1101 bp, Homo sapiens
atggggaggcttagtgatttgctcaaggcaagcttcatgtgtaataggtggtggtgctgggctccagcccaggtattgttgctgttaggatagacacacgtaggggactgggaaatgacacccatgacctgtgaggttggctcacagctggtgctcaccacattcttccctggggccaagtggctgcggcctaccagagaccgacacttctcctgtcctcaggtcccctgtctgagctccactaccccatcgacagcctgaccaagaaacccaagggttttgcattcatcaccttcatgttccctgagcacgctgtgaaggcctactcggaggtggacgggcaggtattccaggtgaggccccgtcctgggctggccaggaggctgtggggctcacatggtcgggaaaggctggtgtgtgtgtgtgtgtatgtgtgtggacacgggcgtccactttgtgggcctaagaaaatgtgcaatggcatgctaagtcactgcctcactcaagccactggagagtaagaagtcgtgtgagggcacggtctgatctgttctggtcactgatctgtggcacctacacctctgtctggcacttagcaggcactgaaaaaatactccttgaatggatgaatttgctctccatctctatagataccaccttagaagaggagtaagaagaaaagaattttgacagggacctattaaaatggccacagtggaataaaagaaacttctcttttcccagtgttaccaagtaatatacttagcatacatcctcaagccccaggctgcctcatcatcaccctttttccttttctcattcattcattgatttattcatgatttcttgatccccttgttgccatcaggccagacctggccccaccggcatggacctcacattcttactcactggtgcagggacaggatgcgatgcaggcttgagaggcggggagagggctgcgggtgcggggttatacactgatcgaagttttgtgtgtgtagctgtgtcaggtggccccctcacgacatcaggatcctgtgtcaggtgggaagagagtggccacgttctacctgacctccctcccaccctctggtcagg

SEQ ID NO: 71628 - DNA, 1046 bp, Homo sapiens
aaaggaaagtgcatgggcttgaggggctcaatgtgggttgggatggcttgagcaggaggagacagtggaagaagcccacgcagccagccctgatgaggagcctggatttcaccctgagcattcagaaacccctggagggtattaagcagagactgaccgtcctgtacctactctgtaaagtgtcacagaggctgccgtgtagaggactaggaagacatggctggtggcagggagccaggagctcaatgtgtggcacagagaatatcaaagctgcagtagccctgccccgttttggtattgctaatcagaggacttatgggggatgctgggcacaggggccatggacacggtgggcatggtgcctcaggcctctcactaggaggaccatctaccatttgctacctctgacctctggtttgctcatagctgtcgctgatcccagcttccctgtttttccagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgaggtgcgtgtgtatcccgcaggtgatgagggaggaggtgcgctctcctgcttgcccgtggtccccacagctcctctgttaggagagcggaatgttggggaaagacgcagctctgcagtccaaagccttcccgatcttggccctgccgcttgctcgccgtgtgttctttctgcgtttcttttctgtttttatttttattttattttattttattttttgagacagagtctcactctgtcacccaggctggagtgcggtggtgcaatctcagctcactgcaacctccgcctcctgggttcaagtgattcttctgcctcagcc

SEQ ID NO: 71629 - DNA, 1031 bp, Homo sapiens
tgagaaccacagctctacctcatccattcactcatgcatttagcaagcactcaatgatgctgggagtttagagaaaaaggtgatgcctcagcccctgtcctcatggagcctgctgtctctgggcaggcagggggctgacaggtcagcaggctgctttggctcagtgacatcagtgctatgatagggtgagccccagggactgtgggagaacaaagatctatagccggaccagggaggagtcaggaaagcttcctggaggagtgggctccactcaggtcactcgtgtatttagtgacttcgtaaaaacatctctaatgctttgttgagaaggaaaaaacagatgatggataaatatatatatgtctcgtgatcctatatagacacaatcgtattcctctatccatacatatatgataaatgcatagaaggccataggataggatttgtaccaaaatactaatcattcctctccatgagtgataggaattggagtacatcttttttaacttccattgtacttttgtatattatttgaattttgtaccgtgagcatgtcattattatagagataacaagcctattttggaagtgtgcacaaaagggattgtaactggccaggtgtggtggctcctgcctataatacaagcactttgggaggctgaggtgggaggatcacttgaagccaggagttcaagaccagcctgtgcaacatagcaagactgcgtctttacaaaaataaaaaaaaaaattagccgggcatggtgacatgtgcctggagtcctaggtattcagaaggctgagacaagaggatcacttgagcccaagagtttgaggctgcagtgagctatgatcatgccactgcagtccagcctgggcaacggagtgagaccctgtgtcttaaaaaggattgcaaccagatggcagctccttcccccaggggcagtggttggttgaccagcgtcagccttaactgtggctgggagtggcttgcggtggtggatgccccagtaaccagcgctctcaaagtcctc

SEQ ID NO: 71630 - DNA, 1121 bp, Homo sapiens
agatctctctgcctgcggcgtctccacctgcagtccccggactgcgctcggccttggcgcctgggtagacagaacatagcaaatgctagggacgcgggggaggatctgaggccagcagagaaagcctcagacacccaaagccccagtcttggttccagaccccgcgggagagggaaaccccggcgtcagcttggtggtcgccctgcgggccccggcgtacgccagcgctgttggaatttcctctcccccgcggtttccctcgcggttcagatcgggaccagaacgcgatcagcttcagtgccccgccgcaggcatttttaaatagagtattgcgtcccccattcagcctctctcttcctctaccggggaacaaaggccccaaaaccgcggtcttagctgggacgggtgtcccaggacacacaagagggttggccggggagggggatgctgaaataaaagctgtccttttacatagcacgacagatgcacaaagaaatttgaacgttctcgtattaaaaaaaaaaaaaaaaaaaaaaaaaaaaaaaaaagcctgcggcacactccaaaatccggaacatcccctcagatttctgtaaatccgggacatatgcgccgcaggtacgtacaccttcagctgaattaggaaagggaattacagtggatcctggagcccacttcggtttgaatcctggctccataatttcccccagaggatcttgggtaagtgatttaatggtctatgcctcagtttcctctcttgtaaaacagagataaagatcatatatcgtttatggggttaactgtgaaggctaacgggggtcacttttatggggtgcttcaccgagtgcctggcttgtgcacgtgtcccttgtatgccaagtatttatattattcttgtttcgtgtactttgaactccgacatctgcaacatatacttcttgattatacgcatcttgattataaaacaaccaaatgcatctacatccggaactgtcttgcgcatgaacttctaaacccaaattggaagagacagctacagatggagcacgcacagctacacgcaaacatacacatatccttctaacacctgcagctcctggccccagaatgcagacacccaa

SEQ ID NO: 71631 - DNA, 3066 bp, Homo sapiens
tacctgaacagacaaaaccttaagggcacctcaaggcatgatgcagagaactggcccaggccagggtgcctgcatcttaaatgctgcttctgccaattcccagcttagtgcactcctgaactcctgcggcctacctcggcttctcacctggaacaccagtgaatcatgctggacgatttctttgtctctgtttataacaaatgccctttttccctcccccagccccagtttccttttgcttaagatcttcactgtctgttttttttgttttgttttgttttgtttggagaaacttctaggattggggtgggaggatgggggttggggaagaagaaagatttaaaaaattattcctactaatttatgtcctccggcttccccttggttacctctgtggggtaaactgaatctgtatccccatttaacaggtgcaaggagatttcctgggggctgcacacactgtgtgcagcatattgcaggctttcactcatttaatatctacaaagtcctcaataagtatatgaattacttatgatttccctgttttttcttcctataaggaagctgaggcacaagttaatcaaagtctcttggcctagggtgacacagctaagatttgtacctagagatttctgagtgttgacttctctcctgcccccacctatctccccccccaaaaaaaaaaacacaacaacaacaacaacagaacataccagggattcatggcttgcccaatgttggagggggagaagagaggagagggatgagataagctcctcccacccggctgactcgctgtgtgtctcttttctcaccccagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttgggccttgtgttaaatgttttttctttgggaacctttcctgaagatggacagtcaggggagggtttagtatcttcttgttctgagtttacccccttcccttcgcctttaaataattaagaccgcccccagcgaaccaaaatgagatgtcactcaagttacaaagctaaaaacaaaagtcccttacttgagcgaag

SEQ ID NO: 71632 - DNA, 2334 bp, Homo sapiens
atatgaaagagggtctcccctcccccaccccctttcaaagaatttctaaaatccagaaaatcacccccaaatttttaacctatccccttggggcgggcattaaaaaataattgctaacagctaaatatatttttattccaattaatttgttagtaaaacgattacagtaaagtgcagcatgaaataaccacttcctcccaatcttagccaccatccaaaatttgggtatgctggggacagacagcgttgtgtttgcaggattggacacccggttctccctatataaggctggcagtccagctgtctctgactagatccagcctcttctcctgcttttaaataaaatttcacagcccaagcaaatgccttttcctaatgaaaccccatcttgaataaatgcaactgaagcctccttcctttctccctaaccctctgccacactcttcagcccagttagagggtcaaggacaaagcttgggtctatgtggctgccctggggcaagcagatttcagtgaattagcgttgtccctgggcagcaggcagggtgtgaggtatgtgtgtgccgctttggaaagggtaagggaaacaaagaggggaaatgtatgttacattctgtaacctgggtgtgggcttctgccacagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaaggtaaaccatgtcacctttgtgatcactggactccagtccctcgtggcctggaagagttgaagggggatggggcaccaaccagggcacttgccctttaaaagctagaagccttctaaacatccttaaacagaagccagagttcaaaaagggctatcaggtgtgtctccccttccccgctaaggcagtagaaggagagcacagaggcctttctcccagatccttatttggctggtggggaggggaggtgggtgtctgtttgcatactacctcttggcaagcagctttgaaaacttgcttgaagcgcttctctcttttctctctgtctctgtttctttctcctcccattctctccaaccaacagaggctccaactgctgacttttcactgtctttgaactctaggttacaatgtgttggactgggtgggggggaagcaagggactctgccacctggaaccgagaaggtggcctagaaaacatccagctataaagcaacaattgacctgggagaggaggtggagcactggggatctgcggtgggggtagagctgggggaggtgggtgaggagtggacaagatggctcaaatcccccctcagttacctgtgtttaaagagcaagcagtatttatttggaaagacacacacacacacacacacacacacacacacacacacacactctcaacgggaagaaacctgttttttagtgaaataaaatgcaagtcctttatgtcttcaatccatttaagctttaaacataaaataggatccctttttcttttcttctggtggaacacccacagagggtgtggtaaaagcgaaaaaagaatctatgatcgtccccgggctgtgagccatctgtccgacactcatctctctctgcagggactggggcaaatacaaacggttcaactgagtactggtgttgaaggacaggtgtccgttctgccattatcaattcagatgtcagggttcttgccaaacaaatccttccagagtaattcacaaatttgtggaaggtgctgctctctgtcattcactgattttttgatagtaattagaatatgttccagctgtgagttttaatgttactttttacttttaaaaagttaatttgcaatcgaatggggagatgcatgtgaaatctgccactgtaggaactcaaaaaaagaagtaaaattcattaaaataagaagagctactgattaggggattgtccatctaagggaaagtttaaactctgggtaaatactttaaattcataatcgcttattgaattttccagcaatgttgttgggcacgattatccccattttgcagatgacaacactgaggtgcagagaggctaaggggctttccccgggattacacagccactaagccacgagctgggattccaacttgggaactggagttccgttggctcatactggagataacgcccttctgccttggttttttccttcgcctgtggtagatttatgtcccagcgagggtgagagcgacgccgaggccgagagcaaagaggagcat

SEQ ID NO: 71633 - DNA, 1046 bp, Homo sapiens
aagtatggtgtagcctagttaatttccttaaaggtaaggaggtaggaaaagtacttgtcctgggtatactgatagcggcaagcatgtagcagtggggaaagtgaatgatttccacccgctcttaggataagtgcctgcatctcacttctaacacttcagagttggatcctaaaaaaagggatttttctaaactatctaataaataattgtttcaactcaccttttttctcttcggccatttccagtgtcccggaaaccttttgcaaaagggttgttgtctatttttaactgggttatctattggaagagacacaagcaagacagagacattgttctcattttctagaatgttttgagggtgtttttcccaactcaacaagtctagagatgtgactgccaacagaagtcatatagatatgccagggaaaggagataataaggaaactgtggcagggcttgtatctcctatatgaggccaaaccagggatttggggatgaaattattcaaagaaattcttttctttgggcagccaacagtttgggtttagacatggaagtgttgtcaaagtcatcaagagggaaaacctgtagatcttaaaattatgctttcattttgatttttatacagtgcaattaatcataaattatagcatactcccttcacacacacacacacacacacacacacacacacacactccttttccatgaatccaataaatgatttatggggtttcactacccttgtgcgggagtgagtgcgggagtgagtttaattttttttttctttgcctggggggtggtttgaggaaattacaatattgacagttacagtactgaatgaccactggaaacatctgttttcatttatatgctctgccatggccattaggtggagaaggcccatggcctttttgtctgatcaaaaatgctacattttattattacattaacaacttcatttcacaggattctgggtctagagggcacatgcattttgcactttgagaaaaatgctatagtgtgtaatctttcaaatcccttcc

SEQ ID NO: 71634 - DNA, 6005 bp, Homo sapiens
cgcgcgctccccagtggctcccgcccgccctctgatcatgttgacatattcacaggacaggcagtagtaccgatgcggcgctgcgacgttacagtttccgacaccttctttttataactcagctctatcccccagcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggtaagcagtgggggcctcctcccctaagctgttggagagttttttcctccctttatttctctgctcccagaacagtcggttggtcggttattacggcttggacgaaaagttagttcccctagaaatgtatgcacagacttccaggccctgccccggtggcaggaaatttcagcttacctgggcatctgcatgggtcttgcatttggtctgcatcctgggttccctcccgaacagacagaatttttcagtggagcacagacatccctgcagggagcaggaaagaaaaaaaaaaaaggcactctactgcaagaaactcactcttcaaaccctcctggaacatccttatttctttgttgatgttgtgttgtctgttttattttgttctcagagagaaaaacttaaagccctttccttttgtgtgggtattgggaggcctgacaccattccccggccctttctgccctccagtctagcctctgggtctaaaggggcctgctgctgccctggtcagagagaaatcgaagggcattttggtttgtttgcccacactacttcacgtgtctgtaacccaagggcgagttcagcaggcaattttgcataatttaagattatgtttgcagacttaaggagccagtgaggagacacacaccttttttttaatgtgtgaatattatcaaccatattttacataatgtttaaaggtccttgcctgaccaaaacctgcctggaagagaagatcctgtaatagtcatttaaaatcactgattttttttttgtaatagcattgaagcctgtaaaggcataaagttgatacaaaaataaaatccccttcatgatatcttaagcgttctgtctccttccaagctaaatgaggccaaagtttggcataaaatcctcctcaaactcacaagacatttagtcagttttccagcaaagtgcttccttgcttccttttaagtcaagactacagaatgccaacccttctgtgaaattaacagcaatgtggtggcacagtcttgcggttttggactggcctaagaagtgggggaatgtgttagcagctccacgggcagatcggttatcaggcccaggagtgcaccgaagtctgcaaaattcgttctgggaactcactgaagtccagtttcacttcgcccacagcgggattgctattctgcagcagggaggggtgcaacttgacgttcatttccttgataagtttaacattttctcatcaatgggtggtggaaaattctagtcttaactgaccgcgctttacaaaaatcttaccccaacctgtttagatctagatacccacagaaaaagacatgggcaagaatttgctctcaggagggcaatctgtaaagtcaagcaaggacaaaaaaaatattgaagaaattgttagacaatgtagagaattgcagtgccacaatgcatttgttttgaaccttgggacgtctaaatatggcgaaactgagaatatttaatacgttagttgtggaagaaaacgattttgcaaccagttgcctcactctgaaacatgtaagcttatcagtcacaatataaagtcttagacttggtttcaatattatgtgatacataggaaatcaaacccaagattacgggtggtttatctttctttttcttttctattctttcgttttataggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttgtaagtttcattgctctcttcagtaaaattttctcctccttcactcagtcaaaggcagtgcttcccatttcatgagtttcagcccagacttctcctttgcttctccctaagcatagcaaacttgtcctcgtctggaaaaaggattcggggtgtttctctccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatgaggcttagatcttcagaaaaaaatggtttgtgtgttgggagtgtatatatggattcagtgacagtgcttagaaacttagaaaactttcattgcttgtagatatcaggcaaaggaccttttgcgccttttcctacccctccccaacatttcaataaaataaacagcgtgataagcaaggagtaagcagaaagattaggcccaggaagacgcgaatggcgcggaaatatcttcagcgggcaggaattgcatttgaagcccttgatttgattaaggcataaatattcctctctagagttcagcctttcagggctttaagtggattgggctcgtcaattagtgggcgcttaaagtactgaatcattttgtaaattaaaatgcatgtttttctctatcttttaagactttggccttcccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatcgctgtgactgcataccagaatgataaggtaaactcaaggggctttcctttttaatggtgatattttgccttccccttaaaagctgctttaagtcaggatgagaaagttacaagagagtggagacgagagtcttgagttgtcttttgtgatttgtggagcatttggggggaaaggacaatgacacctcgaggagacagaaaaacaccttgactaggtaggaacaatgctgagcaaaaaaacgccatactaattttgccacagagaaactcctagaactgctgtcattgatgccacccactcctccccccctcttgggctttgtcctgtctgttttaaggttcatcttcttccccttggggaagaaggatcaagaagtcacattcaaaaggaaccagctaaaaatttaaggcaaaagccatttgggatcctgggaggagaatcctagtagagaccagcttttctcccctagccagaaatcctgagtagctggtctggtttttattaccttttatgctgctgtgttatgatgtgtgtgtgtgtgtgcatgtgtgtgcatgcatgcgtgtggttggaaaaacctaccctgatcacagggtcatattaatcgagttgtctgaggcttttgagttggggtggccaaagtcaccacttcatttgaattccccccctcccccaggcctgaatctggaggttagaaggatccccaaaagggaaagcacctgatatctagagctatggtggcctgaaggtcatgggcacagaaaaagtgacccttactgctgattcaccagttcccagattggctgttagcagttatggggtgggaggagggactgaagacccctgctctgcaatcctggacttcaaagagagtccattttacctgacaacacacttcattttgaactcactgtcattgtcactgtccttgggtcctctgtggacttcatgatggggatgttccagctaaatttctttagtgtgaataccaaaacatgatcttctctccctgtgaaacctgaagtcttcaatagagcaatttattccaagaacatgaatccaaccaagggtccccctttccacctctgagtaactctgtg

SEQ ID NO: 71635 - DNA, 1060 bp, Homo sapiens
ttcacctggagagcagtttgggtctgggcaaaagcctgtcaactgtatgcaaacatatttgcctgaatttatctttcagccctttcacagtgtttgggtttctctaggcaaatgctgtgctttgatactccttttctttgcggtgtgtgtcaataagcgttttgaaatgtacccatgtggtggtcaggtccagtttgctgtagtcttggaactgtctgacaaggatgaggaacaaaagtgaatctgcaaatgggcatctgagaggctggcagcatttggaggggtaggttacagggggtcacaggctggctactcaaagtgtggtcctcagcttagcagcattgaccacccaggagcttgttagaaatgtggagtcttggatcccaccaaagacctcctgaatatcactgctcttgctccagggaccccactctaagaaccactggattggacgagaggtgagaaatgggttgcatcttgaaagccaactctaatcagtgtgttagctactgggaccgctgtgttaagtagggttctgaggttgtgtgatgcttagagaaaagaagtactgcactcttttagtcttgtgtgccactggtataagacggagacttagacaaggcgttgctatccctggattttctgagtgctgtcttaggattcctttatgaaactggagagaaggagcgaggaattaggtggagctccatttcctaaggacgggggggggggggagttaagaaattagccttgccaaggacttcatgactaaaacaccaaaagcaatggtaacgaaagccaaaattgacaaatgggatctaattaaactaaagagcttctgcatagcaaaagaaactaccatcagagtgaacaggcaacctacagaatgggagaaaatttttacaatctacccatctgacaaagggctaatatccagaatctacaaagaacttaaacaaatttacaaaaaaaaaaaatcaaacaaccccatcaaaaagtgggtgaaggatatgaacagacacttctcaaaagaagatatttgtgcagccaacagacacat

SEQ ID NO: 71636 - DNA, 1075 bp, Homo sapiens
cttgtattactgcaaagcttaggaggttttctctcttaggtctaggggtcaagatcacgtttgcttgataagatgaaccaatgaacttccccgtcattttccgtgagcccaaagagtttatctttcatgacaccaactttctattgggctgagactgaataaaggactgaagtaggcactcacgaaatgtttgtcaaatactgatactgttgaaagagtagaattagttgcacctcaaaaatctgaaataatttaccagtaaattcatcagatcctgatgccttttggggaagcggtttacaaaacaggaatttttttttttttcgtttttggttgatttggggtttccatttcttttgttgattttgttaatttagatttttacaggaaaaaaatgagtttttcaaatgtattacttaatgcaatggtgcagaatacccccttaattttgaaactttttggtgatgtatgctcttttccatttctagcaatattaatgcttttattccacctcgattgatttttctagcagtttgattttttttttttagtttttgtttgatttttccaaagaaacagctcatggacttaacaattctgctgtttgtaccttggctttgtcttcttattctttttcctagtttccttgagagttatgtttcattttgcttgaattttaattgcctgcttagttaatttattttcacttttgatgatataggcattatagcctgggggcttctggatgtgttggccctcctcaaattatatgcagaattcttcatgtgcatttttttttagggagacagtctttgtatcagattctcagagatgtcaaaccctaaaagggataaaattgcttttatcgtttgagatgtcaaacgctaaaagggatgaaatctggcactagatttaagttgattacatcctacaagtcttgatgcttaatgttttcatttttatttttatactcttggttctttatttcttttttgatccgtttttgttaaggaaaattctcttaaagtctctcacgctgtaatattctcctatgctacaacataatcttgcattc

SEQ ID NO: 71637 - DNA, 3229 bp, Homo sapiens
atttttaatagagatggggtttcaccatgttggccacctggtcttgaactcctgacctcaggtgatccacccccacctcggcctcccaaagttgctgggattccaggcgtgagccactgcacctggcccctaagtgtttgggctccagtgcctactttacctgcagtccacgcaagttcctactggcctcactggcggagctcaatggccatgtgtggctgctggctactgtactggatagtccatatctagaaggaaggaggaacatgagacaaaggatgagggaaagagcctggggcaagttaaggaatgcctttgagacctccttcctgctaagatctggaatgtattagaatctgagaaccagccttccctcttgaggctcacgcccctgctctgtgtgttctctttggcaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattg

SEQ ID NO: 71638 - DNA, 1053 bp, Homo sapiens
agattgtaatctttccattttagtttgttacatcataatgccatgaaatagatcttacatcccttagaaaagaaacccaagcaaataaatctgtacttacttgactgaggctgtcagttttgctggtatcttctctatgtgtgcagcaaagacgatgctggccccgcttacctttctcagtcacctgttgttttctgtgagatgctgccacaaaggggatcactcactgcagtgtgcagagtgaactgatgaaagttcatttttcaagctttaagataaatgctgatcatgtttttgggatttttgtttttcagagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggttggtttggtgtcatattagaagtttgcaaggaatgagtgatttacgcttaaatttaattttggttagaaatttcagttttagtcaccataatcttattctgttccttttttctcttgtatctacttatactctgaggaaattttaattacagttgtaggtggagagtagaatttaggaggacccaaaaccatgtcacaaagaaatgaatcactgtagcccaaggaggaaacagtggggcccagagggtaaatctaggatggatgcatggggttcaatgtgatggtctttctccaagtctatattgcatcactatcagtaaagttaagcctgtgtcgaaggtataataaccagccatcctcttcttcccctgccagggactcttcacattcttcattagagaagagtaagagtcagctaaaaacatcgcacatttacacttgctccttcctttatatttcttggaaccttttaatcccaattttaagggttcaaaacaaaagatcccctacttgcagtttatgttaaaaacagcaatacctagaatgaaatccatctcttgcccacagattggcaa

SEQ ID NO: 71639 - DNA, 1074 bp, Homo sapiens
ggggtcctttgtagtgatgccaggtaaatttcttcttgtcattgtcattaattacatatcacatcaattcagtccactcaaacttaagtccgcagacaagggtagaattgtcttcattatatttctataagggaagattgtatttggggcttaaagatggaaaacattcgataccttccatgcggagtggtttgtgattttatcatgtttgttgaccatagctcgggggagagactaagttctgaatatcattgagatctcatagagtcatggctaatgactgttacctgaccccagtttgttgttagtatatgaagatcaccctccaaagaactatgaaagtagacaccagaatgatgcatatttgaatatccttttgaagacatgcatttggcagaatctctcagcagcctcgaagggatatttctatagtctctctgatacggttgaagatgaatgggaaggcaaacaaggataaagcagttagcacagtacctggtacacagtaagctctcaatagatgtaggtgtcatttgtggatggccaaaacgtggccacagaatttcttaagaatctggctggtttttgaaaaccagtaactgagcgattttatatttttataacctatctttaccatccagatatttcttgaatcaaatgggggaccttccccacttattccttataaaagtcaacagtattgtggtgtgagaatggggttacttgtcatcaatccagtgagagacagatgtcctcattagactataggttacctctgttgccgctaccacttgggcagttacgtaacttctttgtgcttttgtcctcatctataaatggggatcatagttcctaccttcagatgctgtgatgatcaaatgcgatgacttgaatgaagagtttagcacaaatgctggcatgtagtaagcattcattaagtgttataacatgtattgattttatggtcctatctctataggattgttaaccgtttagaacagtactttataaattgtgaacaaccagaggaggaaagaaagtagggtgtttatttttagaaatacttcttacgta

SEQ ID NO: 71640 - DNA, 1021 bp, Homo sapiens
tgtagcattatctcattgtagtttcaatttcccacttgcctaacaactaatgaagttgggccaatgcagtttctaaaatagtaatttcttttaataaggaaatactggcttgattgagtttcccagcttacatgatttaaacaatcattttgttatgtgtcctcagtactatttatgtgtctctagtactggagagagagagagagaaacgatttactaccattactccctgtgggtcccctcagtgtcgttctggattttgttgtaatcattaagttgtatggctttgtactgatattgattttggttttgatttcagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtgagaagacttgatgtttatggtgcatgtaaattaatgctgtaccgttcctcaaatatgaatatttccagttttctatgtaaatgaagtgggtacagcatggataggttctttggaatttctagtgtttgtcttataagtgataaataactctgatttatctagggaccccttccccttccccatttctttatttgttaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaaggtgagaaatttttgaagaagtatttgcagaagacagaggaaaagggctcagctattgtcattaactgagctaagggagaaaatgtttaaatttgtaagaattaaacagattctattttatgattcttttatatg

SEQ ID NO: 71641 - DNA, 1024 bp, Homo sapiens
ttcctttcatcagtgaatgagtatgcttattttcactgcacctttgacagctttatagtgtaatgattttttaaaaaattctatatagatgaaaaacaatgcttcggatgtttgggtttcgttttaatgtcactttaactgaagctatcttgtaaaattaaaagattgaaattaaagttatcagagtacattgctgatagttttccattgttttgaagtctgtatcctaaatgattaggtaataattccaaaaaatgccatacacactgtgtaattataaaaagaaatataataaaattttggggccatggtaatacctgtaataaattgagatcttacccctaaagtgggaacatggtagtttctaagtgacagtataacttgaccaacataatcgtacatcttttgaaattgctggtgatagagaattttatgtcagcggaaggaattaggatttaattatattatgtgtggcacagatatattttaaggctgaggttacctctccccattgtggtaaggaattcatgccgtttcctttttcagcttgcttgttagtgtgttagatctcagtttctaggtttttggtttttgttttttttttgtatttgtgtctttagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgaggtaggtattggcaggacagaaacttagaaaatttatactaaaatgcaagctagaagaggtattttatctaacccagagattggctggttgcttagttggtcttctacattgatataagagttgctaggctggatgtgttggctcacacctgtagtcttagcactttcggaggctgaggtggaaggattgcttaagcctaggagtttgagaccaca

SEQ ID NO: 71642 - DNA, 1050 bp, Homo sapiens
gtgcatctccatgtttgcagaatacataagcatgactgtggagatagtattttgggtattgtaatcagagtattgcagcctgaaagcataatgtttttacaagtgaccattctagattctggttcagtccgacactgcagaatatcactaaagtcacctctttgcatgtattctttcagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagaggtatgttattcactaattgagatgagtggcttcagctcagaccctttctctcttcttcttctgcaccttttctcccttgacctcatgattctgtgaatcctatgaagtgctctatttctcttctcaaaagaaaggggcaatggtcgatctaaagctgcagtgttaaaaatttgagacttcttataaattattatgaattataaactttattattaaacttacttactatcaacttaattagtaacaactttgtacaacataaccacagaaaagaaaggggagttgaaaaagatacctcccattttagaggagtacattgccattttccatctgccctcgatgctctctggcttggtttgcctgtattttggtaaggtgataaatgttactcttacctttaatctgtaaacattctttagggagcctgtgtgctctagaattgagccc

SEQ ID NO: 71643 - DNA, 1620 bp, Homo sapiens
tgatcttactgaacctttataaacaaattctgacttacttaattaagagtcctcatcagtgaccatttaattagatgatttcaaaaatacttttaagaatgtcttgtgaacatggagtgacatttcagatgccagaattaagaccagtgcaccaggaatttcaaaattgtaaggttgtgggaaaaactctctagcacctttctacactacaatgtcattttaggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgaggtgaggaagttactgtgaaaattgctttttatgacttggatcctctgattgtttatagtgatgactaaatttcaagacaaatgtcttgaaagtaaatctcagagaaaatttgcaaacaggtggatgaagaagagaattgaattggccaatttttctggaagcaaattgctttcccatctttgctttatatttgttagatttagaaaacgttcccctcccattcttaccacacgtcttaaaatcccatcagttctctcttctccatttatgtgctaaaagttgaagaatattgctcaccaggggaaagtgtggctatgtagaagatgagctttaccaaaagagcacatctactctttgtatttatttactggatggattgagggacagggtgagtaggtgagagttcctgacaacagtgtaaaaatgtgtcttttgcaaatttctgaattgaaacataagtttaatgaataatgtccctgttgtgttttaacatgacatcttaatactgaaactttgatactgattaaaaatataattcctataataatgtaaaaaccaggcagataattttacatctttagtatatgaattcctgttgctttaaaaaaaatagaatcatgtctgtctttgaagaataagtgccacatttcttatgccaaagtatatatgcactaagttctttgtatctgatacatctaatgtctttgtattcagcaaaatgaaattaatatctgtaaaatatttagtactatgataggcatgtaaacattatgaaagtggtttttaaataagattccaagctgaattgcaaaatattccaaaacaggacattcatgatctataaatgtatgagtaggcacggaatagtaaatttacgttgttgctacaaagaaatgaggagatgctaacatgatgtaatgacatcaattaagtcactgccttggatacattcatttctgaacagtgtctggtcagggcatatataatactattaaatcataattaacagaaaatttgtgtaagcagttttaaagcccagccatttccttgaatggaaccttcaacataagttacaaaatgtaaaaagcactgccagatctttttaagagggtacagacagacactcttttaaatttttcttaatgacttcactagggttgcttattcggcagt

SEQ ID NO: 71644 - DNA, 1783 bp, Homo sapiens
tctagctaatttagtgtctgcacttatggttgaagttccatttagtagttaacttttcaaattacattgaccaaacccagtaccatgttttcttataaaaatagtaaaagttccttcaagaggttaggatgaggatgcttatatgtggaataagtagaaggaaagtgctgtgttgaattattcttcataccttactttcttcttctctacacactgcactgacctttgtatcttcttttttttttttaagagaaaattaaatataccagtgtatcccagtgatagcagaaacaaatgataagaaatacacagtacatggctggggtgatcatgtgtctagttcagcatctgtgacatgctgcccttcctcacttggtgccttctctttttgtagtaacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatggtaggtgtcccagaacacaaatttactttgaggagtatcttggtatgatcataacttaaaagctttctttactgtatttgacaaaaaattttaatttcatgtctttcgggggaaaaaaaagaacctaaagtgagagctgtattgattttatcctaaacttatggactgggagaatgttttatattgaaatgcctttggagaagagtaattgttttctgaaattttcctcttgtaactcataagtaagcagtctatgttgggaacctgtgaccgctgagtatcagagtcgtcaggagcttacagactgataatttgcacactcttgcatgcttaaatccaccattcttccagatcaagtttccaaggaacctcttccatgaagccttctagccatttccagagtctcttctcccttctctgttttccccctttgttgtatcacttataacaa

SEQ ID NO: 71645 - DNA, 1089 bp, Homo sapiens
gggatcagctcagagacagtgacagcattaggcatgatggagagccctatggtcagtatggtttcaacacaactcacagaattcaaaatggaagtggaagatggattaggaagtcccaagcccgaggaaattaaggtagttgtcaatatattaacatttccagggcagagcagtttccaagtggattcacatacatctgctttaaaatggtattgtctgtgtgccatatatacataagttcctaagaatccttttaattagaacatgaggcacaccagcaggcatattaaatagtgtcttttgattgatttaacatttctgcattagcattttctaatgatcataggagagaaatactgaaatacgatcattttggttgctgtttttatgatagcactatgccactgtggtgtgttctacagagtttaccaatattaacactgaccccactttgttgtcacaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaagtatgtatagggattgtgtcatttacttgccatatttgatgcaatttttatcttaactaaatgtttgttaaaaatgatgacaaggtccgggcgcggtggctcatgcctgtaatcccagcactttgggaggtggaggcgggcagatcacttgaggtcaggagtttgagaccagcctggccaacatggtgaaaccccgtctctactaaaaatacaaaaaattagctgggcttggtggcaggagtctgtaatcctagctactcgggaggctgaggcaggagaatcgcttgaacccgggaggtggaggttgcagtgagccaagatcgcgccactgccctccagcctgggcgacagagtgagactctgtctcagaaagaaaaaaaagaaagaaaaaatgatgacaagtagcatatcatttgaaac

SEQ ID NO: 71646 - DNA, 1390 bp, Homo sapiens
ggagggcttgagattatgccttttagctgcttgcttccaagtataagggaaaccagaccaattgtcagttactactggaggcaccaccctaatgtaacactgtgtccctgaaaattgacttgggagggaagaattgcttaaggtctgcaagctctcctttgatggcgcaatctgccctcacaagatccatgaaaaaaattcactgtttcttacacttgataagcttgtaaccatctcctttgtttcactatctgttggtatttctagaggttcacctggtaaacgcttctaccaagaggcatctaccaataggcatacattaggaaatatttgaatgctgccctacttatatacacgtcactctgttttaataacaccgtctgttcttaggctgtatcacctgctctgcgctcatcaaaaatgcctgcagttgggacagaagaccgacctcttgggaaggatggaagagctgctgttccttatccaccaagtaggtagagaaacttgactgagccattgtggctcactgcctgtaacttagatataatattctcatacttagtggtgctttatctttatctgaaatttcccttccttttgacagaattctaactgtgaattaaaacctatataaattggtgttctgagatggcaggcagctaatcatatacagaaaccatcttaatttgaattcctttcctttgttttccagttaagaattagctttttatagcttaaaatgtagaaaaacatgttttaggtttgtttttctaatagtcctttcctagtagaataaatgctgcacaagtgatttttcaaactgatactctattataagactgtgtaaaatgtttctgtttttataaatataattcactcaaggatattggatatttgatttcagtggtccttttcaagatgcatactaaagtttttgtgtttccttttgagatcaactagttttaccatatatgctgacaaagagatgaacctcttttttttgagtatattctttgccctaagaaaccaaattattctacaagaggaaaaaaaagggtagcttatgtggatactctgaagcagaaacataattccattgcaaatcattctttaacaccttctcattaacttcagctggtaatgagaacaaattgaggggaaaaaccaccatgtcatagggatgagtcaaaaagctttatgaacctataaatgtagtgctgatttactcaaatctagaagttgggaagtatacagagattggattttgacagctttagtggatccatagctttttaaaatatgcaaagctttctcaagcatgacatgggtgaaaatgaataatgatagccagcccgttgctgtagtttttttagttaaacatttttcttgt

SEQ ID NO: 71647 - DNA, 1065 bp, Homo sapiens
tcttttcttaatgttataatgatgtaattgtttactctcattttaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagct

SEQ ID NO: 71648 - DNA, 1017 bp, Homo sapiens
atggaacccaagtctaaatgtgcaattcatttgtttcatatataccttgtacatacagcctgaaggttattttatacaatattttaaaaatatttttgtgcataaaacaaagttttgactgcattttgactgtaacctgtcacatgaggtcatgtgtggagttttctccttgtggtgtcatgtaggcactcaaaaattttggattttggaacatttctgatttttggattagggatgctcaatatgtgtttatgtaggtataggtgtaggtaaaatgttccatgaggcgcttttgtattgtaataatgtacttggtaactttttctcaggagggtgattattcatagaactgtaatggtgatttagtagtaatatacaagtactatgcctcattttagaaaattatgtgcaattaactttcctggacgttttcattgccttgtaatcaggtttaacttatagttgaaagagaagatatatgaaatagtaagagtacctcagagcctcacaaaataatttaatcaagtctcattatgtggatactataatgccactgtcttttgaaaaggaggtaaaagttaaggcctgtccgataaaagaaaactcagtatacctgcaagcaaaggacctcaacatagtctttgtgagtggtgccaaagtaaactacatttttaaggagagtaagtggtaaagtaatattagcaaaatattcccaaataaggatctatatattgaggcaaattgcttctggcaagaggcttgattaatggcaactttgaaaattttaatagataagttcataccacagaaagcatttagatacaattatccgaatgcattttgcattgagaatctgttatcaaaacacttttacaccatgaaaaggagtgtattaatattcataatacgttttgaaagcacatgtaatagttgcattctaaaactcaacgtgagaagtaaaaatatctttttagaggatttagaatattgtaagagaataaaatgatctggagcact

SEQ ID NO: 71649 - DNA, 1139 bp, Homo sapiens
ttaaagaagatgccaagccacagtgagtgccagctgctagctctgaaatagtgatgtgaaaaggtagatttcttttgtgctatatttgtgctaagcagtgcctttaaaaatataactagaatcattacggtgaatagacacagaaaataattttatgttatacagtagttgtatactagcttcctttaaataaatattatagctttatcagttttttagatagaattggagtgtggggggaagaatacgaacatgggtccttcccttctctttttcctgcctcatctcattagagaagtatttaaggtagctttcatatagtaaatttaacgaggcgggaaaaaaaaatagatgaggaaatacggatagaggaaaaaataaggatggatggaaaatgcaatagtagattatggggaaataacgttctataagaaaggctgcatacctagctagcaccagtactcgttagcaggttctcctttttttttttttttttttttttttttggccttttgaccgcataggtaaagtcctgcttgctgctgttgacctgatgaagggcagcatgttggaacttccatctgttttacactcttttggcgggtcatttctcccactgtgagccaggcttgagaatctaggcagatgtcagaggtctgtccctatgtttctttcaagctggcaagaattccaccatgactgccacttgctcccccatgggtgtcagaatctgtcataatggttggatgtttttgtaaaacataaacattcctgattttaaggtgtacaatgagacacattttgtaatttgggaaggtacaccatttcagtttagcaatagggagctatggagttaggcagggagtcaatagaatatgtgcagtcttggcagtatttcagtgtcagttgatccttgattgttcacagtgatatataatgccttagtatttaatgagaaaaacagtagaaaaatttatgtggttcctcatcatcccccatgtcttataccttgcttgtccctatctttaaagtaacctccaaaacggatgaaaggttttatatttaaaaaaaaaaaaaagaattccaagcatgtcttaaagtaagcaataaaaatactttggtggttacagtttacctaa

SEQ ID NO: 71650 - DNA, 2062 bp, Homo sapiens
catgaaaatgacacaagactcatcctgttgacagtagcttgttagctgatacaacttcatattctagggatgagatgatttttgatgatgagctttggttcacttgtttaatcttgattagtggtgttctgttctattctgaggcttaaaaaagaaacagaagacttgggttctttccagatgtttctttgatgtgacttttccggggattagtgaggatgacaatatttttctacctgatgattatttgcgggtcatagttgtctaccagattctcaaatgttgtctcagctcacatgctcagagaaatattccttcagtgagataatctagccaggcttttgaatctgtctttagatgctgttgtgtgttcttaggagttaggatttccacctatagtatggcctcttttttcactcttcttcccactagtatcacagagctggtcttaaactttgaccatttgatttctctgtgttggtgtgaagtgaacacagagctaacattcacttgcgctttctttcgtgtggagttgtttgaactggcagagctcctgagtcagcaatacattcgggttatgccaagatacagacttcacttttctcagtgctgaatctacatagaaacttaattggttaatttttttgaaaacacttacttatggaacatttgaaaagtgcttaagttggctttgaaatttctgaaactaaatcctgcatttgtaatccatggggtgggcactagaataccaagttgatttattcttgtgattaagatccaggaacaaaaaagaggacctccttctcttgctgttggttaaaatagagctagcatatagtacaatggcgttattcttggtcacatgaactcttaatgctttcttgacacatttgtttagagaaaatattcttaaaacatggacatctgctttatatgcagtggtaagaatctttagactacacatgaatattacattgaattaaccctattaattaggcttctgagttgttctaggaaaaggactcagctttgtggcaaagtgccaaacatatgccagtttgaataaaatacatgcctttctattacttttccccttccccactgtttgagcatcatcaagtcatttgctttaggttgggatggagaagaatctgccagtgcgtaggggtatggattgagctgagtggctttattcctggatatctatttatacatagtcaagataaatagatacatgcatgcacacatactatgaaaagccagatgaagagtatactcttggttcccagtttaacttgcctgcttttattaagaaaaatgtgacacatgtactgattatcctaacatgttttagagcatgttttactttttgtattagatttctctgataatgcatttctttttctgttactaaacatgattaatgtaccacatagtgttaactgtgctctttcccccaaagacatcaaatgggaggcagcatgtagaagctaaattattcggagaggagtcagtgattgatttaaatataaaaggattaattggtccctgaaccagactattaaactgtactgtgatcttgactgaaagtggaagaattacaagtgcattgcatagaataaattaatacatttttcgtggctttaatccttttttttctgtattgcttattgtggttttatgtactgtactctattgtatgcataattgatgcagaagggattcagagtatcatgattaaatgggagagggggatagaaccattcctgaggtttaaggtggtacagttcttcttccaggatagctgaatgtatctccacagaatgaatatttcttggaattcttaccagtgatgaccccaggcacagaaagaagttaaatgttactgaataaaaaaattaaaagtttacgttctgtgagggctttgtttaacatgaacatcggctaacagtgggtaaatatagccctttatccttgaaagaattgaactgagacttcagctcttgagggtaaacagtgtaatggcaccatacccagataaaatttccttctttttataatt

SEQ ID NO: 71651 - DNA, 1044 bp, Homo sapiens
gtcccaaagtgctgggattacaggcatgagcctctgcgcctggccatcttttatattcctgtgagatgcctaacttgggtgaagagcctacttggctatcaagtaaatgaagacattttctttctttcttttctttttttgagagggagtctcactctgtcgcccaggctggagtgcattggtgcgatctcagctcactgcaagctctgcctcccaggttcatgccattctcctgcctcagcctcccaagtagctgggactacaggcacccaccaccatgcccgactaattttttgtatttttagtagagacggggtttcactgtgttagccagggtggtctcaatctcctgacctcgtgatccgtctgtctcgtcctcccaaagtgcagagattacaggcgtgagccaccgcacccggccttttctttcttttaaaaaacacttttagttactcgtacacagatagaagtgagaatgaaatattacactgattttgcctgctactaaaattgcactgcaagaaatttcccttacaaattgaagcaaatatctttatttaattatatttttatgttttactgctatattgttaaaatgttctcatatatgtgaagttggggttgtgctgagtaacgaaggtaacaaaagacaaagccattaaatatccaacatttcttttaaatggccatttctcctattattttgggatgtgaaattatttacatccatttggctttagattttgtatcagagcattaactttttcttttgtgatttttttttcaatgtttcaatggatgggtgtcttcatattatttatcttgacaaacatctttgtgtttttgttttttacactgactattcaaaattagctgattcagcttttgaaaataaaaaactcagcacttgtcaaacagaactccagtttcacaaatatcagaacattcttttttgtgtgtgtgagtgactataaaccagcctaccatattttgacttagacatggtatgttaaagagtagttagagaatgataagactgcattt

SEQ ID NO: 71652 - DNA, 1053 bp, Homo sapiens
aatagatcttacattgcaacgtagtacatacgtgtttttgtatctctcatttcttaaaataagtctgaaattttatttacattttcaattctattctatttaagaaatattggttgaaatctattaaattgattttatgattcctgccatttgaaaaactcttagaattgtagtcctcagatgtttttataattagtgtttacattttcttccactgtgtggtatatgaggctaagtgttcagtttgtccaccttcctaaattgtttgaatattttgggcaagataaaatgtccatgcatgttatatttttaggctcaataccaataatgttagaactgtctggtttgaatgtttgtaaatccttaacgaaaagcatttcttcagaagtgtaaattcgaggttgtgccagtgattatgtccatacttcgtctattttttcctaactgcaaatgattcatctatcatttttttcttttgccatgccaaaattttaagtgcttcatctggaaaaagggctggttataaaaggtgaaagaagtgtactcagtattaaaaaaattatgtgatacatttaagaagatccatgcttatttgttgtgggggtgttttggctaataaaaatctgtaacattgtttttatttaagtcattttaatttcaagccttttggccttgggaaatatgttcatccataatggtttatgagcagttatctccacctatgctttaataagcctgacttcaaaactgagcctcttccaaaagagacagtcactaatgcctaaaaataaaggtgatttcagttgtgtctttgttttcatctggaacagaatgccactgaaaatagtaacattctgtacatgagatcatgttaatactgtaacctgttcctgtcagcatatgtctagtagaaagggctggtctttgtatgaaaatcagagacttttgtttgctaggaaggcagaagaagctggtcattttcactctgctaaaagtgcaaatgtcttattgtagcatacttcctttgtagtcatgattatgcaggatctgata

SEQ ID NO: 71653 - DNA, 1036 bp, Homo sapiens
aaggggcagctgctagaacagtctgattccaagttgcttgcacttagtcttggcaaagaaataataaataccgtatttccccccaaaatgaaaaaggtaagatatagtggtttaatgttaagtgtgagatattaaagaagaaacaaaaaacagtggtcattcatttttttagcctctgggttagaaagtttaatggcaaacagtggaaaaactatttgtggagaccagacactgtagagccttctaggctttgaagaagattcctaatcctgtttttgttttaaatgaaccttgcttgcgcaataaagctctaagcagggtatttaaatacatatttaggaagaggaaaatggtttccatccttacacattctctgaatttatatgcagtggtctgcatacttgccctaaggggctaagctggatgctgttctgtcaagggcacccttgtggtagtcacatggtctgtgccttcctctagagctgtcaaactgaaaagttttagtatagtcaggtgtgtccaatcaatttgaatcttagggtcaaaaggatagagaacaggagtatggaatagtgaggctttctctctgcctcttgaaggtttgcctgaatattcagtgactggtgcttaatagtaaatcagaagatacaatttgctttggaggacagatacatttctttgtaacatttagccaaacttagagttatggaagaaaaagtgtcattttttcccctcctttattcattttgtctattaggtgacataaaagaaaaagtattcttttaaaacttaaaaattgggcgtattttaaatgtcaaagaaaactttgagttttttgttgttgttttgaggcagagtctcactctgtcgcccaggctagagtgcagtggcaagatcttggcttactgcaacctctgcttcctgggttcaaggaattctcctgcttcagcctcccaagtagctgggactacaagcttgcaccaccacccccggctactttttgtgtttttagtagagacggggttttgccatgctg

SEQ ID NO: 71654 - DNA, 1066 bp, Homo sapiens
tgctccccagcagaagccattttatccagccagagttgtccttcacagttctagcatagtctaaactcattttctcattgttcatattctttctctcccacccactctgtcttccctggcaattcaagttaaattccatctctcttctttgagttgctcccctgaagtaagatttctgtttcttctggcattttacctctaaatttatcaataacatgtttattctgctgttcttaatgtcgtgtgtgtgtgtgtgtgtgtgtgtgtgtgtgtgtgagtgattttaatcttctcttgaatttagaagatgagaatttagtctttctcctttccccattcctacattactcctaaattgaatctttaatataaaatcatttattttagtttccagtgtacatcataattttacctttttttctactcaggatctataattcccagcacaaaaggttggattaaactgaataggacatacttttcctttgtaaatctatttcatatgctttaggatcaaaatggtaaatgaggtttgaaaagtaatctaacataaaacaaaaattgggttatgtcattaaaatagaaatagtctcttcaccattcttatcttgatgttaaaagatgatcttttaaactattttctaattgggttgagatctttgattcttataattattggttttgtatggttatttatcagtgttattcattattgagtggtttgttcaagtttgagcaattgggctgtttgtgacccttattttactatgagtattttttaatagaaagcctacagtactgttggactttgtgccctgtcatgctggattgtgaattgcaattcttgtagtagaaatagcctcaacacattttgagatcttaaacgtgcttcatatataaagtaggaatttgcacacagaggaccctagagggaacattgttaggcaacatttcagggataattatgtactcttgaaattgagtagtattgtttctttagtgttaactgttattgagaatgtagaaaaataaacggacatcgcagtatatataattgaaaacagtt

SEQ ID NO: 71655 - DNA, 1048 bp, Homo sapiens
ccactaagaaccaaggtcgggtttctgttagttttagctgttgtggttcagtctgccctatgctacaaactgtttaaaaaggggggtggaggggtaggtggacaactgtgatgagaatgaggatgattgattcagtgccatttcctccttctggtggtaaactctttcccctcccccaggatcttcctgcatttggtaactcaggtttttgcagattttaatatcttcttcataatttatagttgttatttaaagggagtgtcatgttggagtggaaggaactactttgtactactggatggggaacctgatacgtattttaggatgtaaaacttgacgttgcataccatcctttgtcaaggagggtaccatcttttaaaaaatgtatagacataaaagatctttattatatatttggagttaacatttatataaaaccttttcctgatgcacttttagtgctctatacaaatgtttcttaacagcccttatgaacttttttttgcagaatgaggtaggatgatgagaaatgagacagaccagtaagaggaaggaaggtctgggaggtgaccaaacaaggctgaaaggcagatgataggattgtaaggggaatggaggcgattgagggatggctgcctgtttgattcgtagtgtgctgttagtaaatggggtcctttctttgaaaagtgtgatcacacttggtaaaattttctgactgtggcatctgtgtagcaacttggcagcagggggaaagcattgtagattagagttagatttcagaacatttctctttcgacaagaatattcatttctggaaagatggttaagaatacagtttcatatttttgcttttggttgactttacacttttttttctaacatttttttcctcattagtttaaggaaacaatttaaaatgttaagaaaaagattacataaattctattaagcttgaaattactcacttaagcttgccttttttgtgatgaattttatggtattgaataagatagcataaataaagtagctaatacagaacctaacatct

SEQ ID NO: 71656 - DNA, 1883 bp, Homo sapiens
cttgaacctggggggtggcggctgcagtgagccaagattgcaccactgccctccagcctaggcaacagagactctgtctcaaaaaaaaaaaacttgaaagatgggtgttagtggcttggatgaatatctctgaagttctcttaagaaatgctgtattcctaacattcttgatgatgcaagaattgaaattatgcagaagtgtgattttatttgaagtaattctgaagcgtaagatgttttagaaatacatcaatcaatttattttgcttacttttgtttacattttcttttttacgtgggcataagaatctgtgcccagtgtcccagagttctttcggaaagtataacgtaaaaattttaagtgataaaacattttgatagtttaattggtggtgtttttatttttggtgatatatctcatctggtgtattgcttcagcgacttactaatttgttactgatactataaaagtaattcttgatgtaattattttaggtgcctaatggataagaacttcgttaggattgggaaatggtttgtccgaccctacgaaaaggatgaaaagccagtcaacaaaaggtgagcctttagaatgctcttggctttttggtttctttggccttgtgggtgggtgaacagcttattgatttatttatttcctaataatgttagtagtttagatatactcaaatagatcctggatcacagtgttcttaaatactatattattaaatttatattcaatattaaagattgattagaaaggtgattgccaatatactcatgttcaagccacatattactatactatttggaattaagataatctgttttgttattttccattttccttcctcatctttgactttttttttttttttttttttttttttgaggctgtgtctcactctgtcacccaggctggagtacagtggtgccatcttggctcacctcagcctcgacttcccaggctcaggtgatcctcccaactcagcctcccaagtagctgggaccacaggtgtatgccaccacacctggctaattttttgtatttttggtagagatgggattttgctgtgttgcccaggctggtctcgaactcctgaactcaagccatctgcccaccttggcctctcaaactgctgggattataggtgcgagccattgcgcccggcctcatcattgattttttaaaagtgttgtatggaataagtttaaaaacagtgaagaaatggtgacaatttttgtggaattcattggtgccccttaaagaagatcaacacatctttgacgattgtaaaaccagaactgtgaattactttcctaaacaatcctaaacttttagccatcatatgtgtgtgtttaaatgcaatccttgatactatacagacatggaattttagatcagtcacaccagaatcggaaaacaaaaccctcagaatttaaaatttactttggctacctctgaatgtagcacacatgtagttggaatcataagttgatggtgaatattcattattgatgagcatggtattcaatttaaattttgttttattatcagtgtacttgccctaagtgtcccaggtactgggtgcagattagagcccttgaagccttacatagtagttttaagattaggtcttttcttttggttgcaaaatttcagctggaaactcctgcctcattaggaacctttgcttgcttaactttcctagtttctagcagagacttaattagtagtcttctcactcaacctgtctgccttaaatctttaatgaaatggttgtggaatcttctcattaaccaaacataatttatgaaaattttcaaatcagataaattagggaccggaagttttctttgtcaaatcaccataaacttct

SEQ ID NO: 71657 - DNA, 1538 bp, Homo sapiens
ttgatgacattgcctgacgaagaaatatgacctgcagtgggaactcaaggagctctattcacgcagtgttggactctcagagttttcatcagcctttttgccttttgcttttgtccttgagtggtcttgactgtgcactgctcttctaccctccagaccttgtttgttttttctggaatgaagtccagcatatagaatttgtgacttttacttgatagaagaacaaataaactttcagacattgtcctctttagtcacagatattttatctgcttttatttcatattatactctctgtagccttggatttttctttctgtacactgtaaatttatgatttgttactgaataaatggttgttttgaattctgaccttcaagacatgaggaaatgaatattttttaaaacagtatttactaagtgaggatgtgtgttactggaagactgttcagtgtttgacgtgactccatacctgttacgtgccgtattgcttttattctcagcattatcaattttaagatataccttcaatgtaacaatggcttttggagactaaagaagcattatcacgttaaatagactgtaatttacaaggtacatttggacttgagaaataaggaaagaattgggaaaatgtgacagcatgagagttggtatatgctaattattaaatgtcctggctctgtgatcagatatacctgggcttgtgtgcagctctgctgtttattatctggatgacattctcactgtgcctcagcttcttcatctacaaaaattgccattgtaacactcatcttttattactgctacaagagttaaataaggtactgtgcctggtaatcaaccaggtagtggtggtatagtgattctggtagcagttattgataatattattgcagaaacttggtattaaacactagagttctagtggaaatatgtttatatgtactctaataaaaatataattaagtctgttagctggtgaataaactgtggagatgctttttcagttttgcttcttgaatacttcctccttgggtgggtgtgccatatttcctattttctaaatttaatggagtcacagtccttacccctaaaaagcatttttttttaaacttataagcttaggaaaagagatttggttacgctgaaaatgattttcttcattgtgaacaatggaagatcgcagtagaaatttattttctaagtaaaaccagtggagcccagtgactttttggtacattggttctccgaattgactgcccaaaaggagttccattgtggtcatcagaaactattaccattcactaacccatctaacctgtaatgagttgggtgagggcttgaattgtttccatcctctttgatggtgtggaaattacagaggcaaaagccatgtgcagaattgcctcaatatggaataaagaattgctatataactcttttgctggtaggtaggaccctgtatagaagaattacattcagtgttctgacatcttttcttacaaaatatgtagaatttcactgaatactgttag

SEQ ID NO: 71658 - DNA, 1099 bp, Homo sapiens
atcaggctgcatttgcacttaattattcagagccatatggcatgacacagaaacattaggtacacacatacacacagcctgatttcattttcatttttcagcagctgttttctttttgaaacagtgattttggggaggtggtgggggttgggaacagaaataatttcctagtactattgcttaaagaccattttataaatctggcatcacagtgatcttgccagataatattgtactactttccagcattatatcatatttggatagtgaagtcatttagaaaatctcaataataatgactgggattactgagtagagaaccaaggttaattgatatatagtcttagcactatttatgatgatattgatttgaaacagtttttgcctgatggagtgtgtctgcttgatttatttatttgtgaagttaagtataaattttgaccctcaaagcttgatagagtgtaaaaaaggggaaattatatttctgatgtaacttttatatcttagaattatctgtcattaaaagatttgcaaattatgttctttaaaatatcattaaagcatttgggcagcagtgctggtcatactaaacattttttagtgtctatgaatctactatgattttaatcttcagtgggatacgatgggctataaagaattgaaatatgtagattttttcccctcaaacaccactgttgcattagcgagaatacatacacataagaaaattcaaataacagtacaagactacccgtgattagtgattataaacaagaaaaatgccagcattacattatgaataggaaaatactccttggtatatggcattcatttctcatatatttattgagcacctcccaatatagagcatacatttaagcatgttacatagtgggcacttaaatatttgttgaatattatcagtggataagacagacacacaccgtctgtactcccaaagaactgatagttttattggggaataaagctgtagaacttaatcattacaactcagtggtgaaagtgctgatttgtagatgttagagtagtgtgcaggcttgatcgggacagaaagaatgaatagaattcaaattagagg

SEQ ID NO: 71659 - DNA, 1373 bp, Homo sapiens
aaaaaaaggaaattaattatgacatataaagtttgggatagttctaaagaattttgggttattccttggcttcatttcagggtctgttacttggacagttaccctaatctcactaagccttagttaacatttaagtacaggacaccatgtaccttgagcttttgctagatgatagatatatatcatgtgtgccacataatgcctcacatactgttaatgtcagtaattattttcaccataaattttttattttacatactttgatttgtattctttcaaatttcattaaagtagttccagaatgctctatttgagccctcctacaggagtcaattttgaaacaaataaaacatcttttcttttagaaaataatgatcaaacaaaccatcttcatatagtttctatggatgacttcagattcttttgaaaaatggtactaatcctgttgttctttaagataataattttctcttatcaaacttaatgtaactttgttctatgaatgaaaattaccctgctcatgagataggaaagctaatttaaatgattgttgttggctccgtttattcattgtcaacagaagttggaagggctaatatatgcttgcttatctgtggtgatggatatcatgaaaattacgcacagctcacccccaccccccacgcgccccccccccctttcttttaaagctcagctattgttaatgttagagtctattttatgtgtggcccacgacagttcttccgatgagacacagggaagccaaaatgttggatacctgtacaaccatttgttgtagtctttgaaaaacctgtttacaatatgaatttattgagaatttatttactgtcttattcctggcaattttctgttatgccttttcatttctattcagataagatgtggatattgtgagtttctggcttgaaagctagaactgaggggttttttttttttgtttgtttgtttgtttgttttgagatggagtctcgctctgttgcccaggctggagtgcagtggcacgatctcggctcactgcaacctccgcctcccaggttcaagcaattctcctgcctcagcctcctaagcagctgggactacaggcacgtgccaccatgcccagctaatttttgtatttttagtagagatggggtttcaccatattggctaggctggtctcgaactcctgacctcgtgatccacccgccttggcctcccaaagagttgggattgcaggcatgagccacggcgcccggcccaactgaggatattaaaacagatcatcaaggactttatcacttggagagtgtttgtgtctctccctagccattttttccatagtttgcatgttaacaaagtttgtattgtgatct

SEQ ID NO: 71660 - DNA, 1229 bp, Homo sapiens
gtgttttcagtaggctcatatcgtcagtgtcccattattagtgatgttaacatgttctgtcaattgactgaggtaatgttctgtcaagtttctccgctataaactaataagtattttgttaactgttatctttgtcaattttgtgtttgtaattaatatgtaatttgtggccagatacaatgagattgtataattatcctatttctcatcaaattttcatttatttgttttagactatattggtagtccttgcttaaatcatttattaccattatggttgtactgttcattttcaaatgccaccattctttctactttttattagttggcatcctgttgtaaggaagagctttttcattttcttgcattttatttccttatttatttatttatttatttatttatttaatcttgctatgtaaattgggacccatggattgttattttattcaatggattatagttgatttttaccatcatttattttgatgcttaaatttttccagatttggtcagaggaagcccctttgtgatggctcgctcctatgtccttttgacatgatcccatcgttggagcatccccttactttctggcatagcaatatgttccaggctctgaatagtgttttgaggggagaagtggatgagaaagaatgggttcattaagagcttgtatgagaaaaactttttacgtctcttcctgagtctgtatgtagtactttcaggtaatcaaagctgtgaggacttaccagtttcttatccaaactattggctagggtggttaccactgtaatacaactgcttaggacacttgaactacagttgatatgttatttaagctactcagaaagacttttctgacggaagatttctctatttctcattctcaactttagctcctctgagtgttcctccaaatctgtcttttggagtagacctagaaatcatctgttactaaggtgtactatgcatgtggaaccattgatttaagagttgagtactcttaagtattctaaatatttggtaattctgtctcccactgtaaaacgaaacaaagtacacagaaactctatccaagaaaatgtggaaaacttactgttgccataatcctgtaccagaataaagctcttggtatctctgcaataattaacacacgtttaagcacaattctttttatacaaagttacaaggtatgtgaacaaagtatattttaaaattgtagctcactg

SEQ ID NO: 71661 - DNA, 1932 bp, Homo sapiens
aggttaaaaatggtaatcattttaaaaaatatttggaagaagtagcaaatggggacaaatttggttttgagaagtcaataacagccattgtgcaagatttctttttcagtgtgcagctattaaagtaacattgcagcctgttttctgtagcagttgtcttttgaaggccttgtacagtttatctcgaaatttagttttatggtttccttcaatttaaagtttgctggctttacagggagtcttgtgatccattgaaatgctaacttgggtcgtgtctcaactgctacaatgctgtgtagaaactgtcattaaaattctggttatcctgcaactggcagagaacccatgctgattccttaggaagatagtacactgttaaaattttgaatcgcaattgtgcttctgtctgccaaatattatcaatatttgtaatcacttaaggttgcaaatagtttgaaataaatggaacgttttagtatgtatcttctatccatgattcttatttgtttgatgaattgacatcgggaaggttacaatccatttccaacatagatttgttaagtgatactgaatattttacactcatgagcaattcaagaaatcagagctctaaataggttgaagttgatataagtaataagtccatttagttattaatgacttcaaatatagattctaccaggcaactgatggcagcataaattgatcagtcagtggtggtgtagtgttgtaagtcattggatttttttatgtgtgaagtgctatatttcataattaatgtagcattgtgctcctttgttactgagtttctttggtaagtcagtttttaagaaagcagatacttcaaaatcgtttatttatcttggtatccttcatttgctgcagttagattaagtggatacatgtttccttgttgtaatatctgattagtgtagtttttggaagtagatttaataattcagaagatttttttttttaaacactacgatgcgttttatatgtttgaggtagaaattgaaaacaaaggcagtgggcaaatgataaaccttggattcagagctatgctatctttagccgttagttactgaaatctaactgggaaacaatgtacttgtttcctgtgccttcctttacttgtgtttctggagtttcgagtgaaatttgattttcaacaattttaacggctgaataagaagtgccatccctgaaagtgcccttcccccacctccaatatttgcagtggccaatgccgttgctgaactcaatgttctggataataggtttcattagttttgatgcctgaggtaaaaaagcagtaggtgggagtaagaagtgtttttgatgtctagacgttcatttcagctgttgctgcaatatgatacattaaaaggaaatatgtatcatagctcagaggaaatatgtattctttgaaagtaattctacttttaaactgtgtaaggctgggtgacctgaattctaaaagcatgagcttgaatttcttcaaggtttcacaatctttatgctcctccctaccctattccattctccctcctcccatttttttttccccttcaagtaaagtatgtcagtttcatttatggaattggaagggatatctttccaagatctctgctggaaaacacaaaatcattgaagtatatgctgctttgatattttgccatattgactttttttctccctgaaccttttctatgttttttctttcaaataagcttattaattctgtaaggagtcatgtttggtgaagttgaaagaagttatattgcaattgatggggatttgaaaaattatttgggcactaagcagtaattactactatttaaaacttttcctttataaacactgtcttttctgttaaaaaacatttatatactacttttgcagtttaaatatttgattatgaggataact

SEQ ID NO: 71662 - DNA, 1052 bp, Homo sapiens
gagctatctttggaaaatattgtttgtcagatggggcgaactgtgggctcaggggcctgcctgcctatatctaggggcctcacatgagttaccatggtcctagagcccgttaagaccagcttctgagcagaaccaagagttacagtaccagcctggtctaccgtcatgctgaattgagctcttcttcaggcacaggctgtttccagattgttagcacttcctgttgctcctcttaacattaagagtcctacaggtagaagaaaactcaatattggacttttaggcaatgttgactcacagggaaagtgttgcaagagaaagtactgtgttttgtgagtacagtttggaaattttaaactcaagtctgctcacatagtaaaaagaaaacaaactctggtgagattggttctcatttttttgaacagtgctattggcttttactagttggagataattgtgcccattcactcattttccttctatcgaatggtcaaagattcttctctttatgcctggtgttatcagtagtaaatcaaacttatagttttcaaatattattagttttattttttcctaacaagggaattgcaactgtgcagcaagtgataccgtttcattccctgcagttagtctgtttttcctctttcttcctttcctccccttcgccttcctttttgtttttttttgagacagagtctcgctttgtcacccaggctggagtgcagtgtcggctcactgcagcctctgcctccctgtttcaagtgattctcctgcctcagtctcctgaataactgggattacaggcacacaccaccacacccggctaatttttgtatttttagtagagacagggtttcgccatgttggccagtctggtctcgaactcctgaccccaaagatccacccacctcggcctcccaaagtgttgggattacagatgtgagcccctgcacccgacctgtttcttccctttcttttcaccttgtagctcagaattagcatatagtgaaattgcaagggaaaaaaaaaagcaagtagaaaagagaagaaaa

SEQ ID NO: 71663 - DNA, 1846 bp, Homo sapiens
atcaaggatcacaaaactgatcagctagcctttgtgtatctgattgacttatactaaagtttcttcctgctttagggacatgtacttgctcctctccctatttgaatagctattccttcatctcacgagcctggttccttgatagcattaggtcttagaacaaatactacttccttatattatagtgtgatcttaccacttgctccagttatcctttgctgtgtaacaaaccaccccaaatttggtggcataaaatggcaaccatttcattatgttcacaggttctttaggtcaagaatttggaaagggcataatagatatggtttgtttcagcactgtgatgtctcgaccttcagctggcaaagctagtataattgaatggctgggtgccaagatcatctggaggcctttttattcacatttgtgactcatgtgagggcatggatgagctaggattgttgactggagtccctacaagtagcctttccatgtaacttaggcttcctttcagcatagtggcctcagaggagttagatttattactcaggactttcagagcgagtgttccagtgaatgagatggaagcttgcatggcttttctaacctacccatagagattatgtgttgtcacttgcttttttgtttgtttgtttgtttgagacggggtctcgctctgttgcctaggctggagtacagtggcacaatctcagctcactgcaacctctgcctcccaggctcaagtgattctcctgtctcagcctccctagtagctggggctacaagcacatgccaccacacccggataattttttgtatttttagtagcggcagggtttcacagtgttagccaggatggtctccatctcctgacctcgtgatccgcctgcctcagtctcccaaagtgctggggttacaggtgtgagccactgcgcccggccacatggtgttgctttcatcctactccttccttgaagcaaccataaatcctattttttaagggaaagaaatacaggccttacctctcagtgggaggagtgtcagacacttggggtcttgttttaaaactggcgtatcatcgtaaatagcataacatggttaacatgggttaaaagacatgttgtcttttaggtaaataaggtaaaagacttaattgcatttaacttgcatttaacaggggtttgaataattttatataagtaaaattattactctctgcctctctcaactaaaatgaaagttttatgaaaaatctgttcactgctgaattttcagcccctataatagtgcctaagatatcatatccattcacttgctgaatgaatagatacatgaattaaaattcagccacatagccagtttgcttcaccgctgagaccgtcctagtaccctgttatatcaccagggttctcataaaaattttcttattaatatgtaatataaattgtaaattcagcatttcatttcactgaatctgtatctttttgttcataatgtgctttctaaaatgaaatcgggtgcctttgaaatttagttcgtctctcagtatactgcttctaccttaatgatttatcatccaacactaatcatccagattatgttactgcaaaactagtgtgaagtacaataattttgtttttgtgaatgagttatgaatctactctgcctgggacagtggttgcactggatgtatatcatctaatatcaaaactcagtagcaaaaaacagtttattttattatgcctatggactctgtgggtcagaacttaagacagggcacaatagggaccagtagtttttgctccaggatgtctgagggctccactggaagggctccaagactgcagtc

SEQ ID NO: 71664 - DNA, 1017 bp, Homo sapiens
tgcatatcagattcagtgcccagatgacttaccttttgggaaaacaaaacccactcacttttatggaacatattctctgccagagacactattttaagcacctttacgtgttatctcagttaatctttaaaaatgtttgcataaagtagttggagtttcagaaaatgtactctgaattcatagtaaaaactacagtaggtcagctattagttgtattagccacattgattaaccacaaacatgcagaacttatattgagcatgctttgagccaagattttatgttttggggtaagctttttctttagggaatttttttgtgaggaaatagatttgggacaaagattctcagaccaaactcagttttggaatcacccagaatttcagaaatgggatctcagttcactatcagggtcgaactgttgggagctgggccctttgggacagtgaaggacaagagatgggggaaatttgaggagtagttgggcaccacccttacttctcatccaaaattaggatgtggactttatcggtgatggctgagtttcatttagtaatgaggaaaggtttttgtgaaacattcttttaaatggaatcacatgagttaatggtgtgagtatttcagggctgtgagttaagctgttggggcagtgaaatagcaggaatttctcagctcagtcagaatcctttcttgtgtgctgtgtatggaacacaggggcaaaggaaaggccaagcaaagagaaactgcctgtgtgcctgttctgtggctctgggtaatcacctggcttctattaagttctgtagtattggtgaaataattggggatttaaaggaggtgaaccagtgtgtggtctcttttagccaatccataacctttaaggtacaagttgctgtgattttcttcttggaaatagtttttgtatattcatttttcatggtttaggatctgtaactttaatatcctgtctatgaatatgaacaacctagtgaggtccatccttctctagagatataagta

SEQ ID NO: 71665 - DNA, 2912 bp, Homo sapiens
tggcaagccgcaagggagtaggaaatcccccaaggatgatatgaaatgtaccagactgtggcttgcattctttgcatggtagacacattcttgaagttgaagaaactttagctgcagacaaaacttgacgctttaatcacgtatgtccaagcaaagcaaaaaaccacaaacaatatcttattacctcttgttagcaggatatgaaccattggctgctgttaaagtttatttagaaatggaaacagtaatataattatggtataataaaattatgctgaaaataatttcagactttacaaaaactactttttattcctctttgatttggcaggcatttactgagtatttactttttcacagccttttgggggctttatacggagatcctatccacaaggagtttataatccagcaggggagagagaacctgtatgaaacaaatatatttccatgtaggatagagcctgcaaatactaaaagacaggatcagtgaaaatgcttaggagattatgaagggagagggaacacttttcattgaatgtatagtggaaaaggaagaggttgtatttgaggggtccagataagtaggatttggcattcagaaatttgtatttgagaatcttggacaaaccagagaaaacatacagaaatataaaggtgagaaaggatagggagtagaagttgagtgtcgatgtctctgaatgtccttagatttaggaaatgtatttctaaaagacctactttaccttttgcccctctgtctttgttctttcacttggtgactttcacccttaggaaggttaaaaataaggcactcattagtctgtatggttcccatagccgctatagacagatggcatcattttatttttgcacattatggctaattttgattttccaaaacttgctgtagatttattcctgcctttaggtccattgtaatgtgacttcttattgctcagtttcaaccactgtgtaggatccttcccatctgcatttttctaaaggccaaatgtaatatagtttgtactgtgctttattctaaaatcactgtaacaaaggagttttattgtatgcgtttattgttaaatctctgtcctaacaccttgctaatggagtttcttcgtgataccttttaaaataattttctttttcattgaggaggcaatttgaaggtaggatgtgaagaaacattttcacttaaagcatttaacagttctgacatttctatagtaacttaagatgtctttgatctcaaccaattatatatgaaaattgacgtccttatgaagacctcttatacacatttattttcaataacagaaattcataactaaatatctcccctccccacccccaagagattttgcttgctaaaagcctagttaagatgaaatttatgggactagtttattctctgtagttttctcatttcccccctcttaatcttctggtcctctgaagttttcccattttttaacaataagatgttgtgatagacctctggggagtaggttggagtcagagacaaagttgaacagtagtaggggcatccacacgagtccctactgtgggcctagtgtagtgctaggtgctttacgtaccatagctctagttctcagaacatctggtagcgatatattataggttgcatttacaaaagaagaaacttagattgagaaaattaaacgacctacctaaggccacacacccctgaagtaccatatgtgggtttcaaatctagactaaactactttcaaagcttgtatctttccgtaattctaggttgtccataaataaaaataagttttcactattttctggcttagagctgtacaaacagataataataagaatgaggaaatgccagatgtgagaatggtgtgcctcagttctgtgggaggtcagagaaacataggttatcctaagtgtcagaggagcttgtataggaacacttagcgaagttgagtggcagaggtgcagtggaggagtagtggaacacgagagcagaatggaagctcagacccggttgtaggaggtttagaatgccagcctggagcactgagtctttcccacctcattgattatagaagtttagtttactaaattatgacaagatctagatgtaacaagaagagtagaaatgacttattttttgccttcttggatttgctttccaagactttgttgtaataaaatttgagtacgttgataagctggcactgctgtaagggaaggtaggctctggccttaggcggacacaagagaactagacacttggtggtttgttacatgttgtgtgaagttaatgtccagtgacacagcctgcatggtcagccagaaaagagatttggcttagggccatgctggtatcacagcgatctcagcgtcagctctgattccaattaggtctttacagagattcttgcatttagagccattcttttgacaactaaatctgtccatgtgtgcatttattaaatgtgtatacttgggtctaattttgtatttgatccacttccagagaaatgaatttattcattcattaaaaatggatacattaaaaaaatgtaactatcagagggcaaagtgaaagaaatatcacacctttctttttctgtcttccatttcttcctcagccctttaaaaatatgttattttatcattcatttattaaacattttttattgccagctaagctgcaggcactataggggcatatgaaaggaacttaatgtccacttactcatctctagccaaaccattctcaatgcctaactcttattttctgtgtttttattcatgttgtttcttctgcttaggtcatctgtatcagcgtctttccttaatctccctgtttacttattctaaatgttacccaccctttaaggtctgatttaatattattggga

SEQ ID NO: 71666 - DNA, 1022 bp, Homo sapiens
gggttaaaatcctctctttctcctgggtacttgctgtttgactttgttttggcaaaccaccacatttcattttcttcatttgcaaagtggggaattaagagtcacaatgcttcattgagtgtgaggattacatgagttaacacatggaaatcagttagcacagcatttcactcatagaaaattcagtaagtataaactgttgttaatgttaccactatttctgctattgctacaagagcagtgctccgggcagctgtgatttttgttgttgttatacctactattgagtagttttcctttcaccgacattgatttgtgtatacgcattaaggccatttctgtttttaatgaaggagttatctgaatgttgtcagtttggggatgagaagaacttgtgaggccatggtgtcaataagccttccgtgtgcttatgggaaaatacattctcagcacaaagggagcattaaaccagatatactatttgcatattaaagttagaaagatttttctgtttggtttcaaaatttcctgcagtaagggggaatgggttaaaatagaagcaagtgtgtatatatttgtgtctagtctgtgtctttcaaaaggaatcatttacttcctgtgaggagttgccataggaatactgctattatttcttccaggagagtgaatttaacttgcttttggcctttaagggggcacaacacttaactttaattctttattgtatgtggttaaaactgatttttgttgttaatgacatatatctggttattgctattacagaaattgattgcttcctgctcccttctctgcaattatttgtggtggtgggatagagacttgtggtagctatcagaatgtgctctctgcctgctctaactaatggaggtggcactctggcttccttcttttgttccacattttggcttttagctgccaccataagctcttggcaaatagactgagaaaggtgagcaatcttttcttccagttaaacactcccctcccctcagtaagttctg

SEQ ID NO: 71667 - DNA, 1196 bp, Homo sapiens
tcagataaaatatatttgcattttgagaactctgagcttaaatattcttacaaaataaggtacataaaacctcttctgaacttaaacattttcttttaaaacttcgcttagtagtttatacctttgatgcattgatacttgtggtaaggaggaggttggtacttggaaacttggcctgcaatgtgcaacatcttttccttaacttgccactgatgctagactttgaaatgaacacccctgcctccccatcagatgtattgaacttcattttggactataaaagtttttttttttttttttttttaagtaattggagactttacatttacactgtgctgcctacaatccagtattccttcatttgttaatttggagttaaaaatggaatcctaatggatgtactcatatcttatgtataatatatgcttcagtggaaagttgtaagttataacttgctggagacattcatcatatggttggaaagatatttatactactgcaaaaataaaaaaaactgatgaacttgaaccttaacatattgctaataattattataagcttaaagaatttcatgtttttgtagaaataaaaatgatagttatttacgataatagcatgaagtaaaatgagaggtttaagaaaaaccattctagagtgaattgtctatagaaacgtgaaagtaattgcacagaaatttttcccttattgagttgagtaagaaaaatagagtataaatttatatacacaataatggaaatgatattttctaccctccaccttactatttctaatatgaaaatacatactggtcctataattatgtatctgattattttattaaaatggaagagtgaataagtgcttgggacctagaatcaatatatttagttttttgtgttttgaagaacagacacaatttttatgaataacaacagcaaagaatagttaatatattaacagtttcaaggtttttttttccccttaaatcttgtttatagaaaagtgtgaaccatacattctttgttgaagactgtgtggcaaaatgtaacttcagcggtgaaatgaactctagcactgcccacagcgctaataggcttggatcaaaaggtattattttggtgttgtaaacgttttcatgagaaaacgtgaaatacctattgtgtggccgaactgtggtatgtttgctctgtcaagac

SEQ ID NO: 71668 - DNA, 1573 bp, Homo sapiens
ggctacagggagctctgatcatgccactgcactcaagcctggtgacagggtgagacactttttttttttttttaaattaaagtttggatccagtccagcctcttcctacagatcagagccaaggcccaaaggagctgagtgtcttgtccagttttgtatgacttgtccagtttccatagtagaggcagatccaggtttcctgctacatcatgctgcttctcaggtgactattgcagggctctccagagagttggccactatcatgatgcatcgtgactcacctaaatggttttgtttggactaagtttgtttattcagtagtgttgaaatgtatgttgcaaacaacaacaacaacaaaaatagcagttaaaagaccttattgctcaagaattagttactatttttaaactatcagttaattgaacgttatttgggactttaaattcctttgtgaaaaaatttaaatatctgtctgttttattataatggaatttaacctgacgatatgttgatagtttgaattgtagcagaattataggaaaactcagctgtaaacatggtataaattatttttttagtttatattattttgttctgtgcaagtagtgaagtaatcttcatggagaagaaatcacagggtctgcgtaacagattccatatggccagaagcatgtagtgagtccttaaatgggacaaagagatgaaattttaatgaaatgtacagtaatcattgggaccacattagttagctctttattattttgtgctgctgctttgaaatagcaggatgtggcacatttataatccctttctcttgagaatcagttactgtaaagttgaagatttaatttaaaaagcaagagaagctgttatggaattaaatatgtagatgtggctgatatgatctgtaaataactttattcacaaacacagtaccacctttttaattccatacatttaaatatatcctttcatatcttttaaatattaaatcattttgacaaacagcttacaaaacaaggtatcagtagtgatacttgagtgcttttttcttaaaatctctaaaattcaattaaaatgtaagttgaaagtatataggaatgtgaactgtaagttagagtgataaaaagtgaattatagaagatttttcttttaattacctgctcacctttctaagtctaattatatataaaagtaatgagaggaaattgtattctggtattatttagactttagtagataaaaaatagtgttcaaatccatctgcttctttttctgtccacttggttaaaatgtattctggcattctctgggcagacagccagttctaaaataaccacttctattgaaacagtttttgtgatgtctacataaactctgagattgcgacctccatttgttggacataataatctcagaggctttactttgatcctgtagtattcagtggcacaaaatagagaattcatttatttattttaagaggcttctaaataaatagaatactgtcgatctttaactcttaatgttgcctttgttttaaaacttagaaaaactcagaaaatcctttcct

SEQ ID NO: 71669 - DNA, 3229 bp, Homo sapiens
ggggtggttatattttttcattgattagaatactcattactttctaatacctctttttcatggtgtcttggtacctgagaagctaagctaggagtcagaaagttgctaggtgaacacaggatcagaggaatcagctctatctccggaagcttttactcaggttataagaaggcctgttagtgtattcacagtagtgaatttctgtgatacctctctctattatctagtgttgtgtttgacagttaatagcttctcgtcaccttgtacctcttgtaccttttttttttttttgccagaaaaatgtttattaagcacaagacactattcgtggagttaaataaaaggcatgttacttctatttaatgctcttctctgtttgttctcattattaatttaattctttgtaacatatagggtttataaataaaaatttcttttttttgaactttgaaaggtatattcatgtgactctttgtttcatacttctggtagtctatagtacacaagattagattggttcagtaggtgatggtgataggattgacacatgtggcttagctatctatgaaaataaagtgtttaggaaaattgcatgtggcgaatcactataaagtgttaaaatgatttttattttttttaaagctagcattttatcttcaatatttcaaatgtgaaaagtgctgtctagaaaatgtcattcctttgaataaacatcattaaataaacttgtttgttgattcatatagatttgtattaaatatagtccatcaattctaggcacaaaaggccatgttatagctattagcatgatcaatacatgtcaaaaggaaatgttagcaattaagcaataatgaaaaagtcaagaaaataaaaatctaggtgaagaaagactacactggaatatctgcatggcagtagcagtctttcttagggtagctaaacttaaatggctaccattggagaattatagttaggtctctccacagcactcatgtcctaatggagtatagtacacagaatatgatgaattgatttttttttgacacctcaaagtgatctccacataaaataaatacttgtaagtgatggcccttactgaacgaacaagatatttttaaagtataaatattgtggggaaacgttaaacctccaaatctgtaagtcaacatagctctaaagaggaaaaattaatgttacacagtatctactggcctgtcaattgttacatttttaaaaatagagcattgtatacttaatagactggcatcaaatcttttgtaccctgtattttttgatcaaacagttgtttaaactgcttgtattcgagggatgcttttcatttgtaaacataatattaatcttgccaacaattccataccctagtatctttttattgtaacaataaaatatattcttctctataaaacatttatgctctttgaagagtttcttttctgcctgaggtttctttttaatcaatttgtctatctctttatctttacaaactcatctttaatcttttgtttctttaaaacagtctggtttttaaagattttagttttgaacatcgaattttgtgatataaatttatggggtcatgtatgaagaattttgtcttcatacttgaagtcaaaggatgaaaaatttgatccctaaagagttcttttcacaatttttaaatttcaataaaataaagaatggtaggactgtgattgaaaaatgtgatactaaatttttctattgaatgatgcatatttatttttaaaatccttctctgtacttattcattcaacaaatatttattaagtgctcagtttgtgccagccactatagtaagcactgtggagtaaaaacaaacttggtctgtgcaatctttggatttaggttattggcagggtaggaggcaggtattaataaaataacacaaaactgcagtgaagacaagtatgattatgagcagtatggtgctgtatagataatatggtgatttgacttaataagaggccagaaaaatggtttgtttatttatttatttattaatgacagagtcttgctctgttgcccaggctggaatgcagcattgcaatcttggctcactgcagcctcagcgtcccgggctcaagtgattctcatgccttagcctcccgagtagttgggactacacgggccagcgcctggctaatttttgtatttttagtagagatggctgtattaggcaggattctcttagagggacagaacttctgcctgctttatacttgctggaagctgatgagattgtgcccaccagattaagggtggatctgctttccccagcccactgactcaaatgttaatctcttttggcaacacccacacagacacacccaggattaatactttgtgtccctctatccaatcaagttgacactcagtattagccatcacagtgaggttttaccatgttgcccaggctgttcttcacctcctggcctcaagtgattctcctgcctcagcttcccaaggtgctggaattacaggcatgagccactgcgcctgaccagaaaagtggtttacctgataaagtggcatttgaactgagatctgaaagtagaatatacttgaagtagatgaagagaggaatgacaatattttatagcagaaaggacagcagcccttggtggcaggaggcatgttgtattccaggaacgaaagaccaatgcagctgtagtggagagaatacctgagagcatgtgatcagatgaggcccacctgagggcagatagggctagactaggcatagtgtagccacaaaagggctttcagtcagtgataaggatttgggtctttatcttaaaaagacaaggagaatccatgttacatattttaagcaggaattgaaggtggggtcttgaggaaggtgagtggttgggcaacgagacaggaatggtgaaactctgttagtctacaatgtgcaaggtggcagaagtgcatgccaaaagtggacataggcaggccaggtgcggtggctcacgcctgtactcctagcactttgggaggctgaggcgggggggatcacgaggtaaggagatagagaccattcggctaacacagtgaaaccccatctctactaaaaatacaaaaagttagctgggcttggtggcgggcgcctatagtcctagctgcttgggaggctgaggtaggagaatggcgtgaactcgggaggcagaggttgcagtgagctaagatc

SEQ ID NO: 71670 - DNA, 2655 bp, Homo sapiens
taacggtgtaactatataatctctaatacattctttatattcagagtgtgcttaaaaagatgttagattaatttctcatgtcaaactgtcttgcagactctaagcagtcacaatattttagaagcgaatgaatattcagttcaattcagcaaaaatattttgtaattcccaatatttgctggatactgcttaagttgattaagacactgtcctttgtcaagaggctagtgggaggaaaataaagacagacctaattctttactgtgaggtgaagacaaggcaagtgggttgtaagaacagtgcagaagtatcacaggattagagtgttcattttgctactaacaaagatatattcatgttcttctgtttgtatgttggatacttttaacatgaatagggaaattgctgtttttcattttaaatgattatgcatagcttttcatagttatgcagttgaactaagctccaaaattgactttaattttcagaattgtctggtacatagctttgcagttcaattcaaagaagagtttgctccgcaagtccttaggactctggctcctccaaattatgaaaaaattggaattatttgccaaagagtacaaacagatttctgcaaattttcaatataaaaaatacttttaccagtctttggttgagtatcagagagtactctcatagctaaccatcatatacataatacatatctatggaactgatgctgaaaattctgtgacttctattaacaattgtatctgggaggctaggcgtggtgtaatctcagcactctttgggaggctgagacagtcaaattgagcccatgggttcgagagcagcctgggcaacatggtgaaacccagtctctaccaaaacaaacaaacaaacaaacaaacaagcaaacaaaaaagcggggtattgggatgtgcacctatagtcccagctacctgagaggctgacaggggagcatcacctgagcccgggagattgaggctgcagtgagccgtgattgtgccactgtacactccaacctgggcaacagagtgagattctgtcttttaaaaaaaaattgtttcttgggaattccaaagaaggaattgatattacagatttaagattgttgttactaaatacttttccttacactgacttttttctgagtatgacagtgaactcttttaatgtgttacctttttcctcataggtcagatttacctttttgtatgtttttaataacagctattcaggtagataatcattaatgaaagaggcctatcttaaaaacagttaagaatagtatgattaggtaccaagtaaataatatcaatgtaaagtgtaattttaaagttatataaatagcattattatttgagaaactttcatgtgaaatgactgagatttaaggcaaagtgatgtttcttggtttacttagggacagagaaaagtatttcattggggagacacagatgagtaatggtcaagatggacataaattatgtgaaatttgtttttacctaagaatatttctgagacagagactcaatgcctagctttggaaagattttgaattgctgtgatggtcttgaggattgcttctttacaagtggtattctgatttcttttgtataaagtttagacacagacaaaactaacttacgataatagaagtcaggatcatgtatacgcttactgtggagtagtgcctggggaggggtcatgagggaggtgacttagcgttctaggaagttgattttgtttcaagatttcggtgttggtgagtgggggaggggggtactcattacacaggtgtgttcactttgtgaaaattaattgaactgtacccttaacatacctgtacttttttgtatgtgtgtttttggatacttagataaaaatttacccaattaacaaaaatgcaatagaagctaatttaaccaagttattgcagtatttaagaatttgaggatgagggagtgtatatggaatggctatcttatactccaggcacataaacaaattcaagaaatttacctttttttttttttttttttttggctgagttctcgattctgcatatgtaccacaggtcagagccattgagttaactggttgcctccccttcctcccccttgctttttctcaattccttcatgtctttgtttcatctgttttctattttcctggcccactggcttctttctcttgatccataccattttggtccttcagctgaatttttttctttgcctttgctccttaaggctctatcatgtttccatttggttttcaaaattctccagagataacttttgttgttgcctctgcttatcctcaacccttggcaatctcacttttttccttgctaacctactgagactacagtcaaaggccctgtccaaggccagttcttagccttcatcaaattcagcttacattcttcatatcctcttgttgttcaccctttttctttgctactcttctgtttctctgccttttactgttcttttttgatgatgatgatgatgatgatgatgggagcttatatttattgagccttagtgtaagtcagacactgttatatgtactttacatgtgagccttagtttctataatgttttacatgtgggttacatgaagacaaaatgacttaattcaaca

SEQ ID NO: 71671 - DNA, 4258 bp, Homo sapiens
tctccagaaaatgatgctgagtggaaagtaaaatctcaaaggttatatagtgtatgattccatttatgtaacgttcttgaaatgacaaagatacagcaaaattagtagttgtcggggtttaggaggggtggaagtgggaggaaagttggtgaaactataaaaggggaacatgaggcatccttgtgatggaaatagtctgtatcttgaccatatcagtgtcaatatgctggttgtgatgttgtactacggttttggaagagttagcattgggaaaactgggttaagggtacactgaatcttttggtattatttctgacagttgcatgtgaatctctgactatctcacacaaactaaaacttaattgaaaattaatgtaagtgaattacttttccccttactagctagggactcatttgccgttttacctagcttgttggcatttgtatatattgctgggtatataaaatttgaactgagatcactctgtttctgtgactgttttcattctttgtaagttgttgaaaattgaggatcttcaatgtatcctttaattttggtgtagatttctttccctgtacttttttacatgaatacttatgctcaaactattcaaaaacatggttttagaaatgtaaaattggttttgttagccataatatagttaacttattcctttatgtttataatttcttttcaggattaataatagcagctgtgacatgacagtgatttttttttttaataatttgttaattatgttatgtaaaatgtaatactggtgaggagccagtaatgttgcacagattatcgtagtcctgaaaaaccacaaataaatccaatgaatgagtgagaaaagtgacactgttgttggcactctgaaattctgcagggacttacattgtggctaaaatcaaccctaccttcttgctgtgttcaagaggcttttcactgatttctgttgacaggaaaagcctttttttttttttttaacttataaaagaaaaagaaaaaaagcagtaccctccaggccctgtgtattattaagatcttttagtagcgagttgctctttctctgggaaatcggctgttaaagtcagagggagctcttaatagtttgcatggtatttgattaaatggaacagttggatcagtacagattccagatttaatagagcagatactcacttctatacatcccctatgattagcatagttatatcttctatattatagaaatataattttaggatatactcttgtacattataaaataagcatgttagagaaaacctgataaattgaacttttgcagagaaagacttaaaagcatatgactaaaatataacttctacataaaacaatatgtgtccagcattgtgggatagtttatagttctgaggtgatctattaaaccatgatactggaagaaatgacaatgatagacactgacataggagcattatttgtgtgtcaggctttgtttaaagcactttttatgtatgaactcattttatcattactgtgaggtagggactatactatgatttcctgctgattgacaggaaactgaagcatggagaggtcaagtagtctctcaaaccaaagaacacgtaagtgagagaggaggggctctggctccatagtccttggtcttaaccactattttgtattgacttccatagagaaaatagcccacattatagctatgataaaatgcaaaatttcactttataggtaatagcctggaatcggtgagctggagtcattaaggcagttcggcaaaaacaaaaaacatgggggcaagtgtgggtaggaaagtgctagctgcctgagtacaaagcattgggtattaataaacatgctgtgtgcggcatagcaggaagcagctgtttggagttgaaggtttgtttgggagagcagtagaaaagatgggtttgattagttatagaaagaattttgaatggaaaagtgtggacttgggaacacattttctaggttgctgttgagaggaacaacagtggtacattaaatatggacttttagaactagaggaaattataaaagttattattggatctgtgctcttcagtgtttctgtgtctaccctgttttgtgttttaggttttgaccttttgctccagcttgtccagggacagagtggtgtagtgaaacaaaagcagtaaaccaagtatcacaaagcttggactttagtaccagcttttgcactttcctcactgtaaagatgttgtatgggttacttaaccagttggggtttaatttccttggctgtatagtggacttagtgtcacatgcctacctcaggatttctgtgacaattaaatatgatattttaaggcttctaacttactggatctaaataaattattcctggaaaaaaaaagtttgctgtgtaataaagcacctaaacaggaatgaaaaagcaggtatagaacttcaggtgttttgtcaccctccctcccccagtggtgtgtgtaggaaaactttgcttctttctgtaaatctgatgtctaatctcttctgactttacgttcaatcagttgattattttcattcagcagatgtgatcggtttgcagggttctcagtcaagtaggatagagaaaacatgaagatacacaactaaataaaatgctatatataaaatgatgttttatgcaataattatagctatgctatgttaattcagcaattattgctgctttggggaaatgagaaggctttgaggaggaggtagtatttcaaaatgatgaggtttgaaagaagtatatgatgaaatgcagaaacgaagaggtagcgtatttgtttcaggagaagggaatagaatgaataaaagcatagagaaagaaaagcatatgatgggctgggcccgtggctcacgcctgtaatcccagcactttgggaggccgaagtgggcagatcatgaggtcaggagttcgagaccagcctgagcaacatggtgaagccctgagtctaccaaaaatacaaacaaattagctgggcatggtggtgcatgcttgtaatcccagctactcaggaggctgaggcaggagaattgcttgaagggaggcggaagttgcagtgagcctagattgcgccactgcactccagcctgggtgacagagcgagactcttatctcgaaaagaaaagaaaagaaaagaaaagaaaagaaaagaaaagaaaagaaaagaaaagaaaagcatgtgatgaaaaaaattgatatttttctaagaaattaaatgtgccgtatcaggaaatagatcaataaggtgaaatgagaccagattaccgagggctttgagtagtatgctaaggaattttggattctgcatgttgttaatgtcatggtcagcagtcctgttgattttcgtcaggtattacctaatagcagttatagtcttacaaagatcttttagagtcttgtaaaattttgtgttggaaattatacttcaagaatgaattcgtgtcctctctcctctgaaatgtagactaaaaaaaaaaaagaatgaacttgtgttatagtgatcaagtaggtcttgttattcgtattctaattagtatatatttttaaaaataagaaaggtgtttctttttggttttcttttggttatccaataatattgctttctactgaccactttgtaggtgagtaaagattttgtggtctttcaaaccttgattaaataaatcctgatttttactagttacgaatttttatcaaatgaggcgctttgagaataaagatgtttgttaaaatttcttggtgtacatcttggatataatatatgtggtttgctgtctgttgctgtatgaaacaaacattttagatgcctggattttcttagaatgtctatgattcattaacacagacacttcctgtgaatatatttctaaatgtattcttttgaaacccaaacactggatccttgtgaaaaattccaccaccatgcacaatactatttccaacaggcataggtcataaatatttggtagtgattgtcaaataagccataacctatattgaaactttaatagaaatgacttttggttctcttgtaaaactgagaatgccaattcaagtgataaatagttaatggtttttagatatgtgatttaaatcaaaataatggcttttattgattttttaaaatttattttagtggggtgaatatttgacatcagaaaagtagttcaaacctgcaacttagagatctggtataattgacatctccgtagact

SEQ ID NO: 71672 - DNA, 1033 bp, Homo sapiens
gtctcagcatcccgagtagctgggactacaggcacgcaccaccacgcccgactaatttttgtatttttagtagagatggggtttcaccatattgctcaggctggtctcgaacttctgacctcaggtgatccacccgccttggcctcccacggtgctgggattacaggtatgagccactgtgtgcagccccagtcctcaaggtaagcaacagaagcatcccaggataggaaagtctcatactttgattgacaaggtcaaattgtatcgttttcacatgtttttaaaaaagtacttgtacatcacaatttatactgtaattaaaacaagtaaacctttaaaagcatgaaatgcaaaggagtacttagttttgattaattgatttaacaaaaagtatgagattgtttgacaggttgcctaaatggtaatgttttggattgcttcctgaaaaaaatagggcttgaagctgttgatgtaaggcatatgttgcataataaggaggaatgtgttttaattcagatttgatgtagtgagcaatttttctgtattcacaagttccatacttaacaaaaatgaacctacttgaaaactatttcaaagcaataattcattaatttcctttgcaaattttgagaaggtcatgttcaaacatcaaacataataatccataacaatccatcaaacacaataatccattgatgattatcaaacataatcatccattcatgattttaaaaactctcagaaaaattgtagtgggagaacttgataaacttgtatctgtaaaacttgagaaagagcatctacaaaaatcctatagctaagattattcttaatggtgaaaaactgaataattttcttcctaagatcaggaacaggacaagaatgtccactcttgccatttttattcaatataataccaaagttctagccagtgcagtaaggcataaaaaagaaataaaagacatacagatcagaaagaaagaaaactgtcccagtttccagataacatgactgtttacatggaagatcccaa

SEQ ID NO: 71673 - DNA, 1013 bp, Homo sapiens
gagataggaaatattctgattgagtaaacttatttaggttctggtaaagttttgtaaattgctgaaaggctggaaagttaattggagctttttaatagtgaaattgaactttgttaatgtctttttgctaactactttgatcagctttaatctttgactagcttctcattgagttcattcataaaggtatttcttaggagactgatgtacagtgatcggtttacttgtgagttacattctttggactggatgtgattcttgattgtgactcctactattcccatgatgatttcctttctctagagaagcagatatgtggttttcatttctttgtgctttttcctttgattttggggactctgattattagtaattagaaattcttacctttttttttaaacaaaaatagcgaggtattagtgattattaggagttttttttttctgagagatttctactttacactaaatcttcatcttgaccagatttgacaatgcatttagataaactacttgagaatttttttggaaataccgaaaaataattagatgactcacatttcaagtacttctaaaacagtaagttaatatgtagacctattctcagttgatatttgtgcttgagtttaaagtttagatgttttgttcctaagacaaagcatggacaatatagtacttctattacattgaaaaatatttttgattatttctaaaataaataagcttcaggttaaaaacttaaaattattaaagacaggattttgctttgttgtccaagctgtagtgcagtggcatgatcgtagctcactgcagttgcaaactcctgggctcaagccatcctcccacttcagcctcccaagcagctgtgactacaggagtgagctaccatgcctgcctaatttttgttttttttgttgttgttgtttctttttgagaaggcgtcttgctctgttgcccaggctggagtgcagtggcatgatctcggctcactgcgaacctccgcctccccagttc

SEQ ID NO: 71674 - DNA, 1050 bp, Homo sapiens
tacaaaagaaatggattgctgggtgataaatgccaatttaaaatgttacactactttgattaaaaaatcataaagagttgctttctaattttcatgatttttagctagcagctggtgagtaactgctttttttttttcctttttttctttttttgagacggagtttcactcttattgcccaggctggagtgcaatggcacaatctctgctcaccacaacctccgaatcctgggttcaatgattctcctgcctcagcctcccgagtagctgaaattataggcatgcgccaccatgtccggctaattttgtatttttagtagagatggagtttctccatgttggtcaggctggtcttgaactcctgacctcaggtgatccgcccgcctcggcctcccaaaatgctgggattacaggggtgagccaccacgcctggccaagtaactgcttttgaagcagttggagctcccatttgtgtcccagaagaacatcttactgatgaaaataaagtagtggttgtgctaaatgactgaagaatggacaacgagataaagcagagaacagagatagagttccttatggcagtgggccagagtcctactgacatgtacagataactaaagaaagcgtgtgctgtgtatcttgtgctgtcagatagatgctgactgaaccgtgctagttagggagaccagcccttcagccgagtacacggtttcatctttgcagttaggctgcaggactgctgctgtattttcatccaccggagcttaatataattttaaggattatgtgggtggaggcttagactaaagtaaagtgagtgtgctgtttatcaccagcaaagagtatgctttgtcttgagagagagacactgaactgatgttctgtcttattgtttgtgttttcagacttaatatggttactgttcaaactactatatatctttgaaagattcccattgatatgtattcccatcaaaaagaattactaagtatataactagatataaatgccttcaaattttgaagacatgtctgtctaatgctaaaatta

SEQ ID NO: 71675 - DNA, 1414 bp, Homo sapiens
ggtgttaaggcagatagatttctttatttcttgaggggtggagattagattttgatactggaccaaaaaatgatttttcctgatataggtttgaattaaaaaaaaaaagtagcatttaaaaagtatggattcctggtcttaaaatttgatgactgtttaaccaaatgggaactgtttttctgaaagtgctttagggcaatcagtgctaatgcttttacatgcttactgaaagtagaaacctaggcatttgatcagagtattttctaagagatagaaaatgtttaaaagtcagatgataagcttgcataagcctcaagggtgacacaatttagtattcctaaataaggacttagtgtttcttgcagatgaggatattgcaataggaagctatttgacataaaaataaagtgtgcgtgaagtgtgctgtatcacttttgtgtaaactctctttttgattttcttaagcagaaatggctgagattgggtttacatagtctcttaaaatcaaagcttgctttactgcatagaataaaatgtgtttctctgactgactagtactgtataaaatagcctacctctctcatgcaaaaactgatattggacagaagatggaagagacaagataaaaaaaatgggaccagaatggaaagggaatcacagaggtggctagtattagattcccagagcaaggagaaagaacaagcaaataagaacatggtaactttttctctaaatgggtcagatagtaacctctactttatagtccctaatcagtgtgcccacctgtagacatagaaactttagtggttcctaggggcagagagggtgggaatcaggccttaaagagaggcagcaggagacattaactttgtgtaattgtactctgatgtactaagacttaatgacttaggttccttagcatctatatctttttccaaagctgcagctgtaattcattttactatttctcctaaagagtgtccattcagtgttattattattcatcaaataggttttgcatgcttactatgtggagggcaagtcataagatctgtaagaggaatttcttggatccctttctttatggcgctcttagtctaggggaggtgttagaggcaggatgatggacactaagaaagatgtaattataaaactgttaagttatggcaacattaactgatagtcaggatgcagtgcttcccaggagaaacactgtgctcctttgaccccatgagtggagttgtcagagaagtctcagtgaagaggcacatctaaacttctgtagggggtcagagaagagacagcaatttattcagtttgggattgatgaaagtattgcaaatgtaggcggcactactgcctttacagaagagttagatttcaccaggaaagaaggaaggaaaaggtactctaa

SEQ ID NO: 71676 - DNA, 1981 bp, Homo sapiens
tttgtaaaactttgtgatttctcttgtattcttcatttgccagattttcttacatttttgagattcttctaactttgcattttctcctaagccttttgtgagaagcagtttttaatttttctgaagccttattgaatagaaagacttgagtgaatctgtggggagacgctgaccgtgaagaaccccagaggctgtcaggggaagaaggttaagggttggtggattttagagagaggggagttccttgtgcatcacagccacaggagatttaaaaatgcgtaagccgaggcatggggcaatgaagtaacttgctcagtgtcatacagcttggtggtgatgcagttagaattgcaattctaactgatctctaataaggctgtgctttttcaaccatttccattgtactctcttgcctctaactgttgtctggatagctataatatttgagtagatacagtgttatatttctcaagttgatgacatttcatccttaaattcaagacttaggtcctataaattggtgtttttctttatcttttaaaaaatcttaagctctgtaaaatgattctgctttgaacgaagggtacttatatctgccaaaatcattattgagcttctctagtcatttattttcttgaaattgaaatgaaactttctgaacacagccttactgaatatggatttcagagccataataatgcttcttgcctctgcagattctgaattgatctgagtttggcagtgaattatgtatgtgttatttcaggaattttgcacatgccctgctttaaaccactgattatttttgtaaaatgctgttgtgtggatttggctcattccattgacgctgaactcatcagatggctatattgtcttctaggaatgtgacttgaattgattaaatggcataggcagcaacatctgttttgtaaagctagtttagtttcctaaaactttaaattttcaaatttacagcttacaaagagaatgaagcatatttctttaatgccataaaaagactttcatggagttttgatgatagcttgttttaaccttgcccttaacctaattctttttagaacttattttcttactgtattatattgctcattttcaagaaaaagacatatttgtaatgttggaaactttatagtcttatatggatggctcttaggtttttcagatcattcatccatttgaagacctgcagaaagctttggatggtctcctagaaaaaaaagcacccatacacgtgctcctaaaactctgtacaattgtgggaggtaaagctcacctgtacagatccccctgaagcctcctgcctccttgatgtcctttgcttcacatgtgttattaaatgcattaataatgctgctgactgtgcacataagttacctttctttatacacagcttatagatttgttgaatatttggatcaccatttttaaaaatcaaatgttttatgatgttgatctacatgtgtcatttttatttctcggggttaatgtctatttttattctttttctctcatccttgtaatttcttttttagttaaggaaatgtatccatctcagggtttcttcatttattattacaacccttatttggatggacttaatgaccaaaatttatatggtattacagtacataggcttacctgatctaatcttgtagaagacttttcttgtatacttcttcgtgtaacattttcaaataatattttcaatttgggatagaggactttaaagaaagttaagacttgggtaaagatagatactctcatatgacaacccatgggggctttttaaaattatactagtggatgtgtatttttatattcagttgatcctagtctttgtacagtcagttttcttttacaatctggaattttgcccatggtttcaaggccagcatgggtatttactaagtaatcttgaggatgactgttcttcttttgtaacctgctctctccagatctg

SEQ ID NO: 71677 - DNA, 1325 bp, Homo sapiens
gtgagggaaggaatcttctaataagaacttatgtctttggtcccaagtagctgatgagaagaggactagttctgtttgagtctcattgagtgtaaaaaagctaggaaaaacgttaaaaaaaacacgacttgaaaaaaatttgtattacagcacctctttttgaagtgccatctcatttatcgtgtattgttggaatacatagttaactggtgttttgaagtgcttttgccatcagagctcctagagcaaatggataaggataaaatctgacttctctttctctttaataggcaccgtttttgttcaccattttctgagttctggttaggatttggcgacagtatgaagatgaatttgtgtgtcccagaaggcaagccacatgagtagttgagtaagtaggaggccatgtacagttggaagaaagggtttatggtgttctaggtagccaccagaggagacagcaaagaagcagtatttgtcccagctgtgatcaccactgacactacactgctgctttttcttggcagcgatattattcttcttttatattagccattttataaattctgaaagggaacacatcttattctttgccaattctgaaaactctggccaggttagcttaagaaaataagataataataatacctaagtatctctatatctacagatagggatctacagacaagacaaggtaggtttaggataaagggcaggagccaggtctagggaaaacagtgggtcagaacaagataggggtagaccaaaggaggacacatataatggagagtgagatcaagaatgaccagatagcaactagaggaacttatagtggggaatgagacaaggcattatattaaaagtcatgacagcaaacaccagaacacatactagaagaaaggcagttggtgaaaggtttataatttaggaattagaacatccatctacgctgaaaaataggattgttgtaagaattgccatgaactgcctacagcatgggtactgagacagcaagcagtcttttgctagccaggaaagttcttacaagttcttcctgcgtagtagctactcctagctgatagcagtcatggaatacagcaattcagtttacgtctggcagctcctgactcctgagcagctggtctgaatcactggagttttatggaaggctaggttctgataaattttgttctctctcaaagtagaaagattgatagattatggtccgtaatctagaattttgttctctctcaaaagtagaaagaaaattttgttctctctcaaagtagaaagattgctagattgtggttcatgtgcagaaactt

SEQ ID NO: 71678 - DNA, 1507 bp, Homo sapiens
ctttcttcctttttgatatggtggcgagtttattcattgtggttggaaactagttttgttcctttttgcaggcttttcaagttgatagcttcaggtggtaaaccatgagagtgcttttcagtgtctcctggtgagctttcatttataaatgctgctccactttcattagctttatttagaagtttctttattcattatcataccagtttactacttacattttccctaaactcaggcagccttattttggcacgtttctgcttgcgtgctaaaataagagtgatagattaattgtaccagttttggattttggaattctttattgcttttgtgtagtatatttgtaggattaatgttaggtgctgtacagatcataatgcattttccccgaaggcatgtggttggattttagggctctctgataccactatagaaatatatatatatatatatatatatatatatataggttacgttctgcggttgcttttgggctggttttttttctttcaagttttagggaggtgttaaacagaatgcttatgagataccatatgtattccacgaaataaagcgattcattcaacaaacatttattaaatgctctcagaggtttgagagaagtaacaatattatgcataccatttgcttagtggtttttctgatttcctttaagaatgtaattgtggcaacgtttcaaagcagttgacttttcttgaatgtagctgcagatccagacgtatagtccagttgatactccgtcctgcaatgatttcactgaagattcagatcctctgaatatagtttagagaatatctgtgtactgttgtagtgattagaaatcatttcagggtgcctctgctaactgagtataaccattaagacttttctgcctgcccctttcccacaatgttttatctcttgtcatatgtaagttgcagtgggaagggagggcagctgaattggtcttgaattgttttcccttaaatgggcttagtctagtttgtgggaattgactgcccaaaacattagaaaaatttaagggagaaatggttaactttcttagaacttttagaagaatatttcaagaggaagcccaattttggttaagccatggttaaatcttgaatcctaacttatgctaggttaggaccgcttggaagaatagggtaagacagagcagaataggaccacttggaagtcttctgggctttaccaaagtttgagggctctgtatcatttgagaaagtgtcatcttggtttatttttgccttgggacttccaagtatttctgaaacagatctcactgtggtagagggttgggctctaatagttatctgaccactccctcagcatttggtaggaagcaataaagaataataaggaaaatacttaggaaggaaagcatagaagaggacagatgggttagaatatgtaaactgagtgaagagccatgattttcacggcattgcttcagagaagtgtggaatggtaatggttactgggt

SEQ ID NO: 71679 - DNA, 1546 bp, Homo sapiens
gaaaccctgtctctactaaaaatacaaaattagccaggcatggtggcgcatgcctgttgcaatcccagctacttgggaggctgaggcaggagaatcgcttgaacctggaggcagaggttgcagtgagctgagattgcgccattgcactccagcctgggcaacaagagcaaaactccgtctcagaaaacaaacaaacaaacaaaaacaaacttttgcactccagaagaaacttgcaaataattttagtagtattattttttacttcaaaacatttgcccctccatgcttgcttttgtctttgatttgcaagcagtttattgcagctgggagatccctccttccttcttgttttccctccctcccctctttcttgtccaccttgtctgcccactccttcccattccctccctccctccctgtgaaagggaattggtggagaaggaaaccttggtttattggaagagtgtgggagatgaagtttaaattgtagaagttcatcaagccgtgcaaattgggagcagtaggctttatgcttcgtttataagtggcttttcttcgcgcataagactttttagatgctagtattgagactgtaattgacagtagtagttttttttctttttaggctagccatctgattgcatagcagcatcacagaagatagtctgcctgatctaatggcagcatgtcaaggagttaccttgagcattaactctccactttctttttagtttcaaaagatgattaatatatgttgtaattctctctgtgtcatttctgttgtagttttgttgtcagtaaggactatgtatatttaggaatcacttgagattcccgatagtattttaagcctgttgttttatatcatttgattattaagggtgaacttatttgattttgttttctatacatgtgttttactcagaatgtaggttaaagttttgttgttttgttatgtgagctgcaggagattaacttttaataccgtgttaggttggagaagcatattttatttaacttgctccatatgtgctgtatttatggaataattttaactatctgtaattgtttgggcttaaaaaaaccttcctagtagaagggggttgtttataagatagtgtcatagtatactcagctgaaaataaaattgtgggattgaattctctgatgctcagaagatttattgatttcatgtgagagaggctgttattcttgagttacttttattcaaacaggaaaataataatactatcaacccttaccatttatgaaaattaacttaattatcatttttaatagttaacaacttaatctcatgggtttgtttctaagaggatattatacactaacttaaaattttaattacaaaggtatacagtgaaactgtgactttaagtgaaatgacatatagcaggttcttgaataacgtcctttccttcaatgttctgttgtaacatggatgaggaaaaaaacctgattttgttatatgttatttcacttttgcagttttcaaaaacctatcaacagtattaagtgaggacttact

SEQ ID NO: 71680 - DNA, 1049 bp, Homo sapiens
ctgagcaaatggaaattaaaacttgatatactcagctataagtatcattgggcctaaggttaaaaaaaaaaaaccttaatggtagaaataacacgtaaatatttttttcctcttaaaaaacccagatagtgtaggcatctgtggtgtttttttttttttttttgagatggagtctcactctgttgcccaggctggagtatggtggtgcagtctctgctcactgcaacctccacgtccggagttcgagcagttcccctgcctcagcctcccaagtagctgggattaaaggtgtgtgccaccacacctggctagtttttgtatttttagtagagatggggtttcaccatgttggccaggctggtctcaaacttctgacctcaagtgatctgccctcctgggcctcccaaagcgctgggattataggcgtgagccgccactcctggccgaaatctgttttaagtatagaacatcatgaaattggattctgttgctttaagcatttcatgactgagctgctgtctggatgctacctgaagagattctcattgaatatcattatggccagtaagtgttccataattttctttaagctccatctatgtaaatatttttgaacaattttgcacaagtacagggccacatacctatttgttataaacccgacgttgataaaatgcactcttagtataattgggtcttgttttgatcctggcagtttcatattgggatttggcagtgagttcaacagaataagcattatcctcttgaggcccatctaggattgaactaaagggcttctacaatatccacatgatcatacaattagttctctctctccctctcttttttttgtgctgtgatagtgtaactgaatatgagctggttgccagggtattgtggtagaataataccctgcagtaaacagttaatcatgcagcagaactggcttgatttaaaaaaaaaaaaaaaaaagataaaaattagataaagatgaagtggctttgtgttgaaaaagattgtatgtatatgatggtaaaaggaaggttaga

SEQ ID NO: 71681 - DNA, 1313 bp, Homo sapiens
tattgttgttgagacggagtctcactttgtcacccaggctggagtgcagtggtgtgatcttggctcatggcagcctctgcctcgctggttcaagcgattctcctgcctcagcctcccgagtagctaggactatagatgctcgccaccatgcccagctaattttttgtattttttttgagtagggctgcatgttggccaggctggtcttgaactcctgacctcaagtgatgctcctgccttggcctcccaaagtgctgggattacaggtgtgagccaccacgcccagctactttacctttcatatttgtcattattttgtggataataatgaagaatacatttgtatttcatgagaaacaagtactttcaggaaaaacacatatccagtgataaatggcagctaggtctaagtagtttataaagtatacttttatttttcttggatctgaattattcaagttttgatgtaaatttcctgattctttaaataattacattactgttctgtttttctgttttatttgaaagaatgagtttgccaaagctataaagtagtaagtttttcattgggtgattatctgaatgggtctagtgcatacttactaaatattagacttaatgtgtaattatatacttgaaaggaaaaataacatacttattaagactgataaataatacattcatattgtaaaattatggtaagatcataatctcagttctttcagatgaagaattgaaaaagatctagtgaattagataaaattattaaggtaaatatgcttgaaattgagagaacaagctaaagtctatcttttgagtgtaagtaaaatcgatgtgttaccacaggcaacttactgaaccatgtaattagtttttttctatgaaaaatgagacatactgagattgtgttaaagtagcatgtaaagggcttatgttctaatgatatgaaaattaaagaattggtaaaaaaaagttataattttcagtttgttggtaagtatagttattatggcctaatgttttgcgttgatatgaaatcacctacttatataaagtaaacctgagtaaaatcctcttaaatgagatgttagagtcaccattggaacaaatagtgttgaaaattgtcttaacactagattaactgttatttggtatattgttttttaaaatgtgagtaatttttatgattaatacattgtgactggtagataagtgtttagtctaacatttttaagtgtagccatgtttgatgcccccctcaccatttgtgtatattttatttcaaaagcttgtactttcatagaaaactttaa

SEQ ID NO: 71682 - DNA, 2106 bp, Homo sapiens
atcttacttgatttctaaatataatttgtgagttgaatattgaatgataacatagaaaatagttttctgcatagagactttatagtaagtgtttagacaaattaaattattcaacaggaaataatgattatcagcttgttttattttagtatttaatgtaaagagctatgtagaaatcttgatagaaagtttctcccaccttaaaattcgagaagattgacatacattcttcactgggaggaatcttatgatatgaagtttcgtgtaaatatttattttagcacaattgcttttctgtatggaagactgtttttagtggtctgtaagtaaaatgagaaaacgattacaattttttgtctttttccaggctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcagggtaaggtttctgtttttttcttaaaaattatttgcatcatatttttttgaacattgataaatttcaaacagattattaagacttgtctaaaagaacgatcttaagtgtttcatggatgtctctctcaaaaggaacattctcacccctcttcctcccatccctgtttttttttcctaactcttgtccttttccagttatgctgagaatcagaaccttgtgaaccgctgctgttaaatgagagtattgtgtctcctgggtgcggtggggtggaaaccaggctaagatccactgtttttaaatgatagtgaattgtgagtaactaacaagacagtgaattgaacagttactgtttttttccttggactgtggttgttatggttcactgccagctgaactctttggtggaaaattggagagtgatacagaaatttagttttgagcctaattggacaaaattgtgagattacattgaatagtattttgaggaaagatgaatatatgggatctggtctgaattgggtgtagcaaattttcttttgcttttatttctgtttttcatgtaatttggtgattccaggaaacattggctccggtgttgcctgatttttagcttcagattgcatctgatatctggaaactgaattaatgtaagagtttcatttttctgtgctgctttatatatttaccacagttttatgagcaggaacttttatcagttgtctttgaatttctggtaaaaatttttacctttttatctaagtgtttctatttagtatgcaaagggattttctcaagcaagactaattctaatctttagttagggtattaactctttttgacttagtctcttagaaccatcttttattatctccaaactatattgtgttaatctgtgtctgaaaaatttcagatcgtgtttgaaatgttttgttacttgatgtttttaatgttttttttttttaaaggaaggagtaaaactaactgtaatgtatgttcgaggctctgttctaaagcttttacatttgcctgaaggatttcctgccaacttttgcttgacaccttgctagtttttcttggcagccattttttatctgtgatatctcctgccacagcagccagagggcggtaaaccacaatggactaattgaactgtttactttatggtccatttgtctgttcagctcaaacctttatcctgatattttttagggtatttggtctataaataagagaaccattgtgggtgacattgcttgcttagctgggtaatcagcaaagtcccagaacttaacattcatctcaaagcctgttctatgtagttagcagttaacttaggtaaaattagagtttcagaacatctggattctgtttatcagaattttaaaaataagatgtcacctagaagataattacaacatttttgtttgtccattaaaatatgaaaacatatttttactttttttccctatgtagtagagaggtataaagctttttaaaaagt

SEQ ID NO: 71683 - DNA, 2519 bp, Homo sapiens
gtgatccttctgctgtgggcctgccaaagtgttggaattacaggcgtgagccactgcacccagctgagcgccttttaagcaggcttttaaccagttgttcttatttaatctcctctctgcctttcaaccctacttccaaaatacctgtatttaattcctgaggctgaggggattctgtgtcaattgggttgtatctctttcttcatgtttaggattcagttttcttacgtattgtaaatctccttatcagagcatctgcttcttagccttcaaaattttgatgctatatcctctcttgttccacctgccgttgtaattatataatttaatgaaataaaacaatgaaacaaatgtttttcttgatgtcttacaggggtttaggagagagcaaaagcagatgtgtatgtttattttgctgtctttacagggagttgattagttatgttttaacagaagttttctattacatgtgacttttttccttcctctgagttgagaggtgacttaatatgtttactgtattaacctactctactgcagtggtaaccctatcattggaggaagtgaggtgaggccgacttggaatttcctaatgcatgcttgtcagcctcaaatgatcacagctgccttttctatacaccagcctagaatcctgcccaggatggatacgttaaactaattggtttgtacttctgaggactctttcaatagtttcctgaaatgttgactatcttctggcagcttttctgttcttgatgggtaataagggttccatctcatttacaagttgcttttatgagtgggatgtaattagcctgggccaggagacttgaactgatttatagtatctaggtcaaccctatcactttataggtcctgaatctgaggtgccttgaggtacagtggatttcctaacatcacataggtaaatggttgaaaaaccaggccttaggacctagacctcctaatttccagccagtgttctttccatgatactacaccatgggttcattctaatcaacgtctcttgattttactgtgttccttgaccactgaatgtggttttaactctgaggagccatattgcaagtatgtgctgttggtcacaagggatctagttgctgtgggtcactgcaaataaataatctcatttcctgtatattgtatgtgaagaataggacactaggaatcaatataaattttctttgaatcacattcatgtcagttaggaagtgcatttatccctgttttgttgtaatctatttaattagaactgtttggaactgactgtagtagctgtttgtttaggccaggggagtatctgccacttaacccatttatgcctaatgttccattattggaacactaaacttgtgggagttatttatatcctactgctcaaggtcattgccaaggtctgatttttcacaaaaaaatttgcatcctcctgcataaatgggttaagttcaattttctgagaaccctgactacccctataccacatgccagccattgctgagcagattttcttccagcctgtcttgctatcagaatagtgattttgttggttcgttgtacatattatctaagaattagtttatgtagataccatcttatagtgataacatgtaaaagaaggcatataattatctgagtgaaataaaagtctattcatgggatgatacgtgggcactcttataccagttttcttaatacctcaggaagactaaagaaagatttatgaactttcttaaattagaaagtatggccatgagctctagtcattgctaaattgagttgatgacagtttctttgtactattttataatcctctagggctaatttttaccatttgccttatgaagcagcatggcagaatggaaagaatttatactttaaattcagttacagcttaaatctagttatatttgggatctgccatttgctacctgtgtggctctgggagaattattcaacctttctgagtcctaatttctttagctgtctgttgtgaagtttataaattatatatgaagtcactagtatggtgctcggtattagaaataatatatgaaaactctagtatggtgcctggtagtaagtagatgcttggtaaataatgatgttggtggttattatacataatgtgcatataggtttccttctttgtatattttaatttcatcgttttggttctatattttagaaaccatgtagtttaaaacttagatttaattaaggattgtctttttgacagtgagaaataattgtgtttggggataattttgaatctataattattttaaaggtttgctttaaaattttgaaatcattaggtaaagaattttgtgttgtagagataaacgttagtcagaaattgagacagtatggctgggcacaatggctcacgcctgtaatcccagcactttgggaggccaaggcaagcgtatcacctgaggtcaggagttcgagcccagcctggccaacatggtgaaaccctgtctctactaaaaatagaa

SEQ ID NO: 71684 - DNA, 1096 bp, Homo sapiens
ctgtttttctgggaaattgttatgaattgttttgttggtcatttcctctttattttctgtattttctctttctgaaagctcttgtatttggatttcagcttcctcgtatttggattttcagctttcccccattttccatttttgtttatttgtttcactttctgggagatttcctaaactttatcttctaaacattttactaagttttatcatttctggaatcattatttaaaaatttccaagagcttttaaaaaattctctcctgaaatagcatcctgttgtttttaaatggttgcaccattttattttgttgagaatattcttggtgtttttaaagttttcttctcccaatgttgtcttcccttctagctgctttttcatttgtttttgtttctgtaattcctcagtggttttccttaattatttagcaattcttggttgtatgttcatgtttaggaatggtggactaagaatctgcttggaatttctgagcatgtgaccgacatttgcttaactgtgcgcctcactgatctgggtgggctctttagttggggaacctctctctgatctcagtatcttgaggtcttttctgtggagctaagatttctcagagaagacttttccaaattcctttctgagggatgaagactggctgctagttttctgggtgcttagagggcagtggtagggagggggtggtccttggccttcattctatatatttcaccaaatgccctgttttcactctggttccgtgccttcagtttgcctgtgtcctgcagtccaggtaccctctgtttactgtctccagagaatacatttgcatttatttgctggggtgaagaagggacagtagttcagctttgtgcagtagagaaggtacctgggcatctgagtgccttcttattttattttcttttcttttaattttattttgtgattgggtctcactctgttgcccaggctggagtacagtggtgtgatcacagctcactgcagcctcagcctcccaggctcaagagacccgctcactttagcgtccctagtagctgggactacaggcaagcagcgccatgcttggcttattttttaatt

SEQ ID NO: 71685 - DNA, 1052 bp, Homo sapiens
cctgatactgtgctgactgcagaagtcactttggcttgtttattatgttttgttttacaaattatttgtttttcagcttggatagttaatatcgtatgttttaaagccctgacttttttttttttttttttttttttttgggtaggtacttaatctgctgttaaacccacagcgaatttttcattttatattttgcatatttgagctgtggaaattttacttagttaaaaaaatcccccatttctgtccttatgtttgtgtttttctttaaattcttgaccatatttataatagctgctttaattggcttgtctgttaatttcatcattactttcatttctgggtctgtttctgttaagtgacttttcttacagtcatgagtcccatttttctactttttgaatgtctggtattttttattggttgctggacattgtgagtgttgttgaaagtctggattttatttccttcctttaaagagttgaattttgtattggctggtagttaagttactggcagttaataagatcagcctattattattagcatactttttttctgaggcttgattattagcttgggttagaatagactttatgctagcactggtttcctccttatgaggtatggtcattttatgggcattattcagtgcccaaggtgtttaacagtgttttttctctctggctgttcagaacttgactgcctcccagctttaggtgaactcttggagtgatagctcccagtagttctctgcctgaccttgttgaattttactgtttgaatgtgcagcctagtacttaggaacagtttcaaaagagcctctatcagatctttggagcttttttcctgaatattctttctggtgatctgtctccacaaattccagctgtcttggcctttgtagggcccacctcatttgtatgccttctctcagggagtctagctctgtactccctgttgtctagtgtctgaaaacagtaattttatatattctgtccagttttctggttgtttatagttggagaacaatttggtgcttatttatattt

SEQ ID NO: 71686 - DNA, 1021 bp, Homo sapiens
tactcactttaagtgtacggtttcataattttgacaaatgtgtatatctgtgaaaccactgaaatcaaagtagagaacatttttatgatgcaaaaaagttcatacatgtccttttgcagtcagggtctcccccttgcccctcagccttcctcccctccaggcaactaccaatctgctgttactgtagaatcattttgccctttctagaatttttaataaatggaatcatatagtatgtaatccttatttctggtttcatattattgcttaagtagggtttttttttttttttgctaaatagtagtctcttttttggatatgccacaatttgctgttggctgtgaaaattaatgtactgctttttgtgtgggacatatgtttttatttctgtaaataactaggagtttcactttataaagaactgccaaacttgcaaaaaataaaatgtttgtatcatttaatatcccatgagttttataggagttctaattgctctgcattcttgcagcatgtagtacaatgaatttttacaaatttcagccatccttgtggcgtgtagtacatgttgtgaatcttttatctaaaatgcttggaaccacaagtgttttggattttggattttttcagatttgggcatatttgcattatactggctgagcgtccctactctgaaaatttaaaatttggaatttcctttgagtgtcatgttggcatgcaaaaagttttgattttggagcattttggatttttgaattagggatgtgcagtatgtagtaacttatttcagtttgtaattttttgataacagatgaagtttaacatcattgcatgtgcatattaagtcattcgtatatcttttgggaaatatctcttcacatcttttgcccaatttaaaaattaggttgttttcttactgaattggaagaattcttggaatatcctggatacaagttcattggcagatagatgtattacaaatgtattctcctaatttgtggtgtgccttttcattttctcactg

SEQ ID NO: 71687 - DNA, 1614 bp, Homo sapiens
caagtcagacctttacatgttctcacctcagagcttttgctgtttgtaaagagtgcttgctgcaggcgtgcactgcttaactaccagctacatgcattttctcatgctcacaagatccttttgaggtagagtctactattctcatttttcagataagaaaactgaaacaagaaatttaagtagcttgtccaaggtcacacaggagctgaatctcttgattcaaagcctgaacttttaaccagtagtacatttgtattttatgtttttctttcttctatctaaattcttttaggacttcagtgaagctcctcgtagctattccaaacattattggtctctttctttttcgagccttttgaaaattagcagtgtagaccatataatttagtacaagtgctaaggtagaaatcactggagcatatagatttgcctgagattaatggagtgataatacagtttacgtttttttaaagtttcatcagagattaatggagtaatatacagcctacaatttcttcccagagatagggaaatagatttttttttgtcttagactgttccaaattgaggaatcatttggaaaatgaaaaattataaagatagcttattgttttgattgatgactggggcaaggttaaaaaacctacataaccatgtgatctaaaaaataaaaatgatcacctcgataaaagtctttcagttttttttaaagtaaaagccagttattaaaataatgtcaaaatgatttagtatcacaatcatatgcttatttaaaaatagacaaatagcttaaaaagtaatctctttttctgtacaggcagcttggaggcctgcattttacaactgatttggttgtcaagggatctgggctctttctgtcttgttactacactgttcttagtttatggcatatagttcaagatggctattcagactccagtcatcaaggttgcattctaggttaggaggaggtggaaatgtgggaaggacacaccgtcctttaaggaaacctccaggaagttgcctacaacacttctggccatacttcaaggccttacttaactgcagggaggctgggagatgtagttctttaagtgggcatgttgttatccacagcagtgtaaagtgtatgttactatgggggaaggagccactcatgtttgtgtagacagtgcctgcctcgtaaataatatacgtttctgtttatagtctgttactgcagctgagaagcaaaccatcttaatatcactaatgaacttcattaaatagttcaattcccagaaatttcacaagaattctcttatagttaaggttaacaaatacaaatcatttaatcagtgtcctgaagtagtcagacatgaaaataatttatttgaaaatattgtgtatacctctaaacgatttacacttaccaggagatgtgcaagatgatactttggttttattaaaagtagtttgttttgggctgggcacggtggctcatgcctgtaatcccagcactttgggaggccgaggtgggcggtcaagagattggggccatcttggccaacatggtgaaacctcgtctctactaaaaatacaaaaattagctgggcgaggtggcgcacgtctgta

SEQ ID NO: 71688 - DNA, 1051 bp, Homo sapiens
aaaagagaatgggaatcctgtcagaaagcgttgtgatgtaatcctagagctatagatattttaggaaaatttagctacataatagttattctaaaaaaataagaaaaggtacttcaaaaattttcagatttatgacacctgagccatttagcatttagaatttatatcagagcatgaatcttcatcttagcaactaaagagcacaaatatttgcctcctgagatacaagttcttaactaacatttaagttactaaaaacacagtgttcaaagtatgtcgctttaacttgaaaagtgtaatcatctgcacagattgaatcaggtttcatgatcccaaatagactacattctttagttgtctacaaattacttgagagagatatgtatgaagatgatattttgttgctatttggtgataaggttgtgaaactgagctttgcaacccagacagatggtgctattcttgaatctgcaagatcctataacatttaattaaacagcggaatgattctcatgagaatccatagtttgttatatataagctaataagctgactttagtaaattgtataaatttgatttgaagtagaagaattacctattctaggaaactattctaatgaatgttaagatgagtagcttgtgttagtggtttatatggtaaactcaaggaatattccagatggaaaaacaagtgggactcactaaggtaggcgtttatcttctaaagtaactttgattttgttgccaaactttctcatatggtaggtgtgatatgctgttaagaacccacagagctgactttaacaatttccagaaagctgtgagaaatttagttatatatgttaacacccattttagaaaatatctattgatttagattccttgtaatctatcttatattttaattttggaattgaaaatagaaataagtaaaacagcccagtctagttttagtatgttatgtgaacataactctttagccatttgtaaaagtttgagtttggtggtaatattgtatgatggagatgaatgaattttttagttatataa

SEQ ID NO: 71689 - DNA, 3402 bp, Homo sapiens
atttatctgaacttaatatgagcactaataaggtattcagaagagtataattggtttgacaaaaaacattttatgttgacaattctgactattgaattttcatgccctaaagagaaataaggaaaaacatacatatatctaactggaacatttggaactagctcctagtatttgtgcctgcatgtaagcctggcacaatgctacttaagaagttcaaatgttacctcctctgaccaccacaggcagaactagttaccccctacctccctctgtgtacctctgatcatcagatgagcttctgcaggagagtgaccctgttgaaatcatctttgctaggtgctcattaactatctgttaagtgatggaattcctggacgattattctccattcctcaagggagctcttattgaccatttgggtcttgatcacaagtatgctgtttttatttcagcttattttgatgattaactctgtgttctgaatatattttatctagactgtatgtactgtggcttggtaatattttagatgaattctagaatttccttattaaagacaattccaactgatcatgagacatgttcttactcctcaaaggaataagaattcatttagtgtttagattttctgtagcatagtaggcaacctatagatttttgagccttctggggattttgtttgggggcttgatccagaattcctttactttcattctttaagctgtatagcagtgcttttgttcaacattcaaaagattgttttctatgagcccagtaaaatgggaaataacctggtagtagggaaacttgagttgtattaaacatttttactagtatgatcacgtaatagttctgtgcctcagtttctcctgtaaacttggtgttggagggcaggaggcgtgaaaaatcattttgagtaccttttaaggaaagcgctttggatgactagatgatgttctttagtaggaagagacctttagtaaattacaactaaagttatagagtagcccgaggcagttaaccaggagattggaatggtaaaatgacttgttttaagtatagcatttatgttgtgtttgtatttttttctagggagcagaggattaaattgttcttgtgtctttcctcgtaaataagccaagattgagaagaaaaacttgaaattcatttttagtttttaacagtttttcgttacaaccatatatgattcacagttgcatggtgtgcctttaatgcgctgggtgattttgctgtaccaactctgagctatagctggctgagattgggaattgaaccgtggctcttatttggtagtttaagctattaattccttggcagttctggagtgctctttgaactttaaatagcagttctattaacactttgagatttgtctcagggaatgtcaggaatagtacttaataaatatatttttcttcttaaagactaaatcatgttttagtttgacacacatgtcacaacccttactgtgttttgaacagagagaactcagctactggctaatttctattttctgtttaataatgtggcagtatctaaaaatattgtttaggcttgttgaaggaaggaaagccctcccacgaatctgtagcgtttgtattagtcatgttgaatatgaatagtgtcttaagttgtatctagaggtttagaattttacatgtaggtggtctcctgtgttctaaaatactagaaaaagttaatttgtaagtttgttttcacaaaaaaactcccatctcttgctacaaatgatggttagcctatttaccttgtatattgtacttaattaggtctattataaaactcaaatgctatttatagcagcatttttgtgggaataaacttatgcttagtgttctcatgtagggtgtcaggagcaccttttctctgacttatagtcctggcagtcagagcgggagctatagctcctcttctaggccaaggagaggattgctgtgtggaagagtgtggagaggtgaggatggctccctgtgggaagagcagcagttttgaaggcaggttttcctttccctgcttgtgggcacccactgctgctttctctttgctgatactagtggcaggttctgtgatgtcatcaggaaaagattctgtatttctttgcattttagcacttcccttctctttcctctcctccttcactcagccctggagacaagctttctgctggctattacgtttgctaaatgaggacttctgagatccaatgggatgaaaagggaattagggctgagattggacggggtagccagtaaacaaatacttagaaatgttaatgttttgtacgctatgtttgagaaatttgagacatgtattttggaataatgtacatcagaaattattaaaatctagcttgggttaacaaaagggctagactgatatgcggaaaaaagatctgcatgcactatttaatttctgcagagggagagtgacatggaccgcataatatctgataatactttgtagccagagaaacctgaaaggggagtaataaaactggatgttgaaggaatggatggatgtggcttgctagagaagaaggggaagggcattctttggaagcttgacaatttttagtctttattcttgaggatctttattgaggtggtatgtaggagaacacttctaatttatggtcctggttcttggctttcttttaaaaaacagtacaaagacttattgaaattgaatttttattaggtggaaaatttgaagtgtgggcaggccaatttagattaagaaatgatgttaaaataattttcagttttctaaaatcagttctgaactttaaaaaaagtgctatattacgcaaaatgctaatgactaaagtgacaaatatttcagaaactggacagacgtgaatctcaaatgagcagatgggatatgaaactaaaacgggagataatccaagacgatatagaaactattatgagaagtgaattgaggaaaaacaagtgtgttaaatggtattacatttaataatgtgtttaaaagcctttctaggactgctgtcttacacagacaaattagaattgttgaactgtgtaacccttcattgtttaaattctgtgcattgaaaacaaattcgattttggtttaagattacttcttatgaagcctaggcttttaagttgtgaaggtataggttatatgtgctttaaatagacaatctaatttgctttctctgacttaaaggtaaagaaatgaaataatggtgattttcagagacaatcgtggtgaaccttgaaggggagaggtgtaaggagtgaaagagagggaaggtttgctatttgggcagcttggtagttcaaataattacatttgactgttgagggtagaatcttggataagtgggttgaggagtga

SEQ ID NO: 71690 - DNA, 1010 bp, Homo sapiens
cccaaagtacattgtatatcatagttatttctgaaggagatgtaatcacttgttcaaaatcatgtttttttataagaacgctttatggtttaataatagcatgcatttttttcttttggcctgcagggttttttttttttttgttttgtttttttttgcagagaaaagtatttataaagaatttacctagatactctcattagttagattgaaataagagattaagttctgtaccgtggtaatacccacccagtttccattaccttgaggtgttcattatggcttaccaaaagttgattgtgcaatcaatcagacactttaagatttctgctagtcttttacttattttctgattttttactgcacggaatcaaatttcttaaattaatttttcagcatccattcccttttcctaacgtgtgaaaaatgccattgtgtatatatgatatgggtcattgtataagtttcttattctaactgctgtgagatttgtagctgctgcattaagtgcatgcctgcctgtgcctttctgactcaaaactattttcttatgctgtccatcacatttctgggtgactttttatatattcactcagttaatcattcagttaaaagtgtgttaaatctgcctttttgaaaagtgtaacagtgcaccctatggtatgtgaactcattcttgtgagaagacataatttctggatgttaagtagacatttatttttctctattgagttaatatggagaaagtgattttgtgccctttaactagatttaaatatgtgctctttgatatgagggagtgatctctagttcttagatatgtatgctccactttcatgttttatttgcttagaatcttcctgactatggataattgggtgataatctcaaattcttgctgaattgagacactagtacacccattagtacataattcctattgaagaccattagttctatatttgaagcttttaaggtaatctattgttgacctactttctttttgtctt

SEQ ID NO: 71691 - DNA, 1940 bp, Homo sapiens
attctcccccttttggatcgtctctctctcgccttggatcccatccagtgtttatttggctctttaaaaatcatttgtgagcgcggcgctcggcgtggaatttgcatgtggaagtctcggagctgcggattctgggtcgcacttcgaacgcccaccctctgttgcaatcgcactccccttctcctcccctttcccccctttttttccccccgtaaatgtggaaggctttgccttgtgctgccgcgcctccgatcggcaacctcttcccccgttgttggatcagctgcctgcccgcccgcctgccttttgaatttttttaaattccataatgacacctgcaatttcgccctaaaatagttgattgaatgcgattgtgtcaggaaaggactcttgcacccgaagctcccgcgattgtaaacatcgacagccgcctgcctctcggggcttactatgctggagagccgtaaagccattgcaccgagccgacggaaggtggagaaagctttttcttctttctctcctcctgtgtcttttaaaaactgtttttctctatcctaacaacgaatccgcacacacacacacacacacacacacacacacacacacacacacaaaagcaacaagctggtcggtttgataacatcgcttttatctgccttcgcctctctcgcgctctctctttctgataattgacaacttttccttcggatttgaatcgcctgccttaatcttgaagcagttagggtgtcaattgttctcgtggaagcctggcacccgccgacggtgtctagattcatcgaaattaaaaatgtatagggctccagcaactcttttcctggcggtgtcagtgacatttggtggtaaatgccatctttgctttttattgggtcgtattacctacctctgaaaacattcacgttgttaaacctggcgtttaggctaataattgcagtgcgtggtctttaaatatgtgctttgtgcatgagttactgtatgtatagctatgtgcccaggagagtacgaatttgtttaaatattgagcaaagatttgtaaacagatgtaaggcaattacgtttcaagcgtagaatataattggaaaattggctgaacggtttatttaatttagccttaaaaacacccaacttgttttaagttgtgtaccctgttttttttgggggggaggtgagtcccttttggagagcatgcattttggaaattattttctgtaacccccgctgtagatagaagcattatttccctcttaatccttgtttacactggataaataatttagtgttcaaattgtaattagttacatttaattatgggtggcatagatgcctttttgctatgagactaatggagaaatgcaaattctcgccaacttttcaaatgaaagtgttactttattaaatgtgttacaatgcagaccaaaaaatcaacacgtgatttttacctacaaagacatagtatcattgctcccactctagtaaaatcaggtaaatttttttaaatgaaatattttaatccagatatttaatcttaaaattcatttataagttggaattctttctcttagtattgtgataattttcccttgattttttggtatgtgggagtaaaacccccttttgcctcaactttttccctcctcagtcttatcatttagtatcagtcaggttcagggacttccatagattagcaaacatattgatcaaggggtatttaaaatggtttttgtgtggttactggtgaccacattgacacttacaggtaattaaaataaccaagtagagcgatctcccaaattatcatatattatgctgactggtaatggctgtgtatatacggattctgtagacaaatgaaagtatatgtatagccagtctttagggtatatcatttcttttatcttttttttttttttttaaagcttaag

SEQ ID NO: 71692 - DNA, 1040 bp, Homo sapiens
ggtcagggcactcgtccctgccttcccaggttcctgaacgctgaggattacagcttcgactgctgctgtttaatcagctggtagcaatttaaccattacaccccagtgagagaatcctagacatttcctacaggagggggacgggaagactaagatgcaaggaatgcagaaggggggtggtgtggagacacaaaacagctttattaaaaagaagaaggaaagagaaaaggaacatgatgtgtcattgtatctcagcttgaaataaagctcccagggctgggaaggagaacgcagacccctggagatgctggggagaggggagttggagggttgaaacagggaagatgggtgcgggttgggtgcgggggaggggacatcagagaagcctggatgtgggatgtgggaagttttgtctcctgcaatgaggggcggtcccaagacctagagaaggccctgccccatccaagccttgcccgagatggcccctcagaaactggaaacaacagagcagttcagcgaggagagactcacttttgcaaccactggtccgtttgtaagtgcgtggaaaatgagatcggtagaagcgaggagagactcacttttgcaacctctggtccgtttgtaagtgcgtggaaaatgagatcggtagaagtgaggttctttagcaaatgcacttccagccttcaaaaaatgaaaacaaacaaataaacaaaacttctccagccaactttcttttctctggtcccaccgtgccttaagtgcctgtacttgaagtctccagctggctgctgccctgagccccccaaagccaggcaagagccacctgtggggtgtaatgcagagcaccgggaacctccgtggaaggcagccctgggagaaagcaaggatggagtttggggcgtagaaagggagccctgggagaaagcaaggatggagtccagggcgtagaaacctgccctaagatctggggtttcagatttgagccccaggccttccttggctcactgagaaaactagggcaggttgctgaagctcctctg

SEQ ID NO: 71693 - DNA, 1047 bp, Homo sapiens
actgagtcttagagacccagctgaggtttgtgtcttaatagaaggcaccccagttaggcatagagttaagttgaaggagtgcttttcaataaagccaagatttcccttgaaaaacagtcttgactcttctctaatacatgccaaaggcttgaataagaccccaaaataatgtactatagaacaggtgtcagcagatgttttctgtaaaagaacagatagtaaatatatgatggtgtgtggctgtaacatatacagtttctgccacaactactcagctctgttgttattgtgcaaaaatagccttacacggccacagtcggattcgctgccgcagcagccgccacccccaggagccgccgggaccctcgcgtcgtcgccgccgcggcccagatccccacaccatgccgtcggagaagaccttcaagcagcggcgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctgtgcctcccaggagacgttcgggatgaaattgtcagtgtaaaaccagaaaaaatgcatctcttctagaattttttaaacccttaccaaggaaaaaaaaagggatgttaccaactgagatcgatcagttcatctaatcacagatcatcaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcat

SEQ ID NO: 71694 - DNA, 1925 bp, Homo sapiens
tcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagctgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctccccca

SEQ ID NO: 71695 - DNA, 1073 bp, Homo sapiens
agtctggcccttgcccagagcctgtaatccagtgggaagaaaggagagggaccagcgtgggttgagtactggttccaatctaagctccacattcaacccgagatgctgcaggaaggtgactccacctcttagtgccccagtgtcctcagctcaaaatgggatttttttttttttttttttgagaaggagtctcactctgtcacccatgctggagtacagtggcacgatctcggctcactgcaacctctgcctcctaggttcaagtgattctcctgcctcagccttccgagtcgctaagactacaggcatgcaccaccatgcccagctaatttttgtatttttagtagagacagggtttcaccatgttggccgggccggtctcaaactcctgacctcaagtgatctgcctgcctctgcctcccaaagtgctgggattacagtcgtgagccaccgtgcccagcctcaaaatgggatattcacagtacctacttcatagagtctttgggaagacaacatgagttaagacatataaaatatacagagcagggcctgcgtgacatctaaagccaggatattttagccactattacaaagaacatccccctcttgggggatgttggagagcagtgccactcaaagtgttgtctcttcaccagtgccagtttgagagccacctgttgtctgtctccagtgagttaagtacagaaactgaacatgaggtttcacatatctggtcatggataggtttacactactcagctgtagagtatggatggagaactgtaactgcagccaggatgtctgggttccaggccacctctgtcccttaatatttttaggaccttccacatatttgcctttctgtgcctcagtttcctcatctgcaaaatggggtggataaaagtacctgcctcataatgttagtgtcatcatcactgctgcaccgcagggtctgtaatctgtccattatctcatcaaatcctgccaataacaccatgaggaagggaacaattcccattttattcatgagaaccctgaggcttccagagataactttatttgcccagagtcca

SEQ ID NO: 71696 - DNA, 1042 bp, Homo sapiens
ttttaatgcttgtttttatatgagatttgacttcttgatggacatttgtattaggaaattgaagcatgatatatatgtatatattgtctccaccatctctcctgttgtattacttggattgcatgagatagtggggtggttcttgttttttaaaaaatatttccacagtgtgcaaagtgctggcaacatccctccctctcctccaccgctcccccacttttctctggctgccaaggagtcattgattttgattagcttcactgcagagcgtctgtgaagagagagagagagaaagggagggaggctttgaaataaattttaaaaaagacctcatatcgggtttcagcagacagcagtgtgtgtgtgtgtgtgtgtgtgtgtgtgtgtgtgtgtgtgtgtgtgtgaccgtacaagcagagggaggcctctgagatcatcgtttaggtagcttgctgcataatgagatgaagagacttttgcctcttcatttctgatggtgctgcttgctctcagagagtggggagccaggaaccgctgggactggagcccccgggacttcaacactccgaatgagatccagtcctttctggaagcttctcacccccacctgatctcccacaaacaaatacaatctcttcaaatttgggggtccgtttcctattctctttgttattggtgtagcttgagtaggaagtttctctggggagcccattggccccaatggctgctgtccatggtcctaggccgtgcgcatgtcctagaccccagttcctgttttgtttttttttgggttttttttggccctgcgcatctcttagagcccagttcctgtttttttgttcgttttttttttttttttttagccgccttcatttggatactggggacttcttttccacttcttcttcttcttctattttattttgagacagagtctcactctgtcacccaggctggagtgcagtggtgcgagctcagctcactgcaacctccacctcccaggttcaagcgattctcctgcctcagcctcctgagtagctgg

SEQ ID NO: 71697 - DNA, 1040 bp, Homo sapiens
tgatattattctgcaggtgtgaacagtttaatttgcaacacagtagtccaattgtccaccagaattcttccctctatggccagttggatttggctttttgttgttgttgttaacccagttgttagagcacatatataagaatagaaaatattcttaaacagaaccccgttagcgtacagtgactaagttagctgtgatctgtgaagtcaggagttttatggagctcttacatgagaatgacaatagatggccagtagtttgtagaattggctttgtttcatcaatcattaaaattaaaaccacaaagtaataaaaataagtagcactttcatttgtttcttggggtgtttttattttgaaacagggaggaaatccttctgtggaatgtcctgctgctttatgattttattttagaggggcttgctttttttctctctctccatctctcttttaatctaggtgccttgggattttagtgaaattgggccagttatgtggaattggcaccatgaactaaatgtatgcccttggagaaaacctgtttgcttagatctttatgccaaattggtaactgactaacagtaagaaactctgttactgggaggcctttgagatttaattatcccacaaaccatgccggagactgattttgctttgactttgcctcctttccatatcccctcctcttttttttgcttttgaggctttatgttttgaaaactgaagtcctgctacattagtttgtgatctgtgtgtacttttgatgctgaggtctccagctccttcctttcaatagttgtccctcgagggacttaatctctctgtgggagtgtttcttgccgaaacatcttgaaaacagtgtagcttttagtaagcaaagttacttgttggacagttcattgaacaggtttgtaatcttgctatttataattttatgttcatctttttttgtgcccacaggattcctggtatttaaaggagacaattttttagtcgataacaatgatacagttgttggtttcaaaattacaaattggttt

SEQ ID NO: 71698 - DNA, 1078 bp, Homo sapiens
aggaacacatgttacgaaccaactggaaggtgggcagtggccaatatcattacctgtgaaagaatagcctgcaaggacatgggaatccaagctttcactcatagcctgagattaattgccaacagcgaagggagaggggtacactgagcctccccttcagctgttggtgacttgttgcccattttgttcaccattagatgatctgcctctgttttcagcctcaagatttgggaacatcctcttattctgcaggagaggaagggtgagattgggttgccagccacttcctctcggattgttagggtggtcagaggagtgctctgtgcagcccctttgactttcaccgactctctggagggacccagaaagcaaaagcactacctgcatacaaaagaggagctgaaaatgtcatttctagtaaatgtaagagggagatgattaaacatctctaagcactgtcttctcttccctcacataacctattggcgtgcttccataacatttatcacttcaaagtctctacggaaatattagatcacagctaagaatttgcacagtgaagtgtttccataggagataactgtcaagagccgtgttacataaagctgtttgaggcatgacgagacagcagtgtggtggcagtgtttctttctcacctgggaggctggagattcaatggtagagaagggatggaaccattctctttactcccataaaggtcaatcctaatagactttgagattaacaagcttttgtgcattactgataatgacaaattgcctatgtgcctgtctgtccctactcacctcctaacctgattagtgaccaatacgcttgatctgggcaacctcacacggtttctagcaaagtcaataagagcagtgtctctctagttcaggggttctcaaccccagcactagtgacatttggggccagctaattcgttttgtgcggggctgtcctgtgcattgcaggctgttgagcagtatctctggcctctccccattagacgccagtagcattctcttcctcccccaagtcatgacaactagaaatgcccctagacattgctggatgt

SEQ ID NO: 71699 - DNA, 1151 bp, Homo sapiens
cattaaaattttatctggtggttacgatgcttgttttctgggtcagatcttgaatcccttttcatttgagacagcggtgtttgtggttacctcattcccaatcaatgttgaattcaccaggctttctacagttatgtatctccaaggagcttcttaaagagacagtggccaactcaccccttctttctcttgtacttacctcgtgtttctcttattcttcttttttccttcccttttctctttcttttgcacaagtggagtctgttcagaggcttagttttatgtacctagagctaaactatgaagcatttttgcatttacacctattaagtacatttcacatcattgatggagagcagaatctcttcttctcaccttttcagctctctatgtaaatattcctagtttggggccatgctgcataggcccagactgatatttattgcagtgaacctcatgatggacccagtcatggttcttccctactctccttttcacataaaaccagtgaaatctgaaaatagtcactcgttgataaacgcatttgacactcaaatacccatcatgtgaacaggacctggtgcctgtctccctgaggcttgtttttccagtggggaaacattctttccaaagcatttgattgttcactcttttgtccgtgagtctttgcttactctacagtcttacaaataatttctagttaacttttcctgacattcaaagctctttgacatttctttccaagctacctttttccttattacacttttcaagtgtacctttgttttttccacactgttctatttagttacctctgactgcatcatttttttagttaagatacagtcatatgctgcataacagcgttttagtcaatgatgggccccatatatgacattggccattcatgtaccctaggtgtatagtaggctctgccacctgggtttgtgtaagaacactctgtgatgtttgcacaaatgataaattcaccaaaggatgcatttttctgagtgtaaccctgtcgtttagtgacacgactgtataattcatatgccataaaattcactctttcaaagtgtacaattcagtgattttttcttagtagatttacaaggttgtgcaaccaacaccactatctaattccagaacat

SEQ ID NO: 71700 - DNA, 1055 bp, Homo sapiens
cgtatatatttgccctgaatttaaaaatattttctgttcgggaactgaagccctcaaggatcgtgtttccaacactcgcttagttttatatgtatgtgtgaaaaataaatactgcctatggattactttgagactgttgagataacagatgctttgtaaataacataggtataaggttgtgtgagataaatgttgcccatatatacttactaaggacatgcgttccatttttctccttttttaaaaaaactttttcccctaacagttttcctttaaaccttgttttgtatagattttctgctgctagttattgtgacattggactgtttcccataaggaactcgatcattacccgttagggacctctttttaaaaatacttttaaatttatttattttctgctgtgaggtatacatgctcttctggtaaataagtctgaggtaagatattgataagtgactagaggagagcattacatttattatatctttaatgaaggagctccagaatatccttgataaatactggtgaactcatgactgcatttatccatctctggttctccgaggaataatgggaagggccacagctacaataactctgcataatcatcattgactctgactctattgattgtgattaaccaagatgtatggaaaacagttttaagtgtgtagtgcatgtatctcataaggtccattaagacgttcattatttttcaattgatgcgtcttaagccccacttgatgtttgttgtagtgcatttccacagaaggattctgcactgtgggattgagttcattttgttaattgcataatacaaccccatcgtgtttcatagaaaatagtaaatactcttgcttttattgattggtattctttgatattactgaagaaataccaaagaagcaaaggagcaaagaaataccaaagaagcaaaggagcaagtgaatagttcttcaaacttttacatattaagggcacgaatgtttcttgaaatgtggacactgcagttttaggagcctctgcctgattgctcagtaggctttaaacca

SEQ ID NO: 71701 - DNA, 1030 bp, Homo sapiens
tcctctttatatggtgccatcaagcacggcaaagtggcttatccacctccgcaacactcccagtgcaactgtctgaacgcacacatgctccattgtccgggactgtggctgccctgggcggaggtgactatgatttctcatttactgacgtatcaacaatggacgggggtgggtctctccaagctgctttttagcggtgaacagtaggaccatgttttagttagacggctgtagagactaggtacttctaaagttttacttaagattttgtttttagtaaaaaatagttcttcagttgttttgcttgtatcttttgtttgtatgctgatgatgacatttggatgtgatgacatggcctttgaatgcagtaaacaactacccccctgcccccaacattgaagttttagaagtgattcttaacatgttaaagcattgcttgcgagaaggctaaggcaattgatggattgtggagaagttgatttttttcaaggcctttgttttccagtcagtcttgtcctaaaagtttcaatcatcagttcttgcctggtacctttgcctactcacccttaggtccaggaatctagtcttcatattcagacactttgcaaacaaaacagaatgagacaactttctaacagaaaccaaaaaaacacaccaggtatagtccttgtaaaagatagggtatgttcataaatgtaaacttttttttttaacactaggaatgctcacattttaaacattcagaagggaattaaaacatctaggctgggtgtggtggctcaggcttgtaatgccagtgctgtgggaggatctcttgagcccaggagttgagaccagcctgggcaacatagtgagcctccgtctctacaaaaaatgaactagctgggcatggtggggtgcacctgtggtcccagctacttggcgggctgaggtgggaggatcacttgagccctggaagttgctgcagtgagctgtgcgtgattgctctgctgcatttctgcctgggcaacagagcaagacccagtcaaaa

SEQ ID NO: 71702 - DNA, 1057 bp, Homo sapiens
ttgctgagactttttctcttgttttaccttggcctactgtgcaggagagaagtcgtagagatctttgggcagggggttgtctccttgccctgaggtccctccccaggccctctccaggtgggcatgttcatagtatttgagttagtcttttggcctcagctaattggatgagggatggggccccagttcttgggggaagctgattcatggactgggatgggctggttgggactcaaactttgttgcattcttggagtagaagacctcctggaatggggacagccacctttctccatgtacccagggatgagagaaagctggtttccgaaaagaagaatgaaatagaattgcagagagaagcagagataagatctgtggtgcacacaagttacatacactaccttggttctgcatgtcttcctggttcctggttctgatcccttatcacctccagctgtacttcctgcccttgggctccatgaagtagcctcattcctttccagtcagtttcctttttatgtttaagccagtttcagtgggtgtctgtttcttacaaccaaatgttccattgctgaaacatatgacaagcattaagcaaacctttattgatgtacagccacatccagcactgtgaattccttaccatagggcatagagagggaaaaggacacagtcttgccatttcacaagttcacagtgtcaggagccaaatccatttcattgctaggtccgcagtatgataacacttgacctttcaaatgaatttatatcagatttaaaaaaaaatacctatttgagaagtgaatttccttgaccctgacaggcattaactacttcttccttagtagttatgcaataaatgcagacttggttcaagttaaaacatctagaaaagtttgctgctccttttctggggtcttaaaatagtgtgacagcatgaccaaaagttaagcttattcattgttccattgtgctttgtgtatatctctctgtgatcattgtgttttatattttagttattaaatatttgtttctctccagtgtgtgttttatgaaa

SEQ ID NO: 71703 - DNA, 1256 bp, Homo sapiens
cccaaagtgctgggattacaggcatgagccaccacacccagcctaaagttcttatataacatgtgaaatgatacactattacttgcaggtagactgtgataaagacttatgttaaaatccaaaagcaacctctaaaataacaaagagttttggctaacaagccaacaaaggaattaaaatggaataaccacatttagttatcccaaatactcaatccaaaaaataaaaaaggcaacaaaagaggagaaaagggagcaaagaacagatgggataaatttaaaaaattagcaaaatggtagattaaacccaaccttatgaataatcacagtaaatataaatgatttaaacaccccaattaaaagcaagaccaactacatgctgtctatggaaaacccactttaaacatataaagacacaagcgaaaagatgggagaagttctgcatgctaacactaatcgaaaactggcgtggccatgcaaagtggatttcaaagcaaagactatagtaaccagggataccgagggactttgcctgtgataaagaatcaactcatcaagaggacatacaatcctaaatgattttgcacctaaaaatgatgttgaagaactgtgcacgtgatatcagccccccgacaagtgaggatctgatcaagtgcgacactttataattgaagtaggggaaatcgaaaaagatgaagacacaacaggctttcaggagagaaagatttgaccatttaattgatggagccctggatttttttttttttttttcccaaaaagactcttctcaggatagctctgtgctactcaaccttgtggtgaaggatattttattgcataaagttctgttggaaaaatgatgccagcaaagccaatacttgattaataatgaaaaatgtgtttatagataaactccatgtgtgcttagagtgagctgtggttaaatagcttccacgcttggcagcacccagggtgagtgtgatggtgtacgtcagttactcattgagctcatagttattttatgcacttacaaatgcagccgctcatcctgcacttttccagctaaattccagcccaacttcatgacgtaccaagtcatgacataacaagtggctttggaccaagttgtttaaccgctcggtgcttctgtttcttttctgtgagaggagtaaaatggtgcgcctcccaagatggaagtgaatgcccagtgagaggagacacacgagtctctgaagactcagaagctctatgcaaatg

SEQ ID NO: 71704 - DNA, 1011 bp, Homo sapiens
ggcagaggcaggaagattgcttgaccccagtagttcaaaaaagcagcctgggcaacatagtgagactgtgtctcagctaaattaaaaattagctgggtatggtggcacacgcctgtagtcctgtctatttgggaggctgaagcaggaagatcacttaggcccatcagttcaaaaatgcagtgagctatgatagcaccactgcactccagcctgggcgaagagtgaggcactgtttctaaaaaataaaaaagtaaaataaaatattgtataaaattaccttcaggccatgtgcatcaggtatatatgaaacgtaagtgatttcgtgtttagacttgggtctcatttccaaggtatctccgttaaaaaattttcctttgtgttgcatgtttttaaaataattgaacatattaagtaaatttaaaattgttacctgcattgtttcttgctgcatagggtttcttaatatttgggatttaaggaccggaaagtaccctgttcatcgttttgagcacgatgcaagaatacaggcactagccctcagccaggacgatgcaaccgtggccacagcttctgcttttgatgtcgtgatgttatcccccaatgaggaggggtactggcagatagctgcggaatttgaagttccgaaactggtgagctttttagtctggtcatcttattttctattcttagaatctctgggtctaatgtaagcacgtactaatggtgttggtaactcccattcactcagagcttcctgcgggccttacctccataagtctaactacagccttacaaaataggtagtagcattttccccatttaccaagaagccacttcaggctgcttagagcagtgaactgacttgccccagttctcagaggtaagaagttacgattcaaacctcagggctgacttcagggccagagctgctcatcactgtggttccttggccttcttcagactaacacggtggaatctcacccttgggaatcaaagatcagtttgacctaa

SEQ ID NO: 71705 - DNA, 1080 bp, Homo sapiens
acatctaaatgtattttttgactgggtaatgcattcacctaattcagggatcaaaagataggaaggaagggtatgtggtgggaggactccttcccactccctccaacctgccacccagtttctctatctggagccaaaccaatgttgccagttttttgtgcattcttcctaagatagtttatgcacttataatcaaattaccatatgtggtctcaaccccactttaaacaatgagaatagtaaagtgctacatttttgtctgcagcttgctttttcctgcagcagaatcacttggagatcatttctatgacataacaaagaactttttcatgttttggttttgatttttgcaactttataatattacactttgtggatgtgctttaattaatttgctggctccctacggatggatgctagattgctcctggtgttttgctattgtaaacaacacttggtccacatgaatgtatttgtaggatcatttcctccaagtagacttgctgggtcaaagggacatgtgcctccatgattttgatagacattgccctccacagaagttgtaccttgggcagtggtggatggcagggcatccccttcccctagtggttcttggacggcttttctctgataggctttacagaaagatcacaagatgaggccagcggggatatacagagatctgactggtcctgcccttcatttaaattatttttcagctctctgcttttagagtgaatgactagaacacatgacttcatctagaatcagtgtagcatgactgacagccctatccggccagtgtcgtggtggcaagaaagatcggcagcgtacgcggacatgctccccttctgggcttatctgggacccatttgaggaagagcccacaattcttttaatctgacctgcctcttctcttctgtaaaatgaggagggttgaacacatgacctttgggctcctgtcccaaaccctggattctttaagccatgtaggtggtttaaaccttttggctgtggagttgtgttgagccagtccactggaggatgctgagttgctgagggcttctgaaatgggccgag

SEQ ID NO: 71706 - DNA, 1989 bp, Homo sapiens
tagtagagacagggtttcactacatgttggccaggctggtcttgaactcctgacttcaggtgatccgccttccttagcctcccaaagtgctgggattacaggtgtgagccaccgcgcctggcccccaagaattgttttaaaagaatgcatttatggtagaatgggacaggtcaatttagcttccatgcagaactaatggaataagctaatgtgaatgctgtcacttcatatgaaacccttcaagatgcgaagccttattggagagggctggcaccaagtcttaaatgtcttttgtctttattcacacttgcctagttcctgtatgccaataacatctgtaccattttctaatttttaaaggaattattcagtcttcttgagactctaagtttacagaaccatttagattgaagaatatcatgttcattgcctttcttgtcttttggctttcaaattaagcttagaatgttatttagaggctggtttttcttccctgatggtttatgtggaattgccttcctggtttaccatcctataccatggaagagaatgaacttagcgctaactccatttatttcaccttcacagatgtgtatggctttggtttgtttgtgccaaataagcctgggagtaaacactgcccaggcattgttagtgttaaaaatcagctcgttctccagttcatggggagctaagggagccctattagaaatgtttgcctttgttccagaggtgaaaacacgaaaacactagtgctgcagaagaggctgtgtgcttcccctgcatgtccagacagttgagactgatgctggtttggggcagagtaggagcaagagggcactcagcaaatggcctatgtgagttgaatttctgaatatttaaaacattttactgttttcaaaatacacatcgcagcttagactcacaaaatattaccaagtagagaactttcactttttattcagtacatagatgactatgatttattaatttcctccgcacttcagtcttctatagggcactgtgttagagagtgggtttgtaattaacttatcaattactgagttgcagatgaatccttctaatggacgcaaagttactctttaaagcattccctcgatgtgttattaatttacagggtaaatcccctttgtagagagcaaaggaaaactcctgctcagcccacatctgagcggtcgcatcccaaactaagggactcaggaagagccatgaggctgaaggtgcattaaaatgaggaagtgggctgtgtccagagagctgctctgctggacctggcttccagccttagcttgcctctgctgcaggagaactgtgccagggacgtgggatgaccgactggccccaaactgaattcctcatccagatttctttgggtctttgcagggttaggccatctggcccgggtggcttctttgcactctgctgtttgcttgggtttgaactcttactgtgatctcatgatcacaagttttaaaagtatgttgaaaatgacatgaaaataatccctccccgagcgcatttccccttcctggctcgcccctgccctttccccacctttatactcttgtggcacctgtccacctgtcagtgcccctcctcacggtccacttcaggttttctcagagcactggctgcgtggcgaggagcatgggtaaggccccggtgcccatcttcagcctggccttctagactgtggggagtcaggccccatcttagctcctagctctctagtcctgtgcttccagaatgagacccctgctccagccaggccagcgccatcctcaatgtgccacattcattcctgaccggggactggcactagcatcccctcttcctctcctgtcttgccatgtccttttgaaaaacagtcctacttaacagaagcagccttacaaactatctgcctctcattgagcatcagagctctggccctgagcttgtacagaacacagggtctgcatctcattt

SEQ ID NO: 71707 - DNA, 1136 bp, Homo sapiens
tggggtagaggtttaaagagtatgagctttgataccacccacccaggtttgaatcctggtgccaaaacttcctaactgggcaagaggtttgagctccttagggccccatattctcctgtgtaaagggagtaaaatcatggtacctatcttacagcactgtggaggtcaggtgagataacgcatcatagcagtgttttgcatgtaagagaatattataaatattagctgttattaataactattttggtaggacaggaaagacattgtgatatggtcacaaagtggcgcaggaatgacacgagctgcgctccacctagtgccacctcagctccttttgttgcccatgtaatttggggcaagctacttaaaattatttaagcctcagtttcttgatgcacaaaatgtaggcagtagtatttgtcttctctccctcttggtggttgtgagattcaaatggaaggatattccgaaggaatttgtgtgaaaggcatgtcctgggtattacaaagagctcatatgtgtagtgtttgtttatgtgcaaaatgctgctaagcatgtctctgccaatacctcatgcaccatgtagagtgagtagaggccgttatgccttagggagctggggggagcccctgggtggacctgctgccctccaccaaaggccctgattattcgctgcggcttcccagtctccccctggggctatttgtttcagtgatctgattttagctgcctgcctgccctcttctagaagcttttgtccagtctaactttgggccaaactagaagttgccaggctagtcaaaagaaaatcgataaccaagctagtgtaatatactgaatttcatgtgcaatgttcactaagtcctgtcggcatacagatacttgtacattatgagcatctcatggtaaccttttcattttcaaaatagtatgcaagttgcctttaattttaaagagttcacttcatagtttgcagcctcagttttcactccgtaagatagatattataaccttctcttggtgattatttccgtgtgtcagtgttcctggcattttgacactgcccatgctctctgtggggatgaggcctgttgggagcatgaaggagggtgtaaggattttcagctcccagtcag

SEQ ID NO: 71708 - DNA, 1050 bp, Homo sapiens
ctttactgtaaggccagcatagcagtcgcctgtaaggggtagatacacgcagacatgtacagtgtgtattcatctgctcattctttcatcacctgtatactgagcccctcctatgtgccaaacactgcacaggtatccaaaggagcttctgttccttccagacagtgcggggggcgcaccctgggcatctggcatcttccatggttatggtactttttcctgattcatggcatttgactggttggaataaagactaggtacagattattctatgtatttaacccccaaatcaacattgtttttgcagacagcatctggattcttttatgctcattacttgaatctttgttgactatttcttccagcacctcagaccttttttctggaatgattttctgtctcccaaaagtgcattctttagaagtttctttcataaggacttggtcacaagtgttttccgtgtttctttcttacagcaccttcatttcatccttatccttgaaaggtagttttgctagtcttttacagttctagcttgacagttatttttgctcagcctttgaggatatgactggttttgccttccactgacactactgacgagttggctgtcagtctgtcattctcttttaggactttctctccttttgactgcttttaagatcttctccttgtctttaattttctgtggtttcatgccaatgtctctttgtatgtctgggatttatttatttatttttatactgtctgggatttcttgtgtgtccctcctttcagttgtagagaattcttggcccttatcttactggaaatgtatcgcgatgctctgcgtggagctcaggggaggtgtgcatgaaggcagcttctcccctcctccgtgctgctcactgcccattcagatttcccatctctctgtctgttgcattccgcccaattcctcaactcggtattccagtccacagtttctctctcggacttatttcttgcttatctcatccattgactttttaatttctagaaattctctgctttatttttcaaatctgctta

SEQ ID NO: 71709 - DNA, 1102 bp, Homo sapiens
ggggtggcttaatgcctggtggtggtttaatgcctgtagcaggtatttgagtatgaagactcagtattttggtaaaattaaaacacagagttcctttcctcattcatcagtataggaccaaaattctgagagggtaaggctctatcatctcttcacagtgatttcagtatgcaagtggttcatgattaattatgagggtgatagcccccaatttaggaagagcttgcagtgttaatccatttcttactgggtgaaggaagaagttggtctgccttgagctcaccccgcctcccacccccacagggacaagagccatctctcagctctttccttcacagtttgcctggaaagccagtccaggccacacctggatgctgcggggcccgcctgcccacggcggtggctgatgcctcccagttgttgggcctgtagctggtgtctccttcctgactctggaccaccgcccctgctgcttaggacaccagctgccaggacatggctagaagatgatcggtgggtctcctcagagaggcaggccccgtctatggaggagcaggacagctgacggtcaggccccagctggggaagaggtgggctctgtcagctggcagcaggctgggacttctgcatgtcacccagcgtccctgcacgttcattccagtgcctagaagatgattgataaatatctgttggccagctcttgaatgaatcacagcattatttattttatctaaaaattataaacaatccatatggagttgtgtatccacagagaaattctacacaaccattaaaaagaacaagatctatctataggtattgacacgtagggaaaaggagttgtgaaataatcccatttaggaaaaaaatgtgtatacacacagaggcagatgtgcagaagaaaagtcaaagtatatatatcaaactgttaaaagtggtgatttgtgagagatgaatatacagagggctaccacttcctttatagaattctattatgttagaatttgttgtaagatgtatcatatttgaaatcagaaaaagatttttagaaatagatttcagatacatcagaatcattgacaaaattgcaagttaagattct

SEQ ID NO: 71710 - DNA, 1034 bp, Homo sapiens
ttgctctgtaattactgttcaagtgcttctctaatatatacctggtacttaaaaggaaccatcctcaacatcatctttggcagctgcattagtgcagaatattttctccgggatttgtgctggggtaggtttttccagcatatctgtacacctctgagaatgagtcaagtggtcatgggttgagactcacccaactagggcaataaagagaaaaattagtctaatgcatggtcttaacaagagggagagtgtgagcatgaataattaatctcactagtctatggcaatcagataaaatgaagtcccatttgctcaaccttattaaaagagagagagtgcgtgggagggagggagaaatggtaaaggtcgttaagggactcgtaacgtggaaagaactgcctttgagatgggtaatgtgttttctaatctctgtggtctttaactaaacgtcatggtaaaggtactcttcagatagttcggattcgtttgaattattaaacattttagaaaatactggactctggactactaacttagatgtctttatgatgaatttgcagagagtctttttggaaagggattacatctcactatatcactaagaaataatttatccacttgtcaaaaaagaacaactggaagacataaagacacatggacctactcagtatcagatttcagttcttagatttaccatcaacattctaccgacttaaaggccttaccttcctgctgcagaagttggagtattttaaaaacaagagaacacttgaaagtggatgcagaatactacttttataatagaacgtgaggttgctctttttattttctccctccaggtgccgattttatataatttttaggttattctctgatgataagagatttggttatttctatatacttacttggaagaataaatttactcttgatattttaaaattgttgaaatgttctgcgtcagaaatttttcttttcaactgcaattgttctctgtagtctttatggattaagagggcattttaaattttgaa

SEQ ID NO: 71711 - DNA, 1055 bp, Homo sapiens
aataggaagcacgccctgagttgtgaccccccaattacagagtctcagtgcttgcttcttgccctgacaaatataaagttgtgtgctgtgctcgtgctactgctgcctgctgttagagagagagtgattggggcgtaaatgttgcatttgctccatctgcaagtgttataataagttattcagagctcttaacacaggaccaaccagagcgtgcctccctctcggttccagcacgttttcctgcccatcagatggatgctcctctgttggagtctttggaaggttctggtgtcttttgttttaattggtgggctaccgccgactcctatggtgtgattttcattagagaggggctggagagagggagtgttggaactgtcctccaagcccaaccatgaatattaaacataatacaattacagctttcagaccaattatttttcctttcaatgggcaaagttgatgaaatactcgctagatggggattcacaatatctaccattggctcctctttgtccctggaatcggttgtcttggcatattctggtgcccatttgctgtgctacctgtttcccagcgtcgagtatttggtttgagtgctgagctgacgacgggctttgccaaggcgcacggcattcgggcctgtgctgcgcgctgtcagatgtccgaggcagatacctgtttcttcatgtgaatctgaatggcttgggtggacttagcacactgtgctgtctgctgtttctgtcgacgagaagccagagtggtgcttctctaaggagatgtcagaaaaatgtttttcctttttcccaggggggagaaattcaaggctggtttggcctatttttttttccttagtgatataaaatacactgaggccgcatcttttggtttatttgtttattttgtttggagccatccatgctggtatctaaatacaataggaaaacagatggcaaactttgaacttctggaccaaatttgtgtttgcctttgtctccttaacagccaaactgtaaattatggagtataaatattcaacagaggagctctttatg

SEQ ID NO: 71712 - DNA, 1012 bp, Homo sapiens
cacctccttcaggctgctagagttgaggtgccccagtcattccattcctgtccccatccagggatgagagggggcttgctgcacttgggacagggtctgtgaggccagaaatcccctcgtgggcacgccccatcggccagcagataacaagagccatttctgaaccacctgcctccagcccgaggcacagaccgcagtgcccagatggtggggctgactgagatccgtgcccggggcagcaaccctcggtctgtgttgatcaaaggccagcagccccacaagacgcatcagcctgccccttctgggatcaggtttgcaccaactcatcgccaaccctgatcgttcccgggatgccacagacaatgccaggagccgggcaggagagcgccaggtgatttctgcatccacgctctggcggaaatgagccctaaccctgccaattagaggacaccctcagtgattatgcacaaatgagctttcttctgagcagtgtggactgggctcacggtaactcaacctcattttaattagctgtttagataagcggtggcccaaagcttcaaagacatcaggcaggcctcagtggcccaaacaggggagcacatttgatgtgtgcccatcgtggccacatctcccaaactaaaactcggggcacaggggctgacggaagatgatttatttataaaaacactttacgttaatgaactgcctttgttgaaatgaaccaaatcaaagcaaactgggacagccccagaaaacctgaggcctgcagtggcagtgccagtatgccctcctgctcagtggtaccacagatcgtcctgctcacatgggcacggcagggcaaggtgcatgggggctggaagagggaggttcttgcagtaaggccgatccccaccaggctgtcctagtgactttctaggtgccttccgccagcagccaggggaccaagaagctcccgagcagcaggggaaggcagggagagcaggtgagggggatcacgtcccacttccct

SEQ ID NO: 71713 - DNA, 1012 bp, Homo sapiens
cccttcttggagtatgacagggctgcctccttttgtattgctttataacatctcatcacctggatatacccattttgtttttgcactcaccagttgttggacattgagtagttgccatgttggtggttgtgattgtgaatagcttgtggtggtttttcatgacatgaacaacctcacaagggaggacatcccgttgtcacctctgtatcacggaggaggaagcagcctcatgagttcagggtgacagctgagtgggatgcatagcagagactcacagcagcctcccccggcagcactgtcaggagctcacctttccatccagcctggctcacctctgtattccgggatttccccagtgtttgggttgagtcctggccaatctttcaagaggtggcaagcaggagagagctggggtcttggaagtcactgagccccccagtgatgccccttggtgtcctggggctggcatccaggctggcacagctggtggggccagtgggaggcagggtggcttggggagtccctggggcacgggagaaggctctcagctgtgcttgcttcttccagtggggccttgccctgagcccttccaccttctgccttcccgaccctcaccctgggcggctgcacctgctgtctctcagtctcatccacacccacgctgtctattgccgggcacttcagatctcgttccctggcttggtgtcctctgtagactcagggcaagtccaaatgtcctggactgatagatgaggccttcacgcccccaccaccccagctgcttcattccctgcctgttttctacccacactgaagagcccgaggctccctgagccctgtgtgttctgcctctgccaaggctatgccttctgccagccctgtccaccccacccccagaaccccattgggcatcacctcctgctcccatccccgtggcctagaacctccgctgcaaccctggtgccccttggccagctgaagcagcgtttactgtcctggatcctggcgaggg

SEQ ID NO: 71714 - DNA, 2183 bp, Homo sapiens
tattcactccattcccctgtctgtctgcatttgtctcagaacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacagttttcccttccatattcctctcttgagtttatgcacatctctataaatcattagttttctattttattacataaaattcttttagaaaatgcaaatagtgaactttgtgaatggatttttccatactcatctacaattcctccattttaaatgactacttttattttttaatttaaaaaatctacttcagtatcatgagtaggtcttacatcagtgatgggttctttttgtagtgagacatacaaatctgatgttaatgtttgctcttagaagtcatactccatggtcttcaaagaccaaaaaatgaggttttgcttttgtaatcaggaaaaaaaaaaattaatgaaccttaaaaaaaaaaaaaaaggttttgaagggaaaaaaagtggtttcacacctcttgttattccttagagtcacttcaaggcctgtttgaatgtggcaggttagaaagagagagaatgtctttcatttgaagagtgttggacttgtgtgaaaggagatgtgcgtgttggaatctgcttttccaagccgccagggtcctgacggcagcaggacgaagcctgttgtggcgtcttctgggaaagcctgaccgtgtgttcggacggcactggctcctttccgaagttctcagtaactgagcccagagtaactgcacgcctttgtgcagctctggagctccaccaactctcggcctgccagttctcaagcgagctaatcttgtcattaatcgatagaagctaacttccgaagttaggacctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaatggcctgcccaatttcgtttgaggacagaaagcccagccatgacttgagtagaatgtctctcacctctcttcggatctaaatatgaaaagtatgttctgctgaatttttctgagcattggtgagcggacagcctacctgtaaaccatgacctccttgccaaacgttaattttatcagctcactagtaacctttga

SEQ ID NO: 71715 - DNA, 1727 bp, Homo sapiens
aagtgctcagctatctgagtgggatgtggagtagatggatagtagttgatacaaaggtctagagttcaagagagaactctggtctggaaaataggagttttcataatatgtgaaaccgtgaggaactcaccatggcagtgagtgcccaggcccaagtggcccaagcagggggaccagcaaaaggttctagatgcctccccatcttctgaacctcccccagctcaattcctttttcaggctgctcttccatttccttttatgaaagatacaggcaagtaagtctgaagccaggcagataactgttcctcagatttcagtacaactaatttagtattatattacaattcaaagactgctatttccattataattattataagagaatgaaccaattatatttttcttgttaagcaaactacatggtatgttagtgtaatgtgaaaaatagataactgaaagttttcaaatcttaattcttactgactttttgtttccagaaaagctttgacctggaaatactacgcaaaaaaaattctttactacctgcggcaacagaagatcttaaataatcttaaggcctttcttcagcagccagatgactatgagtcgtatcttgaaggtgggtcttttcccatatatgtggacagtagtatttctgtaggtaactgattagttttttaagaccagcagagggaattgtgttccttgtggtaaagaagtgaaaaagcaaatcatgttgcgtgggcttctgcaggttggattatagggcctgatcaatgaggtagttcaaactattaaatttagagctaagattttatcaaagtccactaaagaaatagtgttttttaaagatgcatcattggcttaaaatgtgagagtgatactttagctaatgaagtaaattcctgtttttccgagctttaatgatcatttccaaatcagaagtaaatgtatccaattttgtctccctgtgaccttgagtaaatcccttaacctctcaggttggagtttattgaggacagaatgttcttgggcatcagtgagtctgcttgtccgtaatgaaaggtgagaaggaagaagttgagtggacaggcaagatgaagggagtggagaatctttttgttcttattaagttgaacaggaacaaagtgagacttccattttttttaaaatgattttgaattcctacaatattacacaaacattcccataaattatggttatgaaatacaaatatgactggtcgtttacttttattccctacttctgatgttttaccagattgttgatttttttttccattccagtgtatctcatagtcatgttcccattctgttactattcctttttttaaaaaaaatgtatttatttttagagacggggtcttgctatgtcacctatgctagattcaaactcccgtgctcaagtgccaccacacctggctggcttctgtaactagtctcatgcagtctatggccacctctcctggcaacaactttctgagtaatacttgctttcatgaacattacccccccttccctccaagtcagccaaaataccagtgccagccccattagaaatctagccttcaccactgcatgtgaaacctgcaatgtggacaactgatttcccttttatatttaacctctacctgcttttcaatgccctgcataatctggtccagacctttgctccgtactctccaggatgtcccatttgctccagcc

SEQ ID NO: 71716 - DNA, 1380 bp, Homo sapiens
agtcttgctttgtctccccggctggagtgcagtggcgcaatctcagctcactgcaacctcctactcctgggctcgagcaattctcatgtctcagcctcccgagtagccgggactacaggcatgcgccaccatacctggataatttttgtatttttagtagagttggggtttcaccatgttggtcaggctggtcttgaacacctggtctcaagtgatccgccggcctctgcaaaccaaagtgttgggattacaggcgtgagccaccgtgcctggcctcacggaagtttctgtatctgcccctgatccctttttgtaactctggaaaataatccacactaatgttttgagttcaacaaactattcgatatttatttctggttggggttctagaaatagagccaatctgatttatttcacttttttgttttcctaaagactcctttggattctctaattttaattactgttagttaatggagttaataatttgaaatgttttcaaggcttttcaagttttgaaagggaaaatttgaactttggacaaatttgaatgttttcccctatggagaatacaaatagacattccttagtgtaattggtttctataaatatttattagtgttagaataaacaaaatttgtattttactttggagaagccatgccctggctaaaagcattcataatcacaaattgtaaatgctgatctgaatgtgtttgcacatacgtagattttggtactagctatgtttggtgcagttggtcatggactatgagcctgcaacctccatttctagtccagctggttttgtgtatgttttgaacagtctgtgcctctgtgtaataatgatggattgttgtgttttttcctcagctcccccttttcctgtaccactgcttaattagaagtatgtcaaggactttgaacacagcgggagcatacttaacattaatctgtgggtgggtgattgctttggcccgggatcttggcgttcctgtgttctcagaatgcacacaggttgacctgaaatgttctggctacttgcaaaaagaaaactgagagaagccatagaattttaaactcagaagatcttttttttttttttttttttttttttgagacagagtttcactcttgttgcccaggctggagtgcaatggtgtgatctcagcttaccgcaacctctgcctcccaggttcaagtgattctcctgcctcagcctcccgagtagctgggattactggcatgcgccactacgcctggctaattttgtatttttagtagagatggggtttctctatgttggtcaggctggtctcgagctcctgacctcaggtgatccgcccacctcagcctcccgaagtgctgggattacaggcg

SEQ ID NO: 71717 - DNA, 1004 bp, Homo sapiens
ccaaagggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttatgcaggaatgcttttccatcagggaataaatacttagaagcgcttacaaggtgccaggcacctcctttctgcatgtgcctgcctttctagtagcagacagatggaaacattgtctcattttgtcaaggagtccaaagaaatgattataaaaccaggattcatccttcttctccagaaagatttttttttaagtaaacacctttcaatccccaacacaagctgcttcacaactccaggctagaaggcaggagagcgatctgatgtgtttctttcatttgccagaattcctgataccaaaagcctctctctctgttgagtaacctctcaaggaccagagtggagtccagattgttaggctcagatcaagggtggggaaatactgccctctcgtggtggcttttcatccaggcctcgtagccaaccgtttaagtgcaaaatagaattaagcaatgggtaagcaaaatagggttgacaagatatttgggggttattcgggttatggcccatttatttccctcttccccctgaattgaccagtagcagctccagccccatttcacaaaagtgagtttggccaggag

SEQ ID NO: 71718 - DNA, 1046 bp, Homo sapiens
cttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacaggtaagctccacaggggtgtgtgtgtgtgtgtgtgtgtgtgtgtgcatgcttgtgtgtgtgcatgtgcgtctactgagactcagcctcatagcccagaagccaacctgggctgtctcagatacctgtttttgcataaccacttgacggcccccttgatcttcacttaaaattacattcacaagaggccacagggcatagcttctaggatgcttctcttgtcacaaaacccagagcgaattaatcatcatggtagcagacagtgtgtcttctcatctttatcccctataatcctccaggaaacttacttgcatttttgcaatctatgtttcacaagtgagaagacggaggctcggagtggaggctgcccttcctgaggttgcctagcaagtgggaggcgtgtgtgcgtggcaccctggggtgtgtggctctgcaaaaacccttggaagacaggagggaagagctgagccctgggcaacccttagcttaaatcagctttctcctcattgcagccag

SEQ ID NO: 71719 - DNA, 1055 bp, Homo sapiens
ccatttacacaaccacggctgctcctatgcaactgtgacagagccagctatttgcaacagagacgatgtggcccacacagtcaaaaacttttacaatctggccctttcctaactttgctagcctttgatagagaggattggatatggctgtcaggggaggaacaggagcctttgatagagagggttggatatggctctcaggggaggaacaggaagttggagggggagagaacttgtttcagcggaagaaggccagcttgccccaagatgcagcgggctgcctccggaagtagagaactccctgtccttggatagggtggagcagatgttgactgcttggcctgtgtgatatggaggcaattcaggccctgaaggctggaccaactccctggactttaaaactcttcgtttgctaaggggggccataataacaaaatgtcacacactgagtggcttaaacaacacgaatttattcctcacaattcttgaggctggaagtcccaagatcaaggtgtcagcagggttggtttctggtgaggcctctttctttggcttgcagacagctgccctctgatcgtgacctcacgtggcctttcctctgtgactgcacatccccagtatctcctcctcttctgataaagacaacaatcttattagattagggttccaacgctctgtgattttattcccatccccggctttctttccccacactggttctcaatcttgagtcccgaaatatgccctccctatcctcatcctgtgcctaccttcacttcacccatccatcccctgcaggctggtcttgttccactgtgccaccatatccccaagcccccctcacctccgtgaggctcctaggactgctgcagcaaaccaccacccactggggcctacaacaacagatgtatcatctctcacccatctggatgccagaagtccaaaatcaaagtgttagcagggccatgttccccctgaaatctgtaagggaatccttcctggcggcttctgaattcctggtgctttcctggtcatcattggcattccttggcttg

SEQ ID NO: 71720 - DNA, 1030 bp, Homo sapiens
agacagcaaatctgaaaaaataggaaactgttgccatcaatctgtctgtctctctgccgtctgtctgtctatctatctatctatctatctaatgatcaatcaatcgagagagagagaactgagaaggaacacccaacccagtctaggagggaagagggagtattagggaatgctttctggaggaagaacacccaacccatgccgaaatgaattaggatatcaaggaagacttcctggaggagaggacatcagagccaagtcataaaagacaagtagggtttagccaggcaaagcaacagagggtattccaggtggtggagacagcatatacaaagagtgagaaggccccagggccagaccaaggtgtgtgtgtgggtagatattgggtaccatgttaaggacattgggtcttttccagcatgtgatggaaaagcaggttctaagagagtgaggtgagggaatgataagttaccccgactctgtgggtaggagagggcattatacacgtggtagcatttgaactggaccatggagtatgtgtaggggttcaccaggtggaggaggaagagaaacgatagaaacactctgtgaggggcagctttgccgttccgtgggggccactgaacagggactctcctgggtccctgccctgtctccttcatctattacagcatttttctatttagttactccagagcaaaagggatcagtgctagacacaggggggcaaagggaaatatctgcgtggggtttctgggtggttctggtgaaagggttccaagaaagaggtggatgaagcaaaagtgaagatttagggctcagttcttggccaccccagtgcctctgacctgagcatgtcccaaatcgaacttctcaggatagtggcctcggggtgggtgatgatgtagggttgggactgacatgcagggtctggtgtgggtgcagttgagagatgcaccctggtgccgtactgcctggtttcagggctggcaccaccttcaccacatcccttatcttctcattgctttgg

SEQ ID NO: 71721 - DNA, 1071 bp, Homo sapiens
gcagagagtggttctggggagcttgaaatgatctttggaaagcatgataaaatgcagatttgtgggccccaccccaaaggacttgagaaacttttgagttgcgggtacttagtctgatttagtgaaaaaattgagctatagactttttttttctgagacaaggtcttgctctgtcacccaggccggggtgcagtggcgtgatggctcactgcaacctccgcctcccgggttcaagcgattctcccgcctcagcctcccaagtagctgggattgcaggcacccaccaccattcctggccagtttttgtatttttcgtagagacggggttttaccatgttggccaggctggtatcgaactcctgacctcaagtgatccacccatctcagcctcccaaagtgctgggattacaggcgtgagccaccacacccggccaatagacttttttttaaaagggaattcagctttaaaggtttcagaatacgttagagacgagatctttggttgcaaacaacagaagccaactctatctaacttaggctgaaaatgaacttgtttgggatattatgggataactctcaggattgacaggaaagctggagacccaggctcagaaaggggcaggacccaggtgtctttgggctctaagtagcagggatgacttgacagctgattttgggagggaccactactagattgagcttcaaatatttttttccatcgtgtgtcatgctgttgaagattcatattcccaagagagactcagattggtctgattggcacctggtgagttaggggaaggcagtgtaccctagttgacacccccaataaggttgtgcacagagtaggagagagaattccccgaggtggagtggggtgaatgctagacggtcacaaaaccagtgtcctctgcaagacagcagtacaggctattggctcagatattgaaatgcctgagtccggctgagcaggaataattacatagatgaacacgttaagtgacaatttgcagcgagcccaccctctatactgtttgatcccaaataagcaaattttctaccctaacaagttca

SEQ ID NO: 71722 - DNA, 1051 bp, Homo sapiens
ggacaggcttaccgtggacgcctacccgggcttgtgcccgcccccgccactggagtcgggccaccgttccctgcccccatcgccccggcagcggcacgcggtccgcaccccgccgcgcacccccaacatcgtcaccaccgtgaccccgccgggcacgccgcccatgaggaagaagaacaagctgaagcccccggggaccccaccgccctcctcccgaaaactgatacacttgatcccgggattcaccgcgctgcatcggagcaaatcccacgagttccagctggggcaccgcgtggacgaggcccacacgcccaagtgagtgcgatcggtgggtgccctggggcggtcgaaacccggcctgcgaggggctgccccttggtcccaggaactgcccaggtcaaggaaaccgggaacagacttgcgttccagactctggttgaatgaaaaatggcttttcacagagggttctgagcaaatgaatagaacagaatttcccagaattggccgtttaaaaaatacgattaatatcctatggcctaggggctaaatctgatacccggcctgattttgtaaataaaaggtattggaacacgcccatgatcattcctttatgtgttgcctatggctgcttttgtgtgacaatggcagagtgagaatagcccacaaagctgaaagtatttaccatctggctttttactgaaaacgtttgccaacccctgcagagtctagcctagtgccgctcctagaaataggatatgaggcatatattaaccttcaactttctagtagtcacattaaaaagaatgaaaaggaacaagtgatattaatgatcataatacatcattcaacccaatatatcaaaattataatatcttaacaaagaatcaatgtaaaatatcattacagagatattttgcattttttaaaatacaaagtctttgaaattgaatgtgtattttatatccacggctcatctcagttgaaggtggtaggaagcaggacacgttggggaaattgacagaggacccctttgggggagagagcaggtgtg

SEQ ID NO: 71723 - DNA, 1046 bp, Homo sapiens
gacagggcagccacagtcctgcatttggagtagagatgcaatactatttataaaaattcactttaaaagcaacttctcatgagattgatttttttttttttttttttttttttgcacatagcacagatgtcagcaaacttttctttaaagagacatatagtaaatattttaagctttttgggtcatgcagtctctgtggcaactacttagctctgcagttggagcacaaaagcagccacagatgatatatatacattaatggtagtggctgtgttccaataaaactttatttacaaatataggctgagggccagatttggcctctgggcagtagtttgctgacttttggtatataggaatttctaccttttcccagaagccagtatgggaaaaaatgctttgaaaagtctgaaattggcctgtgaagatggaatcttgaaaggctggagacaaaaagagaagagttctaaaagaaagcaatggaagaattggagataatgtgttgtgagagctctttgtttgagaggcataaggacaaatgagaaagacaaaagatattccaattggtttttctatgtgtatttttgtttgtttttgagacagagtcttgctcttgttgcccagactggagtgcagtggcgcgatctcagctcactgcaacctctgcctcccgggttcaagtgattctcctaccctcagcctcctgaatagctgggattacaggtgcccaccatcacacccagctaatttctttttgtatttttagtagagacggggtttcatcatgttagccaggctggtctcgaactcctaccttcaggtgacccacttaccttggcctcccaaagtgctaagattacaggcgtcagccaccgcactgggccgttatgtggtttttcttgagacagggtctcactctgttacccaggctggagtgcagtggcatgatcatggctcactgcagcttcagcctcccgggctcaagtgatcctcccaccacagcctcccaagtagctgggaccacaggtgtgcaccaccatgcctag

SEQ ID NO: 71724 - DNA, 1064 bp, Homo sapiens
ccctggtgtttcttcaacttgagacgtgttccttttataaagagaaaatacttttattgtattcatttattaaacttttttttagagacaggatcttgccatcatccaggctggagtgcagtgacatgatcactgtagcctcaaactccaggactcaagtgatcttctcacttcatcttcctgaatagctaggactacaggcatgcaccaccacacccaactaattaaaaaaaaattttttagagacagggtctcgctatgttgcccaggctggtctcgaactcttgccctcaatggatcctcctgcctcagcattccaaagtactgggattacaggcatgagccactgtgctcagcctggaatagactttaagatatattgtatagtcttaattttattataatgttacttaaatatctatcaacacaagactagttcttaactgggggcaattttgccccctcccaggggacatttggcaacatctggagacatttttcattgtcacgactttggggaggatggtgtgctactagcatctcatgggtaaaggtcagggatgctgattagtatcctacaatgcactgaatggcccatcacagcaaaggattatccagccctaaacatcattagggcccaggttgaaaacccatgtacaaacccagctgtaaatgtcttatgtttatagatatcaaacaattatgcagacaaaacagatttgcaaacattaaatacgatctattttgcaaaaccagttcattctagtagatgacatcagtgatgaaaaagatattttggtgaaagtaaatggtgcgttgaaacttgaatggggcgcttctattctggtgcacattattttgtctttggtgagcctcaggtatgtgtctttcgtggcttagttatcctgtggcatgaggaagaaagagtggtaggagtgacttcattggccttcactatgggggacctgttttagaaccaagtattaaatgtgccttggttctactctgattaggcagtgattattaaatcagtgcaacttggcaccaaaagaatcataaattat

SEQ ID NO: 71725 - DNA, 1036 bp, Homo sapiens
gacttgaacaggttatttgttcacttgtgttcatgacagcattatttgcaatagctaaaaggtggaaccaacccaagtgtccacgagcagatacatggataaataaaatatgatatacccataccataccatagacacacccatattatttagccttacaaaggaatgaaggccaggcgtggtggctcatgcctgtaatcccagcactttgggaggcccaggtgggcagactgcttgagctcaggagttcaagaccagcctgggcaacatggtgaaacctcatctctactaaaattacaaaaaattagccgggtatggtggcgcatgcctgtagttccagctactcgggaggctgaggtgggaagattgcttgagcccaggaggcagcagaggttgcagtgagctgatactgcaccactgcactccagcctgggtgacagagggaaaccctgtctcaaaaaaaaaaaaaaaggaaagaaggaatgaagtgctgacacatgctacacaacatggataaaccttgaaaacatgatgctgagtgaaagaagccagatccaaaaggacaaatactgtatgatttcaattaagtgaaatatctagtgtagtcaaaatcagagacagaaagtagaacggtggttgccaggggctgagaggggagggcagtggcgagttatggcttaatgggtacagaatttcattttgggaggatgaaaaggttctatggatggatggtagtgatggttacacaacactgcgtatgtgcttgaggccactccgctgtacacttaaatggtgtattttatgttatgtatattttaccagaataataagggggcaaggagggcagaatgactttctagatgctaattttatacgagtacacattgatgactttgctttcacataccagcttttagtgggtgcctaggaaaggcctggttcctttttttttccttttttccagactgagtcttgctctgtcgcccaggttggagtgcagtagcgtgatcttggctcactgcaacctctgtccctc

SEQ ID NO: 71726 - DNA, 1025 bp, Homo sapiens
agcccctttgtttgcgagtgtgagaaacttatctcaaactggttcaacaaaaatggggagttctttggcttgtgggactgagatgtttatgggtagcactggcttcagcgtggctagatccaggtacttgacaaagcaaagccttgtctacacctctcagtttggctttctttctggattgctttcatccaaacagcctttccttacggtggcagaatggccactggaagtgccacacttgcattttatcaccttgcttgtaggaagagcgtgattatttctcagtggctccaacaaatttctggggtatcctattcaccagccaggagtgcttcatttctctactcctggagtcaaaagggagcggtgttgtcatgggtcagttctggagccagggagcgagatcagtcccttccaagccctgtggaccaagcagggatgttctccaaacaaaagctgggatgctgttactcaaagataatgagcttggctggaggatacaatagattctgttgttccaatgtagccagaattcttaatccagaattccagcaaatgcagaaaattctaagtagggcataaggatcaaaagggtaaagaacatattactaggaatgtctggatattcagagtgggatgtttcagagtttgcaacgtcggctggatttaaataatagctctccctccactcatgcactctgaagccaagtgtggtcacacatctgccctcccatttaagaggcgccatgtatcttttttgggatggtgagtggatggagaactggagcacggtgctgggtcccagctctgccaccctcttgctgtgtgtcgcttgggcaagttacataactttactgagccacaggatactgggaggatcaagggtaagaagattttaaagtacttgggaaactgtggccccgcaatttagggcttggttgtagtgtgccataaccataaaccaaagtactttatgactttgctgtttatcgggtttcctgataaaatataggatgctcttttaa

SEQ ID NO: 71727 - DNA, 1177 bp, Homo sapiens
taatgataaagtctaagtggtaaataatatgggggacaatgtgtgagcccattaggcatgtgttcagctgcatgaaatggaaaacccaatcctagcagtaaggcaaataatggtttctcttcatgtaacaagaattctggagacatatagctgcttcagttggctcagtaggttagtaataccagggctgatgtctttgggaattctcatggcttttctcttatggttgcaagatggttcctgcagcttcagcgattacatctgagttcaaggtaggaaagaggaggacctggtgagtgtgaaggaataaagggttccccaggacatctcttcctcctcaccttgcagatgatttgattatatcttcttggccagaactgagtcctagctgcaagggagcccgggaagtggggaagtgggaccaccaccaggatcggcttagatggatcatgatccattgcctgaaatgacatgttgccactccatgcaaaatcagggctctgctagtgtggaaggaggcataggtagatattaagtaagtggacagccagcgatggcagccatggcacatagtcagaagatattttggtggaaaagaaagttcatgaacgttgagtcagactgatatagttgtaaattctagcttgtctttttactttatcttgggctagtgatttaagttttctgatttatagttttaagtttttggcaaaacagcaataattaaataatattccctacttcagaggatggttataaggattgaaagagataacgttttcaagggtctagcactatctggaacagagtggctgcaggtgctaaatgaatgacagctgtgatgatgataatgattggcattacatggtgttgactagatggcatggaagggagcagttcagattggacagagagaaggaggagcttgagtagcatttccaaagtatgttctgtagaaccctaaatctgtgggatgttagcgtttttaattctttcaacaaatgctgacatccaggcactgtacttaatgctggtagtcaataagtgttctgtggacaaaacaaattctgtggttaataagtttgggaagggttgagttaagcaaagggaaacaggcatctttactgcaggacttttctcagagcctttaatatgctacctatgtgtattaggcctc

SEQ ID NO: 71728 - DNA, 1110 bp, Homo sapiens
ccttggcaggggtgggggaaggaagtgagtgatgcctgggccttccctgggggctgacacaggctggcagcatggcccacctgtagggtacatctcacaggtggtacctttcctgcagccctctccaggtgcctacagccactcccttcactaagcccttcaggctcaagggtgacaggtattgcatagccccatggttttcctatatcacacctttaaaaagatcttgtttaattctcttcaaattgctgcatttgagtatgccatctgtatattgctgggaccttgactaatatacttagattcaaaaatctgagtattgtctattgcaagaaaagtttaacttactttttagacgcaggtctcagaactttgctgctactaatgtccttatttcagtttattaagaacttggtaacttaggattgtggtagctgaaatttgtatcattctgctcataccagaggtgctgttcagtgtaaccataccaattaattatttctccaatttatgtcagtcattgtcctcaaagggtgggggtaatatagccatctttattaatttagtgaattttgtgtaaaactgattttttattttatgatgatctcttagccatcattagacatagagagctagcctgctgagctggactgatgaggaaatacactaacaccaagaactcacagatagcacagcaacatggtttttgttttgtcttctgtcttccacatttagctgaatgcttcagatgaccgaggaatagacatcattcgaggaccgatcctgagctttgctagcacaaggacaatatttaagtaagaattatttgtgtaatttcgctcccttgattttgattagtaagatgatatgggttaattttttaatcctctccttagccagtttatatgggttgaaaaaaaaagtgactttgtccaaagcaaccatggaaaagagataaacgagagggatggtagtaagaagcgttataatgcaactgttaaaataaaatgttatctacgcttgtattagcaagtttgttttttttttcttttttttttggagacagggtcgccctgtatcgtacaggctggagtgcagtagcatgatctc

SEQ ID NO: 71729 - DNA, 2379 bp, Homo sapiens
ccttccctccctttgccttctttgcaacaaatgattccttttgtttttaaaacattttcttttgctctctctttgttttttgagacagggtcttgctctgttgctcaggctgaagtgcagtggcatgatcatggctcactgtagcctcgacctcctaggctcaagtcaccctcctgcctcagcctcctgagtagatgggactacaggtgtgcaccgccacacctggctcatgattttttagtggagacagagtctcactatgttgcccaggctggtctccagctcgtgggctcaggcaatccacctccctcggcatccctaagtgctgggattacaggcgtgagccaccatacctggcctgcaacaagtgattttttcaattaatcaaaatacaaagtgaggagggggaatcctgcaggttatgagaccaaggtcttaccagctgtagatttcaaaatttacagattgatcatgcctttgcttaggtctttcttcaaaaactattacaaaacaatgactcaggatttgctgggaccaggctgggcatggtggctcatgcctgtaatcccagcactttaggaagctgaggcagatggatcatttgaggtcaggagttcgagaccagcctaaccaacatggcgaaaccccatctctactaaaaatacaaaaattagtagggcgtggtggcgggcacctgtaatcccagctgctcaggaggcaggagattcgcttgaacccaggaggcggaggttgcagtgagctgagattgtgttgctgcactccagcctgagcgacagagcaagactctgtctcaaaaaaaaaaaaaaaaaaggatttgcttgagaccatacctgcaaaatgttcagagccctacgcatgtctccactggaaagagtgactagtgctttcattccatcttcacttatatcaactctgaaagaaataagcaaaagggatttatgaggccccctgagagcaccagcattcaccaaaggaacaagatggcctggaatgattaaggctttaaagggatgaaggaaggagaggaacagagttaataatctcctgatctatatgatctagaattcactctggtttttagggacctgggcttcacattagtagtcacagccaaccaaaatcgagaacagcctgaatttaggaacaagcattctcccatggagccagtcgtcttgaattctgctctctggggaggacagaggcctggcacaagccatgatcacacagccgaaactcctccttcacaacaagcagctgctcaggtcggctacttgcttggcatctgactacacagaatgtgatgtcttagaaccttcccttctagtctaaaaaggctggaagcatctttgcagaagggactcagcagcctgcagtttccaatgacaaagaagagtaggaggaaattgggacagcttccaggggaggaggatggaatcaagaaaaatgaagtaccaaatgacttttatgaggaatggccttgagacagcagagaaaatgatagcagtggacggtccccagtgcctcccctgtgctaggcactctgcaaagtcgttttccaacattcctctcctctacatacgaaccagccagtgatcccacaagcctgtttctactacactccatccccaaaggcccgcaaaatactcacttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactagtaagagaaaataaaaccacctcatgtcaaagtccattctgatttttcagagagcccagaaaacttgaatttttctgtggtcacaagggtataggaaaagattcaatactgcaaacaagtgaggatgttggccgggcgtagtggcttagtggctcacgtctgtaatcccagcactttgggaggctgaggcgggaggatcacttgaggtcaggaggtttggccaacatggcaaaacctctactgaaaatacaaaatttagccaggtgtggtggcacatgcctgtaatcccagctacttgggaggctgaggcaggagaattgcttgaatccgggaggtggaggttgcagtgacccaaaatcattccactgcactccagcgtgggcaacagagtgagactctgtctcaaaaaagaaagaatgtaaacaagtgaggctgcagcctatgacaagacagggcagtgctggcctgttcagatcagagattagccactcctcttttttcttttttgaaacagagtctcgctctgttgcccaggctggagtgcaat

SEQ ID NO: 71730 - DNA, 1806 bp, Homo sapiens
gccctgtcttgtcataggctgcagcctcacttgtttacattctttcttttttgagacagagtctcactctgttgcccacgctggagtgcagtggaatgattttgggtcactgcaacctccacctcccggattcaagcaattctcctgcctcagcctcccaagtagctgggattacaggcatgtgccaccacacctggctaaattttgtattttcagtagaggttttgccatgttggccaaacctcctgacctcaagtgatcctcccgcctcagcctcccaaagtgctgggattacagacgtgagccactaagccactacgcccggccaacatcctcacttgtttgcagtattgaatcttttcctatacccttgtgaccacagaaaaattcaagttttctgggctctctgaaaaatcagaatggactttgacatgaggtggttttattttctcttactagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaagtgagtattttgcgggcctttggggatggagtgtagtagaaacaggcttgtgggatcactggctggttcgtatgtagaggagaggaatgttggaaaacgactttgcagagtgcctagcacaggggaggcactggggaccgtccactgctatcattttctctgctgtctcaaggccattcctcataaaagtcatttggtacttcatttttcttgattccatcctcctcccctggaagctgtcccaatttcctcctactcttctttgtcattggaaactgcaggctgctgagtcccttctgcaaagatgcttccagcctttttagactagaagggaaggttctaagacatcacattctgtgtagtcagatgccaagcaagtagccgacctgagcagctgcttgttgtgaaggaggagtttcggctgtgtgatcatggcttgtgccaggcctctgtcctccccagagagcagaattcaagacgactggctccatgggagaatgcttgttcctaaattcaggctgttctcgattttggttggctgtgactactaatgtgaagcccaggtccctaaaaaccagagtgaattctagatcatatagatcaggagattattaactctgttcctctccttccttcatccctttaaagccttaatcattccaggccatcttgttcctttggtgaatgctggtgctctcagggggcctcataaatcccttttgcttatttctttcagagttgatataagtgaagatggaatgaaagcactagtcactctttccagtggagacatgcgtagggctctgaacattttgcaggtatggtctcaagcaaatccttttttttttttttttttgagacagagtcttgctctgtcgctcaggctggagtgcagcaacacaatctcagctcactgcaacctccgcctcctgggttcaagcgaatctcctgcctcctgagcagctgggattacaggtgcccgccaccacgccctactaatttttgtatttttagtagagatggggtttcgccatgttggttaggctggtctcgaactcctgacctcaaatgatccatctgcctcagcttcctaaagtgctgggattacaggcatgagccaccatgcccagcctggtcccagcaaatcctgagtcattgttttgtaatagtttttgaagaaagaccta

SEQ ID NO: 71731 - DNA, 1080 bp, Homo sapiens
tctccactaaaaaatcatgagccaggtgtggcggtgcacacctgtagtcccatctactcaggaggctgaggcaggagggtgacttgagcctaggaggtcgaggctacagtgagccatgatcatgccactgcacttcagcctgagcaacagagcaagaccctgtctcaaaaaacaaagagagagcaaaagaaaatgttttaaaaacaaaaggaatcatttgttgcaaagaaggcaaagggagggaaggatttggcactggaatagccaacaggctgtggcatcctctgatgaggtgactcttccggtattgaatatgtgggttcccactgccttgtgcccatagaactttgctgctcacctgcattgctgccttggcaatttcttcttggctccctgcagcttggtggcagctgtgacagccactgtgatctcccctttccccctctgtctacacagagcaccaatatggcctttgggaaggtgacagaggagactgtctacacctgcaccgggcacccgctcaagtcagacattgccaacatcctggactggatgttgaatcaagatttcaccacagcctacagaagtatcctttctcatgacctcctggccaccgagacctgaaggtggccccaggagttcaggttgcagccagcacccacaccttgctggcaaaggatgactggctgcaggcgactctggtcagcttgttgtgggagtgagatgtctgtaggtggagtgggtacttgtctttagcactccagagttcttcttggagggctctgaccttcaagtcagggtaaggcttgaagcagcttcactcacagatgggagaaaagcttaggccttggcattgaagatgcaggaattttcaagtggtcatgatagtgatagctcttgtgctgtgaaatgaaaggctaggaatggtgacacaaagcctttttggaaatgcatttggggctgggtgtggtggctcatgcctataatcccagcacttttggaggctgaggcggtagatcacttgaggtcaggagttcaagaccagcctggccaacatggcgaaaccccgtctctactaaa

SEQ ID NO: 71732 - DNA, 1099 bp, Homo sapiens
tgttctatcaattcccatccccactccttcaacagattttcagccctagatctcttggtcccttaagaaaaggcagctgtgtttggtgtcttttttcttaccctgtgtttggtttctgttaggtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactt

SEQ ID NO: 71733 - DNA, 1074 bp, Homo sapiens
aaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtacctaacagaaaccaaacacagggtaagaaaaaagacaccaaacacagctgccttttcttaagggaccaa

SEQ ID NO: 71734 - DNA, 1544 bp, Homo sapiens
ctggaataccgtgacacgatcgtggctcgctacagcctccatgtcccaggctcgagcagttctcccacctcagcctcctgagtagccggaaccacagaaccacaggtaaatgccaccacatcctcagccccctgagtagctggggctaccatgcacaccagcaccacactaagtttttttggctatttatttatttattttttaaataaagattgggtcttatctcactctgttgcccaggctgatcttgaactcctgggctcaagcagtcctcccacctcagcctcccaaagtgctgggattacaggcatgtgccgtcacacccagccctgcttgttttaaaaggggacttttttttttcttaatggaaaaaaatgaaacagagagccaaaagcttttaactgttgtttttttcttttcttcaatgaaagcctctcattttgaaaagacatgtttttcttcaagcaacaaaggtggtagaggaaattcctcaactttctcaacgagtcatgtaacgttacactggcctccataaagcaccgattaagaaagctaaagaataagatgttgtatttcttttaaaataatttaaaatatattaaattttcctaaggcaggttttgtttgaatgaggtgtcttgattagataactacatgccactgaaggagaacagtacttttaaggagctatttttgtttcgcagtagagttgaaaccagctgattaatccaatgaagttaaacagcagagacagatctcgtacataagagtatcagctaaagtcatgactacaccaattctttacacaattaagacatctttgcaactgttcaatttaagtactatggtttttagataatcgagaaaaacacagttgtaccttaacatctgttgagaaaatacaaataaatatgatgctaataaatggccactgataactcagtagccatctgaatagtcatgcggtttaagaatacatccttgtataatctgacatacaaatttgtcatttcctgcacatgcacaccattgttaaaaaaaaaaaaaaaaagccagtaatagtgtctggatcggtcaggagcacggcctctgagtcccctgtaatttagttaagctaaattaatacctcataccaaatggctccaggaaaactgtcctgcaggtcagaagggagcccaagaagaaaagcacttggccaacatcgaagcaactctgaccacagcaggagagaacttgaaccaatgctaccactgcatcagaaacacaaggataggtactaggcagaagccatcgttcccagcggagggagtgtgagctgctctgccactagagaggctctggaggcctacttagttgcataatcaaaacaacatcagtaactgcactttgaatcaaaacaagcagaaagagttcaacacttgctgttcataactggactgaaaatttaacgtaaggctctgttgccgtgcaagtggaatctcttcctctaagactgactttcacatgccagggagagaaagatccatgactagtacactggaatc

SEQ ID NO: 71735 - DNA, 1291 bp, Homo sapiens
tactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatc

SEQ ID NO: 71736 - DNA, 1753 bp, Homo sapiens
gggttttgccatgttgaccaagctggtcttgaactcctggcctcatgtgatccacccacctcagccacccaaagtgctgagattacaggcatgagccatcgtgcctggccgctgacatttatttttaagtggaataagatagcacttggctcaggtcttcatcagcacatacgactaccctattggcaaacaggactcagaagcagactcagaagtctctgcacatgcgtttcagcaggggtcttcctaaggctgatctggtttattctctcttatagtgagctccttgagcatgcccattgttttaaatcctcaagaatccagaccagttgccttatttaaacctacaccacacgttctggaagagctgtagaaaagggatagagaatcagccctggctgcagggcctgcagatttggtggtggtacctttccctccctccgtttgagtcctaagcactttgcttctgccctaaccaggcacttcttactttccacaggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccagtaaggactgaatccctgctatgacttttttgtggggggactgatgaggaacctgcctgggattagacatgtctcttttagaatctgggacatgggaggggacaagctggataaaaaggcacagtgggtctcttttgagacggagtctcgctctgtcacccaggctggagtgcagtggcgcaatcttggatcactgcaacctccacctcccgggttcaagcgattctgctgcctgagcctcccgagtagctaggactacaagcgtgcgccaccaggcctggctaatttttgtatttttattagagatggggtttcaccatgttggccaggctagtctcaaactcctgacctcaggtgatccaccgcctcagtctcccaaactgctattataggcatgagccactgcgcctggcctggttcattgcttcttagtgatgccttgtcaattaagccctctcaagtagctttgagtgtcttccagtctcctgattcaggtggctgtgtgtacttcttcggaatcagcattatgaagcctcaatatgactctttatttccatttactaataactgtagtaacaagttcagaaagagcctcttatcgaaactgtgctttccaaaatgagtttcatgttctcacaaacttggtctcctttttccttttgtgtctgttgttttatgaagcaaataataggcagtcctataattatcatgtatcttagcctaaaaaagacttgcagtttctactgtggcattaaagtgagggctgacctactttgcataagcaaattagcacaaggaagtgttagtaacccttcatccacaggacacctggagccttctgagatacccttttttttcccagtgtgcaaatcccaagcttttccacgaggggcacacaatgcatcttgagcccttttgtagccagggcagtttggcttcctgcctagggtgatgatggagggtggagagcagccatcactccaggcctgccatcctgtttctttccttcccagccacacccaggttgaccccgccatggatgacagtgacgtccacattagctcactgagatctgtgtgct

SEQ ID NO: 71737 - DNA, 1357 bp, Homo sapiens
acaatctgaccacagtccagcgtcttctcttttgggctgccccgccctttcgtctcatttttgctacttcggcttttggcttcaaaccctttagggatgctgggagaagcagagatttcttaatgaatctgcaattgttaccagtctatcaacttttcatcctgggacacgtaagacttttggggagtggagggaagggtctgtcacccaagctggcgtacagtgacacaatcatggctcactgcagcctcgacctccctgttcaactgatcctcctgcctcagatccaccaagtagctaggacgacaggcatgtgccattaggctctgttaactttgtttgtattttttgtaggacggagttttgtcatgttgcccaggctggtctcaaactcctgagctcaagtgatctgcccaccttgccctcccaaagtgctgggattactggcataagccaccccacccggccacataagactttaaatcctagaaacaagctggccttcggtgaaatctgctgtgacttttctttttgtttctttttaagagttgatgtaggccaggcgtggtggctcatgcccgtaatcccagcactttgggaggctaaggcaggtggatcgcctgaggtctagaattcgagaccagcctggccaacatggtgaaaccccatctctactaaaaaaaaaaaacaattcgccgggcgtagtggcgggtgcctgtaaccccagctacttaggaggctgaggcaggagaatcgcttgaacccagtgggtggaggttgcagtgaaccaagaccgcaccattgcactccagcctggggaacgaaggcaaaactctatctcaaaaaaaaaaagagttgatgttaacacaggctatactggccatggctcaatctatttgcaacagccctgcaatggggtgacctgccttgtgggataactaaataacagatgctccagggagtcacatgcttgctcagaaagttctctcaggttttgatgagtggaaggaaaaagacactcagtttttcccatgagtaagaaagcatactgcaggtttggaactagggcagaacttagaggctgaatatccaccactctcctgcctgatgagttcccttatcactagcttagaaatccccaaggagttggaaaataaactcatcttgccaacaccgtttgtttggtacatgttaatttccaccttcactcacgatgttgcaactgattaatgaggctccttcatttacttcctaactgatggtaacccgcacaaggatcaaacagcaaggtagtcaagagagaaaacgaattcacagggctgtgtagaggtatcctgtcctggaagatctcttaatc

SEQ ID NO: 71738 - DNA, 1014 bp, Homo sapiens
tttcacatttctcccatgtttcgctactatttttatttattatttttataatttaaaataatcgggctttttggggggcagagaaaaggtcttgctctgtcacccaggctggagtacagtggcatgatcatagctcactgcagccttgaactccttgtctcaagtgatcctcccacctcagcttcctaaaggcgtagccgccacaccctgccaacaatagctattttaaaagtattttaaaagagagaatttggggcatttatattctagttagggtagttatacattttttaaaaatcatgtagtgcttttgatattgagcaaataattgatattaaccaaataattatactgctttttgaaataaagtttttagaaactttaacttcagtgaagctaaattctgccaatgaatctgtcttgcctcatcagctctttcccacggtacgacctccctgcttttcacgtaactcatcccttgattcattagcaaactcaaagtatttgttgagcattaggccaggatacctaagaccttagttccagttctgcccctgattttgtgaccccaggaaagttaataacccataaaatggagattttagtatctctttctagaaaaattaaatttaggatattaaaatgaaataataaatatgccttaattcttttggaataaagtagctacaggtgtattccttaattcaaatacagaaattagggccaggtttggtgtcacacgcctgtaatctcagcactttgggaggctgaggtggggtggattgcttgaggccaggatttagtgactaacctgggcagcatagtgagaccctgtctctgcaaaaattaaaaaattagctgggtatggtggcatgcgcctgtagtcccagctactcaggaggctgagatggaaggactgctcgagccctggagttcaaggctgctgtaagctatggtcacaccactgcactgcagcctgggtgccagagagagaccctgtctttaaaaaaaacc

SEQ ID NO: 71739 - DNA, 2169 bp, Homo sapiens
tcaaagtcttccacattccacattccttgtgtggaatggacacatcaggaagtgaccttattcaggatggaagccagtttttatattagtaagtatcacagtcataatggtcaaaaaattcattctgaaggcctttaacttataagcttcatcagccatgagaatcttccatcagagtagagaactgaactaggaactgtgggtcagtcaatgaagaagctccaatctggtgcctactctttcacaagatggtgtgctaggtcctgggagaaacaaagacaaaatgatctgggtgttggaacaaggtgcttagacactgatgacgagggcggggggcagagagaaattggttacataagagagaatgaaataaacaaggtgcgacttatttccgttttgatagtgtgagatcagggtacgcttcttagttgtgaatctaggtgggattattacttttttctttctttcttgttactttgagaagctagggattctcataagcaaaagtgggtccaggtgtgaacgtaaataagccccttgcatgtcaaggagattttgtggccagagtgtggcctgcagggaggggacaagggaaggaggttggaccgatgggctggggcagatggcatgtggtgaaagtcctggtctcagttgcctttatgatgtaggcaggcgggagctttctaatgtatttgaaagaaatgatgtgatgtgtgggtatttcagctttagcagcatctctaggggtaggaagactgatcaggagactgtagcaaaagatctgggtgagatgagatgaaggtttaaccccagacagaggacgtggaagcgggagagatggggagatggaatccatacttctgagtgtgaggaagcagggcaagggctgaacgtttttagccttgatgatggggaggatgcaggcgagtgagagggagcctttgagtttcacatattccttctttgacagcagcaggttcttctgaagaaacctgaaatgcattggaaggccttgctattttggccccataatcagcaccgtctagcatattcctggtctggctgtctctccactttcctccccttcaagtattcataggaaaatgaggcctccattcactgggttcatgggcacaaaggttactgtgagtcatggttaaccagcagtgaggagtgccaggattgagtaaccgtggtggaatgtggcctgtggctgctgttattgccctgggtcatttaagtgacaactccctctgggaatggatagtgtggctctttgccacagggagacagtggctttcctgtgtctgggtggtcagggagcaagggggtgtgtgtttgaagcatgttgtctcctgccccagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttgtaagtattctcgtactggggccccatccggcgcatttccaaacactccttgttcttttgccatctctgtgcccaagaaccagagagagggaaggtggctcatggttcaggaattgatcatgggggtttccagagccccaagttctgtatatgtgaaagtcaattctgtcaagattatgttagccccaagttggctttttttcccatagctttattgagatgtaatttatataccacacagtttgtccatttaagtatacaatacagtggcttttagtctatccacagagttgtgcatccatcaccatcatcagtcttactttatttatttattttttgagacagtctccctctgtctcctaggctggagtgcaatggcgcaatcttggctcactacaacctctgcctcctgggttcaagcgattctcctgcctcagcctcctgagtagctgggattacaggcacacaccaccacgcctggctaagttttgtattattagtagagacgaggtttcgccatgttggccaggctggtctcaaactcctgacctcaagtgattcacccacctcggcctcccgaagtgctgggattacacatttctcccatgagccactgtgcctggcacataatcaatt

SEQ ID NO: 71740 - DNA, 1850 bp, Homo sapiens
ctgctaaatatgaaaatctgacttgaatttgtactctttaaagttgcgtatctgctctagtgggcaggacctagggcttaaaggggaacttcctttctccatttctaagaactgggactctaaaatgagaagctggttgtctgaagtaaccctgcaggtgtggttggggaaggtctgttttcttggatgaaggaactaaactaagcatatcagagcactgtcttaaccagttttatttccctggagatagaattcttttaaaaagagttagggagctggtaataggaagtgcctttcattataactacattttgcagagcttcatatttatatacaagcctcctaggtgatacactgttagcttgcagactttcctatgcttcatttctcctgttgctttcaaagaaggcaggagacacgtttaataacggagtatctggtgataagaattgcttgggcaaaccagctcatctggactctttctcagtcttggaagtgggaagaggaaaacttgtttccttcctgcttcttaaggatattctgagggtacactgatcaataacactaaatttggaatgaaaataccatgtgatgagtttagcctgctgatgcttccagtagatccttgtatagtttcaagatttaagttttccgatttcatataaatttcttaaagtcgaggaccttataagggtgcaatggatgtttgctaaatatgaaaaactgacttgaatttgcactctttaatgttgcgtatctgctctagtgggcaggacctagggcttaaaggggaacttcctttctccaattctaggaactgggactctaaaatgagaagctggttgtctgaagtaaccctgcaggtgtggttggggaaggtctgttttcttggatgaagggattaaactgagcaaatcactagaagtatgccctgtcccctgctcagaacactggggagctcaagagtgggctgcaatgtgcacccctcaggaatagctgtgaattgcaggtctactggctttttgctttttgtcttttgctgcaaggtaccccacgtacttaaccattctcaacagtgtaaatcagtgtcattttagaatgagatactcagcttgcttctaaagtcactgaattactgagtgagtctctcctttagagtcttcggcaaccaaattccagaattgaagagtctactactcagaggcaacaagattaaaaaaagaaaacacaaaaactgttgaggtgaaaaaaaaaaaaaaccctagctaggaacacagagaatgttttgtaggatcactgggatattttccacaacttcctcttctctagcacacacatctgttgataggaaatatttgagggtttttccactaccaaatgggagcttcatggtcctggtgtcaaacactataaacctttgaccagctgagctgtgactgctgtcacatatctgagtcctgtgtgcacagtaatatcctgggtcaggtaaaatccaggtcttcaagttttaaggattttttgaagaattcgggcttctttaagacgatccatgcccaaatccacaagcttgttgacagtggattacagtttgtgtggcaaagtccaagttgttacactgtgctttaaaaaaaatcttatctgcatgtattgttaacttagagaccatgagatctatttatcaggaccaggaagatacacacttcaggtccattgcaactgacttttttcttgtttttctcaaaccctggtggagcctgggaagggggcctccacaattctgtggctttgatattagccccaattctcacaagcacatacaagccccataattgccgcaggaaaacacaaga

SEQ ID NO: 71741 - DNA, 1038 bp, Homo sapiens
gacggggttttaacatgttggtcaggctggtctcgatctcccgacttcaggtgatccgccctcctcagcctcccaaagtgctgggattacaggcatgcgccactgcgcccgggctctagtaccaattcttaaatagtgcttcctttgctcaagaccctgtcatatatcaattatacttacgtgtggacccgttcctggactctctgttctgttccgttgatcactctgtttatcatggcattgataactctcaacactcttacttaccatggccttagaaatagtctcagtgtttggtagacagagagattttaactttccattgtttgttcacattccctgctccatctgatccccacaaactctctgaggttgggtgataaaatatttatctggcattacagacaggtcataagccttacccaaggtcaggaatcaagacaagaactggatccacgcagagaaagggaggtgttgttctaattgcacacatatctgatggaagaatcaatggtgtgatttgtctttacagaacctttaaatatcggggggattgtgggaaccattgtgagcctccttctgctgggactggccattatctcagggcttctgttgcattatagccctgtgttctgctggaaaggtaaggactccctgggtcctttagcttctcttccagacttttgaaaaggtgcgggatggggaaggatggcccctgccttgctcccacctgaagttctgttctctgggcttctttgctgggtcaagatacacagtaataagtcacctaagtaccatcccgggacaccctatcacctgtcatattgagtcagttttcttatttgttcctctagtaaatgtttgcctgattaagaacctgtcaggttgaagtggatgttactggatattaatggtttttcctttctctcttcagtaggaaacacttccaggtgagtgttccctagaatcaaaccaaacacccattcccgcatctgtcttcacttctgttttgttcccttcctttcacaagaacaataa

SEQ ID NO: 71742 - DNA, 1178 bp, Homo sapiens
gatggtctcgatgtcttgaccttgtgatccgcccacctcggcctcccaaagtgccaggattacaggcatgagcctgacttttcctgaggtcaggagttcaagaccagcctggccaatgtggtggtgaaaccctgtcccttttgaaaatataaaaattagctgggcgtggtggcacgtgcctgtaatcccagctacttgggatgctgaggcaggagaatagcttgaacccgggaggcagaggttgcagttaggcgagatagtgccattgcactccagcctgggcgacagagtgggactccgtctcaaaaaaaaaaaaaaaaaaaagaacatatacctgatttttaaaaaaatcctaatacaggagtactgtccaaaaagggacattgtttagaaattaagaagggtagtaacagcctgatcttgccttgtacaggattggaggctgttgtcattggagaagttcatgagaatgttactctgcactgtggcaacatctcgggactgaggggccaggtgacctggtaccggaacaactcggagcctgtcttccttctctcgtccaactctagcctccggccagctgagcctcgcttctctctagtggatgccacctccctgcacattgaatcgctgagcctgggagatgagggaatctacacctgccaggagatcctgaatgtgactcagtggttccaagtgtggctgcaggtggccagtaagtggggctggcagggaccggggctggagaggtgctcggagccttggaaaggaggagaccatggtcaggaatatgggttttgggttcggatggcctggaaatcattctgggccctgccacatggaagctgagggacctctcacacctctatttcctcacctgtaaaatggagataaaaagaatttctgtggccgggcgcagtggctcatgcctgtaatcccagcactttggcaggccaagccgggcggatcacttgaagtcaggagtttgagaccagcctggccaacgtggtgaaaccccatctctattaaaaatacaaaaaatgccggccgggtgcggtggcttacgcctgtaatcccagcactttgggaggccaaggtgggcgggtcacaaggtcgagacattgagaccatcttggctaacatggtgaaaccccatctctattaaaaatataaaaaat

SEQ ID NO: 71743 - DNA, 1047 bp, Homo sapiens
ctgctctgccagcttcggccaatcagaggccagggagcggtgggcgtgacgtggggcggtgcgcggggctgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggtacaccgggcggcgggcgtgcagcgagcggcacggcgcggaggcctgtgccggcctcctgggtgggacccagcggagacagggccaggggcggtggggaggttcagcctgcgtgtgtcgaggcccccccaggccagaggtcccggggtccatgtcccatgcctgggggccaccccgagcaccgggaacccggcctgtggcgtggccaggcaggttcggcctgcggcagaaattcattcacttttcccgggcttcagacccaagagggacctaggttcggaaacaggccggatccccctctccccccacaggccagggcgctggagagggacgtcgccgggacagagtaggctgtggctgcccggacgcccccagagcttcccctagggcctcagcattttaggcctggttttggagggctgaagcctcacccgagagcctgtgacgcattatgtaactggcgatgagcgcgccggccgatttctcctttgttaaatgggtcgagagcgtccagccggtacgctggagggcaacggtttagttttggtctttgacctcccacgcccacggctggggctgccgaaagtgaagaaactagatttgcagacgccactgctagttggttatgaagctccgggcaacagcgtaaaataaactgccccgaccttacattgttttggatgttcacagaatttaat

SEQ ID NO: 71744 - DNA, 1088 bp, Homo sapiens
gttatttgcactttcttccagtagttccctgagaccaacgtaacagactattttcccagctcctgttctagaactaaattactaatgacccaggaggcatttggctctctgtgggaaagcagcacaatccaattgtgcttgagtgtcttttagcttctcatgagccatcccctaacacaggacactgacctagatccgcccagccgctgggcttgctagaacggcattgccagccccaggtggaccccaaacattgatattcttgtgagcaagttttaaatataatgatttagatgcattgatcacaggactcagccagccttcctcggtcctcccgtagttcctgtgtgtgtgtgtgtgtgtgtgtgtgtgtgcgcgcgcgcgcacttcatgtgtgtgcctatgtgtgtgtgcatgtcatatgtgtgcctatgggtgtatcgcgtgcacgtgggtgcctgttaggagatgctttccattaagaactgcatcgtgcttctttcagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagag

SEQ ID NO: 71745 - DNA, 1071 bp, Homo sapiens
ggtaattcggtgaagctttcccaaggagatgagtcttaaagagtaatagtttaccaaataggcataaaagaaaaagttgttcctgacagaggatacagtatatgcaaagacttagagacgtgaaagaggatggcacatttgagaaacaatgagtaattgctatggcaagagtataggatgcttgttgagggaaagcgggaggatagtcagggtcagagcctcagaagccaggagtttgaatgttattttgtaagcaatggagagctgttgaaccgtgttttaagaaggaaagcataactggatcagatttgtgttacagaaagatattagcagaaatgtggcaaatataggtaaagagacctgttaggaagccattataatagttcaggaaaaaggtgatgagagaacatgctaatggagatggagaggagtggggaaggttttaagaaatatttaggaggcaagaatagaaataacttagtgaccaatttgagaggtttgacaacagagtagaataggtcattatcttaccaagctagaacaataaaagagtgagtttggatgcctgcaaggataattgactaagttgtagacctggtgtctgcgttttgtgggtgaccaggtagagaggtacagataatggaaacctgcagtttaggagggatgtcaagattaaaggcagaaagctagacttcattgttatatgtgtgcacttgtggctggtaggaatggatgagatctgctggggacgggaggtattcttagagaggaaagaactaaggacagagtctggtagacatcaacatttgagggctgaggtagaagtagaacaaaagtgaataatcagagacacaggaagggaacccgaagagagcatgtcacaggagccagagcaggagtttctaactgacagcgtcacatgttgcagagatcaattagaagaataaactttgaggtgttcattggacctagcactggattcgtccattgcttgtctcggacaatcagtggagtggtgggactgggagacattatagagcattgaatgagggattataaagtgaaatccag

SEQ ID NO: 71746 - DNA, 1052 bp, Homo sapiens
agtgagtagctaaccaaatgaagaaagaagagtatactgtactttcttaacaagtagtcttcttcttttcaccacagtttaacatcttaacagtcctgattcactgctttgtttcctttgctcagatgttctggaaaaattgtgaattttgtccttggaaaatatagatggtttgtttactctataatcccaagtgaagaatgttttttcctaaaattcaaactagtgacatttgcatagtcacctcttctctttggaatctgtctgcttctctcagtcttgtcactacttcctttgtccaagctactaccatctctcttgcctggacctttccagtagcctcccagctatcttcatatgttcttgcctccttcattctgttctccccatggcagccagagtaatcattttcaaatgcatctcattatgacactctcacatgcatgaaatccatttctcctatactaaagatcagtgtccttatattggcctgtaaagcctcaatggtcctgcctacctggccagacttatctcatattacgttacaccagcccctctgaccttctttcagcccttgatggcaccatgtttcctctccaacccctagggttttgcacatgctgttttctctactgagagtattcttccctttccttttccgctggttaactctgaataatttttcttagttactaccaagattaaatattttctattaaattcttctagggccaagtacgtcctcttcaaagcagtgatcacagtaatttttagttcatttctgcggttctttaatttttgattctataataaagacacacggtggcagttatcatggccttttactcacctttgtgtcctgtatcttgcacactgcctgtcacatgataggagcttgttaagtttgtgttgagtgaatgagtgaacaaataatttctgttagtgagaaaccaaagatacagaaactcacaagtgtccctctcacttaatactcaattaatgagcaaataaaaaaaattgggggaaggatgtgcaacactaagcttttctgt

SEQ ID NO: 71747 - DNA, 1015 bp, Homo sapiens
gaccctgaggaagacagtggtagttcctctctctttacacattaagaaactgagagactttaagaggttaagtaatttgcccaaggtcaattatatagtaagagatagatgaggtttttctccacacaatccactgggtagagcaaggtggtactgcccacttttagttgatcacatttttgagactgccattgtaaaaactacagttactacatctttataactttctcccatttcagacttactcaatttgtaatttagacttaccaccctctctagctttgacttttttgggtgttgattccctctattactttataacagaaaatagtcactctttttctgccttggtgatatgaatttcctcaggcaattcaagaaccataggaatccaaggccttctaaaaattaaagaggtaaattatatgtgaaagcactttttaaaccatatgcatgaaaaagttatcagctattattttttattttattgaccaaaaggtgtattcttaaaactcatagtgtacacttaagacacacaggcacatataactgtaaatatcatattttttgtatatttcatgttagacttttcaattgaaatatctggttatacttttatttaaattcatctatccagcttgagcatggaattataaagcttagtatctctatatatatacccaaaaagacaatttgaaacttggaaagtttagttgtgacaaatgaaaggtgatattaggagtttaagaaggtaattatccacattatgggaagcattcaaaagcaaaatgtctctcctggaattcagtggtgtacaatgatagcagattgagctctgtaaattttctttgccacatccttgtaccagatcaccttgtatgtgatctggtacaagtagaaagccaccctctttacagacacccacccaccaactgaaatagaaaattttcttgacacaactcatttcccttttatctttaggcatcctggtttagggaaatgaccatcctgagaa

SEQ ID NO: 71748 - DNA, 1011 bp, Homo sapiens
tcatccttggcactctaaactctctttaatcttttgcttctgaatctcacttctcagccaaaaaattattgaaatattagttgttttgcccaaattaatgttagaggtcacatgggcaggaagagttagtgtacactgcttggctattacatttagaacctatgatgacatcatccaaggccgacccagaaatgatcatttttcttgtcctattttttaaacctgatttctacttctatttctcaagtcttttaaaggcttcgattatctttgaaaattataatggattataacctttaaaaacccaaatgcaaggaaaaatggaagttaaagcacgtacatattgctgtgcctgctgctgtctaaaagcaagcaatttaatttaaactgcttataaataagcccactttaaagttcctttatgtagaagtttcttgtgatctctttgatgagcaatttttcattttaaaggaatgctacactatgtaatggagatcttaaaatgtccactatgtatttgctaatgattgttaggcacctaaaaatgtgcttttgagtctagataaagcatcataagattaccaaatagtcattgtcttcatgccatgatatctgacaaaagaagaaatacggtgctttagagaactatgactacttaccatcgactcttgtgagacttggacctttatccagacccgttcatgttgaaatgagtggggaaatgataacaagctctgagcaaccgagtaccatcagtggttttacatgtgaagcagacattataccaagtggctttccccctctgggacaggttcttttttctctcttgccacaccctcattcccacatcatatattcatgacctctcctacctcccagcaagagattactacagccatgccagaataatctcatgctcgcatctgtgaactcacccagggctactctgtgtgtatatcagccatcacagtcttcttctctgtggatgataaaagctgcttccctactatg

SEQ ID NO: 71749 - DNA, 1050 bp, Homo sapiens
tgcctgtaatctcagctactcaggaggctgaggcaggagaattgcttgaacctgggaggcggaggttgtagtgagctgggatcgttccattgcactccagcctgggcaacaagagcgaaactccatctcaaaaaaaaaaaaaaaagaaagaaagaaattagccatgcacgatgtcaggcacctgtagtcccagctactcaggaggctgaggcaggagaatcacttgaacccaggaggcagaggttgcagatcgtgccactgtactccagcctgagcaacagagcaagactccgtcacaaaaaaaaaaaaaaaagttgcattttatagtaatcttttttccttattctatgtttctttgctttctgacttttttaagtgaatatgaatttttttctttttctttttcaccaaatacccagacttcaaggagagaatatatatttttgagctaaaacgcacatgcaaagatcttcatacctattgtgggaaaatatgcaaaagccaattttttgaagctatgtgaaaaaaagaaaaaaacttttctttcactcttttgaaatgagttctgttaggagctttgccaatgtacatttaatgtccggcagcttcttctgaatggctatcttgggccaaccttagagattaaaataagtggattatgtggcatgatgacagtaatgagctattgatttagccgcaaagctttgctcatagtttcttatttctctgtctgcctggtttccttcaagaactactttattgtgtttctttcctcttccagcggaacggaagccgccccttttcaacatgaatgcaatgagtgccttatatcacattgcccagaatgactccccaacgttacagtctaatgaatggtaagactctgctatcattttaaatctctaagaaaatcaccgtatgtatttgacatttttattacattacattttaaatatctgacctagaaagcatttctttccttcactgtatgttgttacaagtgacactgatgcctcacaagcatcaactgtctacacatgcacacatgca

SEQ ID NO: 71750 - DNA, 1040 bp, Homo sapiens
gcatggtggcaggcgcctgtagtcccagctacttgtagtcccagctactcgggagtctgagacaggagaatggcatgaacctgggaggcggagcttgcagtgagctgagattgcaccactgcagtccagcctgggcgacagagccagactccgtctcaaaaaaaaaaaaaaaaaaaaaaaaaaaaaaaaaatttcctgctttatttaattactttaaacaatatgaaaaatactttatggaactatataaagcaatataatcagatgttccaaagtaattatttaagtactttatgtatattcatcctttacaaatctctgtaaagttgctatgagaattatctccattttacagatgaagaaactgatgtacagataggttaagtaacttccctaagatcaaactgatagtaaggggtggagccagtctttattgaaaataatatactgtgtcatgtaaatcaccaagtagattatattttgaatagtgtttttcaaaattatttgtgtaaggaaataatatctatatcagataaaatttcagaatacccttaagaacagctatttcattgaatcactttcctggagaaattttgtttttaatctccaacttgagttttgtaccttatgtttggtaggatggctccagaggtgatcttagctatggatgaaggacagtatgatgggaaagttgatatttggtcacttggcatcacttgtattgaattgggtgagtaaagagttatttgttttcattgtattttttaaaattctattttgcagatgaattttcattgtatttttaagaatcataatgattaggagttattcatctggctattacttaatgagttactggtatatgtgtgctaggcaatgcgaatttattagatttttttatactcataacacagattgctttctctctgctacattttcatgttcttatttttatttatttatttatgtatttatttatttattttaattttttaattattattacactttaagttttagggtacatgtgcacaatgtgc

SEQ ID NO: 71751 - DNA, 1054 bp, Homo sapiens
atatgacatagttttaaaatctgcatacatgaactcaactatggtgctggtttggcttggttttgtgacagtgtcttaccaatatgcctcaaaacgaggtttcatttgagaaggatagaaagcccactggcataaaaagaaacactctggctttgtataaaatttacaatgactttaaattgtgtagttaaggttggtgtcactgtgtgtaaactgagcaggattatcaattcactgaccaagttcaggttttcgatttcatttgcagtttcttttgaacttttctcttgaggcaaagcctccaggtaaggacagggcagcttctttcaccttccctgactagccaacaagcagagatggtacctttcagtgaaagaaatccaagttcttgtctttgttgagttctgataggttacctagcttgtcagtctggctcagagtttttcaccctattcttttccagattattttccttcctttcctagacacgttggaatttcattatgccttacagaatgacttagatctctgcaaaattacttgtctactaaaaaaaatcagctagtctttgaatttttttctatcaccaaataacatttactaagcaactgcttacacatcataatagagtacagttctgttcaaagcatattaaacagatagggcccctgccctcctaatgaagatgcattatggacaaacaagtaaagtaacatccattactacaacctagggtttttgtaggttttagtatctttggaacagctgattatattgctttatatggctccataaagtatttttcatgttgtttaattattttaaaagaatatggccaggtgtggtggcctatgcctgtaatcccagctactcgggaggctgaggcatgagaatcgcttgaacccaggaggtagaggctgcagtaagccaagatggcgccactgcaccccaacctgggctacaaagtaagactctcaacaacaacaacaaaaaaagactccaggcgcggtggctcacgccagtaatcccagcactttggaagtccgaggcgggt

SEQ ID NO: 71752 - DNA, 1014 bp, Homo sapiens
cagatttttattgttttgattttaaaggcaattcaatctcctaactaaagataagtagagaaaatatatttttctgttgtgaagaaaaataaataatgcatttttttttagttctgtctgccaatgcctaatgtcaccatgaggaaggaaactgaattttcaagggaagtttttataaaagttattttgaagcatttgaaccttatcattttcagcttgacataaatttcctcatcttctctgttttatcttttcactgaccatcaacttccaattcatggtttctagtgctcattacacctcatgccttttttaaaaagaataaggagtacatccacaccttctcattctaaattaccataatgaaaaatgaattttttgaattatatttttaaaactttttgctatataatacctctattagctttagtagtaaccacgtgcaattctttgtagtaatacaatagaaatgtaatttcctaacccctaatccttgtttgttttgatctttcagggtcttctttttactgtacagagttatttttaaaatatcaccttctatataacatgtacctcaaatgccttagagttgcagttacaattaaagacagagagaaagggtcacaggcaagaaagaaaaggtatgtgtgtagttgaggtttattggtaggtggtcaatacggaatcattgcaggtttgtttaggctccaaaaatgtcacataatttggaaaagcagaaaaagcagttaaaattggcaccaattttctcagcacagggaatactattgataactggatttagcctttaagaatatgcctttgtaagtgtagcagctgaataggttttcttgttcgccatgtctgccttttttctcatttgtattccctccctctgaagaaagctctacctttaagtaactagtatgacctacctgcaagtacacccaggaatctgggcccccttacaacatgcagtaattactaaatctccttctggctatctgagcaaggttt

SEQ ID NO: 71753 - DNA, 1031 bp, Homo sapiens
gttcgggtagatcagaatatttattcacctagtattcttagttccttgattggttgtttagttggtttcagcagtttttaaattaactttcattattctgaatattattttaatctcttatagttggtgatggaatattgcttaggctcagcctctgatttattagaaggtaagaaagaaggaattaaactctcctttctgttttactttgatcagaatgttatctaccgccatactaaagtgtagtttgggcagtctaattgaatgatggcttgagctttagggtggtgtggataagccatgcacacttcctctcttcaatgccactgaaagtgtctgagtgatgttagcagtcttcctgctgttttagttcatggcccatccagggcaggtactaccaaaatgtttggctaatgtgatatggtacatgtagccaaaaacatcatattcatgggtatatgtgaaagagaggtagatagtctcacgttatattgatgttaaaccctttcagaaatcttgactgaccccattcctctctgcagatgctgctataaccagaggctgtgttaaaaatttactttaaaaaaaatatcttgagccaggcacagaggctaacacctataataccagctacttaggagtctgagacaggaggatcacttgagcccaggaattcaaggctgcagtgagctttgattgaaacactgcactccagcctgggtaacagagtgagacccctgtctcaaaaaaaaaaaaaaaattaaatcactgttgatctctgaatagaaattgcttattagcttctttcacaaataatgaaaacctgtagtttgaaggggtaattaaagatggctttgtggcagaggaggaaaatgtaacctagaacactccagacattgaaatgttggaagggactggttaatttgggcctggttaattggaatcagtgtggcttggcttgcaactgataagtaaattaacaatgcatcatttaaggaatatcaggctttctttgttttatttttgttttg

SEQ ID NO: 71754 - DNA, 1047 bp, Homo sapiens
gggtttaatatatcaaaccaaacaaaaaatgtcatattcccaaatgacccattctggcttcaccttgtaaactgtccatcaatggagaaccagttaaataaataaatatgatatgaccatataataaaataaccacttaaggaatgaggtaatctatgtgcaatgcaatatgaaaagatgttaaaaatgttttggtcaaaaacaagctataaagtagaatccaatttttgcaaaatagtaataatgtgagtatacgtgtagaaaaaattataaaagaattgcttcttttccgagaaaacaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccagccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagaccta

SEQ ID NO: 71755 - DNA, 1012 bp, Homo sapiens
attacaggcatgtgccaccacgcctggctaattttttgtatttttagtagagacagggtttctccatgttggtaaggctggtctcgaactcccgacctcaggtgatccgcccgcctcagcctcccaaagtgccgggattacaggcatgagccaccgcgcccggccatatgtccattctttatttgggtttttttgtccttttgttattgagttgtgagaccaagaggcttttaatatttgtatgtatttgtattgccaccaagtaaaatgtgttagaaataatttaatggcaaaccttatttttctacaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgtaagtacttaaaagagtcttttagatagatcagattaagaaaggttggactctaggcctggcacagtgactcacgcctgtaatcctagcactttgcaaggccaaggtgggaggaaagaccagcctaggcaacatagcaagaccctgtctctacaaaaaactaaaataaaataaagtttgaactctacatgttctctacacatagctgttgctcgtaaaataagcttggtttcagtgatttttctataaattaaatgatatctaccgtagaggcaaatagtcattgctgaaaagccagttccagaatcctaggctttattcaattcagtggtatttataatcaattgactcacttattaaagtagtataagaaagttaagagcttcagccgggcacagtggctcacgcctgtaatcccagcactctgggaggctgaggcgggcagatcacgaggtcaggagatcgagaccatcctggctaacacggtgaaaccc

SEQ ID NO: 71756 - DNA, 1095 bp, Homo sapiens
ttaagacagtaaagtcattatattatgaagctattgtagggattaaaggagataatatatataaggttttagtgctgcctggcgcatagtatcgattaataaataccaaccgttattatttcaacattaattacaccaaaatgaatttttgtaatatctctacaatataatttacattctataccctttgctcacttaaaatgtgtaactgaatgatttttggtatagtcacagttatgcagtcatcaccacagtcaattttaggacattttcatcaccctgaaaagaaagcctgtatcttttagctatcaccctccaaacccccatctctaaccaataatctactttctgtctttatagatttgcctattctggaaattacatgtatatgtgtgtgtgtatatatggaatcatacaatatatggtcttttgtgactggtatctttcatttggcataatttttacaaggttcattcatgttgcagccaatacttcattcctttttactgctgaataatattccattatatggatataccacattttgtttattctttatcagttaaaggatatttgggtttttccatcttctggttattatgaataatggtgctatgaacatttgtgcacaagtttttgtgtgaacacatgttttcatttctcttgggggtatgtgtgtacttagaagtggaaactctgggtcaaatggtaactcggtatttaagtttgttatgaactgcagggctgttttctaaaatggcacagctaccagcagtgttggagggttctaatttctcagcattttcacaaacacttatcttactttttgactatcactatcctagtgagtatgcaatggtatctcactgtggttttaattttcgtttctctaataactaatgatgtttgaggatcttctcatatgttaatggtcatttgtatatctttttggagaaatgtgtattcaaatcatatgtctgttcttttttttttttttgagacagagtttccctctcattgcccaggctggagtgcaatggctcaatctcggctcaccgcaacctcagcctcccgggttcaagcgattctcctgcc

SEQ ID NO: 71757 - DNA, 1097 bp, Homo sapiens
aacctttagtggctgggcgtggtggctcacgcctgtaattccagcactatgggagaccaaggcaggtggatcacctgagattaggagttcgagaccagcctgaccaacatggtgaaaccccgtctctactagaaatacaaaagttagtcgggcgtggtggtgtgcacctctagtcccagctagtggggaggccgagacaggaggattgcttgaacctgggaggcagaggttgcagtgagccgagatcgagccactgcactccatcctgggtgacaaagcgagactctgtcttaaaaaataaataaataacccttagtaatttaaacagaccacaaatagaactctgttaataattcacaaaattatcagaaaccttaagtaccgtagacccataaaaaacatctcaaaacacattttatgccttcaaagggtataatttattgatttttttaaagtactatatttgaactcaagatagctataaatggcaaaaggttatatgagtttgttgaatgttttttgtgaaattgagagaagtttatatagggaagaaaaaactgttgaaacaagtgaatattattcaaaagtttggaagattttaatattttgtgtatttgagggatcctacattttaactttttttgtataattatattttcaatttaatcttgtattttttactacctggtcttaaagagtttgggaccagtgtaacttatgaatttgtcattgcatagtatcatgcaagtacaagaggaacacaggaaccatgggaggaacttgccagcttaggtaacaaagagcaatatgaaatacaaatggctttctttctaacaaatatgaaagctagggaagtagtaccttccaggatatagattatgggctctggcatagatttaggtcagaacaacaaagcgcatctgcctgaatataaggtgatcacaagtacaaggataacctcaacttttcataacaagattattttttaaagtttattagccaccttgaatataccaacttctggaaatgtaaatgaaaaagtcaaatatctatatggaatatttaatatgttggtttatatccaagttgatagtaac

SEQ ID NO: 71758 - DNA, 1057 bp, Homo sapiens
ccccgtctctactaaaaatacaaaaattagccgggcgtggtggcacatgcctatagtcccagttacttgagagtctgaggcaggagaatcgcttgaacccaggaggcagaggtggtagtgagccaagattgtgccattgcactccagcctggacaatagagcaagactccgtctcaaaaaaataaataaaattaaaatttaaaaaaaaatcaaaaaggaaggtcctaagaaaggagagaggtgagcaaagaataaggaaatagttaggtgatagacacatacaactgttgaggaacagaaagaacaatagaatcaggaagaaaagagcactttacaaaatatccttcagtatactaaaaagtgtgagtgtgtgtgagtgtgtgtgcgtgcatgtgtgtgcgctatagtgagattatttagaaaacttgccctgagttcattttcacttagggttggttttagatttgtgagctttcttgactatgctaatcctcgcctctttggtactcaacacccaatcctcccacacaaacagagtctgtcagaattatctcttttatcacttgatattcagctcacatttactttctcagacttttggaagttaccactcagacagatgcaaattcagtgcgatgcctgccaaagtgctgagcagaaaagagactttcttttacaccttccatcttttgagcttttggtcctactctttcaatttttgctaaatagtaaatggggatattgttgtttttcagatgaacacgtgagtacatttgcattactgagcttgctgtctctagttctaaagagattctttacaatttccgtatcagcaaaggaattgccttgatttcctttgatgatgtttccctgctgatattctagacctagcacagaagcaattggtaccctcgtgaaaatggctcttgcccagtaattctgctttatttgtacatattcagctttaattacaggggtaagtgggggaaggagaagaaagccaaaaatacccactgcccccaagtggaagaacaagaagaagcttgactccctcaac

SEQ ID NO: 71759 - DNA, 1051 bp, Homo sapiens
cacacccagctaatttttgtacttttagtagagaggtggtttcgccatgttggctgggctggtctctaactcctggcctcaagtgatccgcctgcctctgcctcccaaagtgctgggattacaggcatgagccaccgcaccggcccaaattttctattatatcttttgtgacattttataattttcttccatcccagttcttacacattgcttttaaatttactcctggattttttgggttggttgttgttaatgcaattgttaatgggatcttttccacctttccatcttttccaggctgcactacagcctgggagacagtgagactccgtctcaaaaaaaaaacttgcaaaaataaaatatactcacaaaaatagcgatgacattaggtccttttgtagcaacattgccatctcagataagtgaaacaacaaaggaaatggaaattatgtacttggtaaaaatataggtgatggtagaaaaattatttttctgaaagtttaggttctctttttttgaaatgtcttgtaatctaactggattgctgaagcatatattttaattatgagtcgaaggcaaaatgactagttttcttgtttgaacttttttatgaaaaacatacttgcagccaggcgtggtggctgtaatcccagcactttgggaaaccgaggtaggaggattgcttgagcccagtagttcaagaccagcctgggcaacatggcaaaactccattctacaaaaaatatgaaaactagccagatgtggtggcgtgcaccagtagccccagcttcttagagggctgaggtgggaggatagcttgagcctggcaggtcgaggttgcagtgagccgtgattgtgccactgcactccagcttcggcgacagagtgagaccctgtctgaaaaaaaatgtgtgtgtgtatgtttgtgtgtgtgtgtgtgtatttgcatgtatacatgttaaacaacagtgttaaacaatatagtaatatacaacttagaaaatagatgcccccaaacaaatataaaagttacaaaccataccaacctttt

SEQ ID NO: 71760 - DNA, 1065 bp, Homo sapiens
gccaacatggtgaaatcccatctctactaaaaatacaaaaattagccaggcgtggtggcgggtggctgtaatcccagctactcgggaggctgaggtaggagaatcacttgaacccaggaggcagaggttgcaggttgcagtgagccaaaatcgcaccactgcactccagcctgggcaacagagtgagattctgtctcaaaaaaaaaaaaaagtacctgttgaataaactcgtgaaaggggaaacacggtggagatcttagttctgcatataaacactatgtggaacaatacatttatgactgattcagtaagtggaagttagtgtctaaacatatgctttctgaaaataagaaaaagggtcctgttgggattcagaagattataactttatagtcagttttatataatagtgtcactctttcagtcaaaatgggtctaaaattaattgatacagagcaagtggacctttcaaattttatttagcaataggaattaagaaggatcatgtttgtggtctgtaagtagatctttttcaggaagacataaaatggaaattctacatgccaataatcctaaggcttatttatgaacattatattttaggatttttatagaagttcttcttctgccagaaaggaaacttgagtttgagaaccagtctccaaggacttgatattgaatgaacttaactctgtctaacacagattgattttagtatttctggcaaaagatcaaaatagcttacacatagcatttataagaatgtttaaacattttccttcactattattatttcttaatatatgtttttctttcaaagtgaatatacttacattatataaataagtgtttcaaacttgtttcaactttagctttcatgctatgattagaaagttaagaaattgaactttcactaattctagttcttaacattttcagaacttcagcttcttcatctgtaaaagtaggataatagtgcctacatcttgggattcttgtgggagttacttgatataatatacataaagcctccagcacaaagtaagcatattgtagatggtggtg

SEQ ID NO: 71761 - DNA, 1176 bp, Homo sapiens
attctatacctagatatattttgacagcctttcagaattttttttaggtaaagtatttttaggaatagtaattaggacagttatagtacatatattgttttctatgctgctttatttcttttactttaacagtatatcattaccgtatcaatattcatctgtctctaaatataacttccacttcattttcaagcctgcatgcattgttgcatggatttttcaaagtggattttttttcttagtctttattcttacaaagtgttctaagtcgctccttaatcaatatctctgtccccaatacaactcttggtttctttccagttataaggagattctacatcaggtagaccataagaacttggtttccaggagcatgagttcatttttttttttcaagcaggatgggtgagcagcattattacattgtatgtcctgacaaaggcactcatggcttgaaaactgtctgtttttttctccacccaccagaacataagctagtgtctgacatttcttttgagcagccagggcttgaaagcatgcacttatcttcccaaacacatggctttttccttggtcttcatctgctctacaggagctcctgctacaagtcttctcttagactatcaccagccttccttcctcttctattcctgcctgttcaggatttgtttattttgttcgttttgcattcaaacttcttggttatgaacccttttgagatcatccttaagaaaggagaaatgttgaatttgtccaaagtaaccggttattacaggcatttaattaatgaatatttcttgtccattttgaagactatatttcagcctccttaatttaatctattctactttgtatcattttttaagtttctatcatgattggccttaaaaaatagacatttcattcccatcttagtaaaagtcttacttcaaatttatgtcactacactaaatataaatacaattttagtggaagctgcttccagaaagtggatatggttcagtaagattggttttttaacactttgcttaataagtaagtgattcagtagactaacctcatgaaatttgctagtgatcctttaactggctaacaccttggaaaaacagattaaggttctaattagcattgacaaggtgaagaggggcatgggtattaacaagaggaagttaacca

SEQ ID NO: 71762 - DNA, 1112 bp, Homo sapiens
cacaatctgagactctagggttcatatcttgtattgggtcagttaactttgttgacgtattgaaaatattaaaactaattcttacataagcagattttcatagggatgtgttagcaaaacagatgtgaaatttaggggacacccgcagtcaattcactaaaccaaacaaggaaactccttataggatacttgaaaaaaaaaatgtttagccgttgtgaatatacttttagtgtttaaaatttcagggtgttaatctgtaatgtaacccctttgtctcctagccagctcctggcttattccatgtttttccttgtttctgagaattcctaacataatagtctcaaggctcattacatcgctggtaaaatgcactgcacctcgtgcacctttcccattcagacccttgttgcctcgttcctggactaccacaggggcctgccttcatttcagtctctttttcccaactcatcatgatgaatcttctttaaatgctacttctagcatgtcactcccttttcagagagcttcagtggttccctgttttccactatgttaaatctaacttcttctgcttgactttcgacaccctttctgatttgcctgtacactatttatccagcttcatttcctatgatcttgggcctattctttctgttctattgaagtcggtctctcaaacacaccaaactcattcaagtctctgccttttacttcacccaaaaagcccttgcttggagcttctcgctgcctacgcagattttaccattccttcaagatcctgtgtgaagtgtactacctgttagatgcttttcctactcctactattttcctgcaaattctcgggtgatttttaatttagcaaaccaatgaacaaaaatctgtgtagtgtcttctatcacacactcttgtatcttcactaatgtaaacattttgaatacaaacaccatatcttttagctaaatctttcacagttcctagcataaggcggaggaaactgattttgaagagaaagaaaaaatagtaaatgtatttcatcatgcttatctaaagtcaactcaggccgggcacagtggctcactcctgtaatcccaacactttgggaggtcaaggta

SEQ ID NO: 71763 - DNA, 1032 bp, Homo sapiens
ggaagtgggtggtgcttcgtgatgacagattattgcagattatatggctgcctgccaaaatgacactcgttgaagggaaaagtagaagttacaaactccatcctattaatttgtacatgtttatttaaccacttataactgtttgcttgttttatacatagatgacaagttttaaactcctgaattacttaaaacgtgcttaaccttctctagtttattgtggctatattccttatctctgatctgcaaagatcacactgacccttttgtggaaagccacgtgttagcagaaaaaagatgggggaaggatgacagaatttaaaactacagctgctttgttttccagttaaaaatagttctgagttaaaaacgtaaggatgtcccatcacatgtggacaatttatataaaatatagcatactaatacaaataatcatgtcttatgaaaaagtttatagttctagattgttctggtttagcttgaaattgagattcttactgttgcaacataaaaggaagctttgtgaaggaaatatgacatctctgcccagatgcataaggagggaattacagtggggagttatttttagaagtatcttatgaatacatttcatgtactgagaacattttttaaaggttagtttcactggtaggagttatgcaagttgctcgggtcactggatattctattaagaaatcatttttatgttaccaaccaacctagttagtcttaaactggctgatctaagtagtagcttgcttgtttatttagagacagagtctcaccctgtcacccaggttggtgtgcagtggcacagtcatagctcactgctgccttgaactcctgagctcaagtgatcctcctgcctcagcctccccagtagccgagactacaggcatgtgccaccatgcctggctaattttttaaagtttctttttttttgtaaagagggagtcttgctgtgttgcctaggttggtctcaaaatcctggcctcaagagatcctcctgcctctgcctcccaaaactctggg

SEQ ID NO: 71764 - DNA, 1029 bp, Homo sapiens
taaaaaaaaataaccaggccgggcgcggtggctcacgcctgtaatcccagcactttggaaggccaaggcgggtgaatcacctgaagtcaggaattcgagaccagcctaaccaacgtggtgaaaacccgtctctactaaaaatacaaacattagccggggcgtggtggcaggcgcctgtaattccagctacccgggaggctgaggcaggagaatcgctcgaatccgggaggcggagcttgcagtgatccaaaatagcgccctcgcactccagcctgggcgacagagcgagactccgtctcaaaaaataataataataaccaaaagtcgttaagatggagccttacagttccgtatgaaggcttacagcagccacacattgcaaggtctttttggttctcaaactgttttcagtctttgtttagcaggatgcaaatacttcccaatatatacaataacacattttacactttctatactactggagtcgtatacaggcaaactattgtaatcttagagactaccttgatatctaatttggtgtaatgtttaagccaacctgaataaacattttcattgccggccggtattcatatttgttgctatcagtagcataggggaatagatgaaaactgttggtacttttttaaaaattagagtcttaattaagtgcccctttttttaaaataattttttccctagttttcatttcttccctcgctctccccaccccccgccaaaaaaaaatagaagggagagagggagggaggattttgtgactctccgaaaaaagatgacttttcagtaatgtatagtttttgaattcatatttttaagttgtaggatattataagattgcatatcagcatagggaatttaatttgtgacaatttagctttatcacccatttaattggttgctttattatttgtaagctatgttaaaagtttttttactgtttcttaggctcagctaagtaaaagaaacataagtgatatttatctatacacctataattatagattagttatg

SEQ ID NO: 71765 - DNA, 1087 bp, Homo sapiens
gaggtgagagcaccggggcgcggggcatgacagtgggagccgaggcggcgggaccccaggcagagtgaggggagttgcgggagcgggctcgacagtgcagactgtggagaggagaccccgggagggaccgggacagcgggtgaggagaggggactccgagagggaccgaggcagtggctctgagtggagaggactccgagagggtccaagactgaaagtctgaggggaggggtctccaagaggggccgggacagtgcgcgtgagaggaagggacccggagaggggctggggtagtggggtgaggggtgggtgcctcatgaggcactaggatagggggatgaggggagggggtcccctgaaggaccaggtcccagaaaaggtcagggacagcggggagaggggaagggtccccgagaggggccggcactgagagtctgagagatggggaccccgagaggggctgggacagcacccggggagaggagaccccgaggtgaggggaggggacccagagagaatccaggacagagtaaagagaggggaccggtcaggggatgtgaagacaggggatccccagagggcttagaacagagtgtgagaagaccccaggaagggccaagacagtgggagaagaggaggggtcccggaagggggctgggctgagacagcggggctgagagcaggacacctagagagaggccgggacagcgggtgggagcagggtgaccccgagaggggccaggacagcggggtgagaggaggggacccccagagggctcgggacagcgcatgcgagcgtgggactccgagaggggctttgagcgtcgggtgcaggcgcggaccccgagggaggagcggtgccccatgggtgcgggtcgggcccccagtcacatagcgggggcccggcgtgagcagcgagggagcgggcggggggtcgcgcccgctgagttgcgggagcccccccaagaacggctgcggcggggagcctgggtcgcagtcgcggcgtcgggcaaataggaaccggctgcagcgcagacgagtggagcggggaggtgctcccagggtctggcatcagcgacctccctga

SEQ ID NO: 71766 - DNA, 1073 bp, Homo sapiens
attgcagaaggttctactggagagcgttgacctagaccttactgaaggagaatgaaccttttccagtaaaggaaggcccgttgattcagactgttgcagcaactgatcagaatagtgtggagatattggcaattttccactccccctcactcactacagacccttgatccactgggttgggtagactttgaatgggcccctagtggtttctgctgtgtgccttggttaagaaccagagttaactttgctgaggtgtgtcttcctttggtgttactgaaacagtcagtgttgatgctagataataattttaggaagcaaaatgtagagcagatttatattcacaataattttatttttcaaatgttcaaaatcaggtacattacaggaatatcagaagagaatgaaaaaactagatcagcagtacaaagagaggatacggaatgcaggtaaggctcctttaaatggcaatgaatcatctttcaatgtttgaccatttgccgatcgtcggtgtaatgcagccctaagagctattctccaaaacatatcccagatactctgtcagggagagttttcagaaaagagacttccaagctgcagttatggaaagtggtttcatcttctgcttctgttgctaaggaatggcccagaagtggagggtgtctgaggaggctccttggagttaggttgttctccctggtaccccaagagtagtcttgcaccctcttgctcatttctgcatggctggcctgatgtacagtcagaagtgcggatgaggaaaaggattgtaggttgtttttgtcccattttaagtttttttttttggtattttgtgctaggattggggagggtcttcttgttattttccccaagtattgtttttataagaatttagagaaaacgcacacttgattagttgtatacagtaaatgtattcattcaacaaaaatgaattgagcacctgctacatctaagcactgcgagcaatataaagtcatgtaacacattgctttgactttaggacacttggtgtttcattgacaaaagataccacatgtataacgtgtaaagttaag

SEQ ID NO: 71767 - DNA, 1026 bp, Homo sapiens
cttcctcatagagagagttggcaaaagaaatgagctccttgaaggcctctgaaagcagctcagaaatgtttttttgtgagaatggatgccaaaacagcagctaacagcagcttcaggcagtatagtcttgttcttgtgaaagtgcttatttaatgagaccagtagcaccgtggtaccttatctggtaccagtctgcctgccggcttttggacctgcacaccattttctctgacagtggctgtgactggcattgatgcctcattgttctctgctagagccaccagatgtttgggagccttcattaggctagtgggaaatattatccgtttacagctgctccctttccgtctgtggggaacgggtatcatcaccttacctgtgatttggcgtcctaattattgacaagcgatagacattgtttggccaggcagttttacagccagaatcttaactgggacaggaggcatcctcagtgacttgaggctgagcctgccagggtagaaaagacaaataaatgtagggaaatcatttgtaacgcaataaaatagattacagaagtgtttaaagctagccatgggcattaaaggtatggatgtccttcctcagggcacctttgatacccttggtatggaaagcactgccaaggtaatgatggagtgttggaagacaaggtgctggagctagaagggtaattaacatttccacagatggcgctgctatggtgttggattaaaggcttgatttcattcctctaattgagtgacttagttcatctttgtggattgatgcccaatatcattgttgcccagctctgccctgaaaaatactttttaaagtctccttttttggttcaacatgaacgtctcttgaaaagcaaagtaggataagacgctgatgagaagcttagtctaaataacccactggaaacgggtgtatttggcgacctgctctttcccaccatgacttaaagcgtttataaacctccataggaattggcaggatgtactgttcaccgcccaaacctct

SEQ ID NO: 71768 - DNA, 1479 bp, Homo sapiens
tgtttctgttcctttcgaggagatggtgaatagctctctgcccaaaatggcttagtcatttgtgtaccatcaggaaagggcataacttcaggttgcttctccttcacaacaggagttaagttgctgagggaagattggccttaccttgggtgagtgtgtgtggaagtctttagatctttggaacaaaagcgctttatacattcatgatgaaattcttattttactgtttcctttgctgtgttattgtagatgcctaatgaagctcattccaccttctcatcctagcagtgggggatgtgaattcttttatgtattgaagtaccatgacatttagtaggagaatcataaatttctaagaagcaaactgttactgtagaaacatcatttaacaaaatcatactttgtaaattctaaaatactggtaccattgtgttgattactctttgcctggaaactgtacttttcacatacagtcctttaactctcaacaccccagctaaactatttgttaacagatgaacagatcatggaggatctgagaacattaaataaggtacggtttgacttttttgatttatttgaaaactcaggcttttgtggttttctgattttgtttgttaacatgttacttgttaatcattatgatacctttgacacctgaagttgcacctgaaatgattttctctaagattttttgttgttgttcttcctacagcttaagtcacccaagagaccaggtgagtgcatgatgtgttggcatttgtgcaacctttttatcatgttgttggaaaagggtgtgaatacctgtcaggaaatggttgcaattttcaaaaatgaaatgttcatcatttgcctaagagtagtcatcatgaaaactgaaggggaccttaactatacccctccctgatttctttttttttcataacccctgctttgttgtttttatttttttcttaggatttatcataaaagagacatttgattgattgattgatttccttctgtgtaggcatcaggcataagatttaagtacacatccatttttgaaaatgaaaccagaaggatttttaagtattactggctttctaaagccaagtcctaggcagttctgctcccgtggcttttcgtggcctgactctggtaaggcattccaaggctgctctgactcgcagttcatagaagagaccaaccagctcagtattcatagttgttccttccggaacagcacttgagatcatcagtgctagctgccaactagaattctgaattggtgacatcttttttttgtttaaagcaccatgattactcgattactcgattactcacacatccctctacttactgagtcttgtggaagaaaacaagagtcttctttttctaggtaatatcttcctgggggccactgcggtccacagacatcctgaccttctgaggcacgatggggaggggtgagggagttgtgtgagtgtaaagttagta

SEQ ID NO: 71769 - DNA, 1338 bp, Homo sapiens
caaaattggggtaatgattatttattttgaattcttaaaaaaacccagcattgtgttaggttggttacccgataacattgtacttgtcaaaaatgcttagggttctagtcatggccgaagtaaatcatttccacctattaagttgcagtgagttaattgcccagtagatgctggaggctggctttatctctaaggctgatcttgatgacttcttcccctctgagttggtgttctttggcattcttcagaaaggtcggtttgtgttatatcttaacattatgtctcagaacacatcgccactaggtggcaggctctaacagcttaacactgagaagggcaaaatgagatgaaaaatgtttctaataatgaaaaccaaataacctttaaagatcaagcccacacataagaaccatctttgaaaatgatgagatttatcactaacatttttacaaatctatgagtcttaaagccatgtgatatttccagtgatgttcattttgtaattgtgttgctttgaatcttcctctttctaagcttaatcctcagactttacgagacatgtcttgagggtgaaaatgcagtaaaataaaattcttgtttttttaaagaagagatccacaatgtctggtgtttcctaatgtaaacaaaatgatcagatttgatgtgttagaactcctaagcattttgaaggaattttcaccatctttcttacattaacagcagaaatttagaaaataatgtcactggatgcattttactttttcagtgaaattgaaattgcttattctcttgttaaatatactttgagaatgttgttttttttctctattctgtatacttttcatttttggccttggcagtcagagatcataatgcagttgttgaaggtgggtctccctcttccccaatgacaattgaaaagtgttcctgggaatactggctgaggtgttcactggtgcagtgccagcctctcccatctcaccaggctcatgtttggcttttgtatcagtttggaggttttgtttttctttctttggcagacgtggcctgtggctgagaggtcagctacattgctttatgctctttccagagggtatggagtattttggtgcagccgtatttttggcagaagatgtcttcctgagttttaaatgacttcagcaaaacaaatgggattcaggcatcgcatcttggtgtgaatacttgccaagctccctttcattttgaaagataaggatcttccctttgccttggtcttatactgcttttaaggcattctatatcatgctatgtaaatttgcctcacattttgatttggactaatgatctctcaaaaaa

SEQ ID NO: 71770 - DNA, 1322 bp, Homo sapiens
agagagatggctgagaaacgagttcaaggctgatgcctgttcccagcggcatgcctttagatggcccgaggtcaggggtgcttatgaagccctcacaagttgagacagtttattccagcaagaggctaccagccttctgcttgcatctcactcgtgcagatattttgatggtgtaggagatttgctcttctgtatttaacttttcatcttgttccctttcctctcccctgcagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgt

SEQ ID NO: 71771 - DNA, 1026 bp, Homo sapiens
tccccactgaggatgtccccacttggaaatgaccagttcaggcattaacaaaacccaccttccacattcctccatcttttcttcctttatatcttaccttaggtttttccccttccggatttccaactctctccctccccccgctgttccttccttttatttcctatctttgcccataaaattaggaagcagtagtggttaacagctagggatttggtgtcagactcatctctaccatttactacctgtgtgaccttgagtattttaatttctcagagcctcaggtccttactctgaaaaatgaggcttattgtgaggatgaaatgaaatatgtaagtatggtgcttagaatcgtgcctggcacatggtaagcactaaatttctattagaagtgattattaaattcacaatgaatcaccatgtggactcaattttcctgagtaaatggttttacatctgttaagaataggccgctagtcaagggtgaatttggtctggcttcatgccatggttgagaagacagaaccaggttgaaacatgacctccccaacatactgactttgtgaccttgagtgagagacttaaactctccaggcatcagtttcttcagctgtcagatggaggcaataacagtccccacctgcagatcacgaggtcaagagatcgagaccatcctggccaacatggtgaaaccccgtccctactaaaaacactaaaattagctgggcatggtggtgcacacctgtagtcccagctactcggtaggctgacgcaggagaatcacttgaacctgggaggcagaggtttcagtgagccgagatcacgccactgcactcagagtgagactctgtctcaaaaaaaaaaaaaaaaaaaaaagtagtccccacctctcagaaatgttcagaatctggtgcatagcaagttctcaatcagcagttattattagaattgcagtagacccttctctttacagcccataaactccccttgtacatttttagcccttctccctctctctgcttagtc

SEQ ID NO: 71772 - DNA, 1037 bp, Homo sapiens
cccaactatctgactccattactttctactactttgggttttagtttttttcctcttgtcttttggcattaatgaggtacctgctctctaattgcatgggctacatggttatttaatactccaaggatgacttgacatcgattatttgaaaatgcgtagctgagaaagagagagagaaaaagagggagagagaaaagaaagcagtttactggctcaatgttattgcagggaatagaatagttcttgagaaacatgttggctcatactttcaaagtgacagattattgctttcagttatattagcagatggattctgtttaaaggtgttgagtatttctcctctgctgccagattgttttaagtaggggaagcaaatgggaggagtcccaagggccttgggaaaacatattatcaggcacaagcttgaacctactggggaagttttacaggggtcactggctccccacctttgggtgtttgctcaagccgttttcccaaaatgaaatatcttttcttttttactctgcctgtgcaaataatattcaacctcagagaactagtttctctttgaacctttccttgatcttcccagcctctaatactgttcccctctctaaactggttgtactgggttgaatagtattcccccaaattcacatcctcctggaaacctaagaatgtgaccttatttgaaatagggtctttggagatgtagctggttaacatgaagtcatactggataagggtgggtcctaaattcaattattggtctcctaataagaaggtgcaaagacacacagaaagaagacagccatttgaagacagaggtggagactggaatgatgtagccacaagcccaggagtgataggatttgtcagcagccacgagaagctagaaaggagcaagccaagattcttccctagagcctctgagggaacatggtcctgctgatgtcctgagttcagacttctaggccccagaactgagagataataaatttctgttgtttcaaggaagcagtttgtggtaatgtgtt

SEQ ID NO: 71773 - DNA, 1021 bp, Homo sapiens
aattccagcaccaacttggctgactacatagtccttatccttaaccactattctatgttagcaaggggttgagggtagggtgagggtcttggagagtgagacacagcttgctcaatggaatgagaggcagcatagtaaagtagttagatatttagactccagagccaggctgcctgaacatgcatcctaactctgctttcagctgagtgaccctgtgaaagttacctaacctatgtctcaattttctcatctataaaatgaagacagcaaggacttttacctcctaaggttgttatgaggtttaaatgaaataatatctgtagatgtgtttaataagcacttttaaagcactgcttagtaaacactatgtaagtgttaaataaataatttatgcatctctgtgtgccaggctttgtcaccaacattatctcattgaagtaaacagaaaatggaatatgcaagggtgagctctgatatcaaactgccttggtttgaatcctagctctcataacataccagctatgtgtccttaggcaaattactgaacctatttggcctcagttttcccatctgtaaaatgggggataataggttcttcacctctcagggtagtagtgagaattaactggaataataggcatagtcaagtgctgtgttagttataagcatttatttttatttaacccataacaatatatgacgtaggtactattattacccccatttgcagaataggaaactgaggcacaaaggaatgatgtcacttgtccaggtcacacaattgggaggtggcagcatcaggattggagtttatacctgtctgactccagtaaaactccacttttgaggggtctgttcttttttgagagggagccaccagcccctcccctacatgcatatggggactcagagggatatcattggctgaatctaggggattcttctgcagaccaaggtctaggataactcaacaaaagcaaaaagacaaacagtcattgcaatggaattgctgccttgctta

SEQ ID NO: 71774 - DNA, 1036 bp, Homo sapiens
atgcccgtggtcccagctccttgggaggctgaggtgggaggatcacttcacctcaggaggttgagactgcagtgagctgggatcatgccactgcactccaatcacagtgacagaacaagaccctgtctctaaaataaaaaatggcaaagtgctttgcacagtgcccggatcatagtaaacaatcaccacctctattaaagcagcatagacatagaggcttgtcatgaagagtatcatgagaaattctcttctgctttggaatgtttcagcctgaatattttgagatttaaaacatttctaaagcagggaaactttacgggataagacttggacaaggagtctgatttgtggatttccccttattctgagccaactgcaccatggggcttcacctatcccagtttctttgtgtcttgtttaagaaacctttgcctatctcaagctcaagatattcttctatattgcctctagaagttttatcatgtttccaatcacatggagatctacaatccacctggaattgatttttgtatataatatgaggtagagaccaagattcaaatttgtccatgtggatggccaattgacccagaacctttcattgagaaagctattgtttctccatcactctccaatggcacctttcttataaatcaagtgtccctgggctgggcacagtggttcatgcctgtaatcccagcaccttgggtggccaaggtaggaggattatttgaggccaggggttcgagaccagtctaggcaacatagggagaccccgtctctacaaaaaattaaagaattagctaggcttggtggtgtctacctgtagtcccagctacttgggaggctgaggcaggagcatcacttgagcctgggaggtcaaggctacagtgagccatgatcacaccactgcactctagcctgggcaacagagcaagaccctgcctcaaaataaaataaaataaaataaagtgtctctatgtgtgaggggtttcattctgagctctttatgctgttccactggtctatttttttt

SEQ ID NO: 71775 - DNA, 1088 bp, Homo sapiens
agtctgggcagacagcagaacacagtcatctaattagaagtctcgtctcctctggggctcggggctactggtgcatggctcccacatttcccaggcagggatgggatgcctcatcagctaggctagcagtggaggcttccccacaaaggcctgagaggcaagagtgtttcccaaaccctggattaggaagtcaggagcctggatattgcagacccaggaccagggtttacatggatgtggctgctgagaaggacatcaccctgtctctctgagcctcactgtctttatctgtatggtagaattatcattgtacctacctcccaggcttgttgggcttatgtatataaagtcatgacctcaagatcccctgacctctaccccattcctttaatgtcccccttgctttttctcctccctttctaaactctttattggtatggttagagaggaagaatatagcagtgattgagaacatgcacattggagtgacctgcttaactatatatttggtccctgactttttcagctatgatatcttgagcacatcacttcacctcactgaagcccaatttcctcatctataaattggagatgatcatcctggaccctccttgtatgattgttgtgattgtaaagtggggcatatagtaagtgctcaataattatcctctgtcattatcatgaagcaaatatggggatgcactcttacttctcatttactatgtggatgatagagcaatgttctcttccaggaacctcatcatctatgtgctttgacaacctcaggactcagcttgtgggggccctcctctgcaaagcttttcctgagagttgtcctcctcctaacctgtgttcagctttcctttcagccctctgagcttcctccatcatagggctttgcatatggcattctttaagtctgtcttctgtgctggacttggatttctttgggacagggctcatgcattaatacctgtgtttttggtaccttgggcagcacctcggacagcaccttgcatctatttggaactttgttgaaagaatgaagacactaagagcttaaagcagtgtttctcaaagcaatttga

SEQ ID NO: 71776 - DNA, 1099 bp, Homo sapiens
tttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggtaatgatctccttcttagaaggggggatcctgaaggtcctcctttctggcctgtgccccagagcccggaggggtggatgcaggcagccgggccagggcgcctgtcttttcccgtcactactcggcggctcccgctgaaacatgggaactcattgcttgtgtgaggtggaagatggtgagaagggacaggaattctttgggggaaagcaacgcttattggacccccgtagctcctattcaagaggttttgctacctgagggtgggcggtgcagatggggtacgacttgactgaaaaacttttcttggtgtcacagagtccagagggcaggtgggccaaggaatggtggatttgagatgtttggggggtgttgtaccagaaaaggagaactgagccagctcaagcagcgttcagagatagcacacatttccatcctcggctcggaaactagcgagctttgaacatttttgacaaaagcccatatgctgttccctcaaatacacccaaaacagcaccctcctccacgcctttctggcggctgctgccgctgctgctgaattctctcctctccagcatccaaaaccaagactctgagctcaggagtcagggaggagccttccaagatcgtgaagatgatcttggaagagttttattttgtttttttttgttttttttttttttttccaaaaagaatctgattgctttgaactcagggatgagaaccgatccttggatggtggtagacatggtgctgatggaaggaagaataagggaagaaatgaaaga

SEQ ID NO: 71777 - DNA, 1040 bp, Homo sapiens
aggtcttagaaatggattgtggtggaaacgaggcgatatcaaacacaagaccaagagaggtccacgccccctgctggtgaaaacaataaatagctccaccatttttcctgggcgtggttccccccagttcttgggtgggtgggtcttggtttggtctgttttgctcaaatggtgatgggggtttgggggatagggagtccgtgggagaaagagagagagatttaccagaataaatgacacccagactgcagaataccataccatgtgaggcggaaaatgccccaggagttaaggatcatcatcagaaaatagtttttccaatccagaatgcaaacagattgcagggccttgtgggtggagctggtggggaggctgggaggcagggggagagacagggtgtcaccggcccttcagaatgaggattggatttctgttgaattttttatggatgcctgtaagcctccccatcacattatagtctggatgaaaaattatccaccaaggaaaatagatctgcgtgaatcaagatttcattgccaagggccaggttatcacatggaatttctttgtgggtcagcatggctgatttatttatatgtgtaccctgtgggtgtctattaggcctcccagactgtgatcactgtggggacagctggcttatatatatgtgttgctgggcatgtggtggaactgaagctgaacattcgccgaagagaaggggaaggaaggcatggaaatgtatttgggctgcttctaagcagtcaaggccagagcccagatttaggacttgaaatatcggggttctcattctaattccattgattgctggatacgtaaatttgaataatagcatcaccttgctgaatttcagcttcctcaactgtaaaatgaggatagtaatattctctgctgagccagcaggtcaatgaagtatgatggtggctgaaatactataggaatgactaacttgggtagggattaataatgctattatatctatttatttggtgattcaacaagcacttattgagcaactacta

SEQ ID NO: 71778 - DNA, 1071 bp, Homo sapiens
ttggtttgggccataaaccacaaacctgagccctctgttgtatatcctttgtttgtttgtttgtttgtttgttttttagacagagtctcactctgctgccaggctggagtgcaatggagcgatctcggctcactgcaacctctgactccccggttcaagtgattcttctgcctcagcgtcccaaatagctgggattacaggcacgtgccaccacacctggctaatttttgtatttttagtagagactgggtttcaccatgttggccaggatggtctcgacctcctgacctcgtgatctgcccaccttggtctcccaaagtgccaggactacagtatccttttagtcttttccttcccctgtaaacatacacgtgtgtgtgtgtgtgtgtgcacagtgaacaccaggaacatgggcccagttcatgatgcgctgtaactaccgtcactgcatccccatgcaccagcatgggaaatctcagcacagccatgtttttcaacatgatctcattctctagcatgcaatggactgacaagaggggcatttccttgggaatttggaataaggaacaagacagagagattcagtgtctccttgcaacttggcctgcaacatggagagatggggcagggtgcagccatgtccctcatggggaccaggagacagcgggcacttcaggtcccaggtgggtcctgtcagctttccactccttgttctagccccttgctcaggcctggctggtccctgagtcactcctgcttctttataatcaagtcctcctctggcctcagttagcatgtgtggacctctagtcttcgcagccacagtcccagcttacacaagacacaaatacgtaaaaagacatagataattgttttacataaatgacatgatatgcttccagatgaccttttagtgccatcaactgtcctccccaccccacctggggaggtcttgtttgcagagaaaaaggacaatacctgcgtcgcttgtgtttcttggaacttttcttcttctttttcttgacaggcgatgggctataggatgaggacctgccagggccaagaagacac

SEQ ID NO: 71779 - DNA, 1078 bp, Homo sapiens
gggcctccaggtggctcggggagtctctccggcgctttctcataggcgagtaggaccgacgtctccgacgcgctcgctcgcgctcccgctgctgcgagtccttctcactgtatttgggatcccgctccctgaaggggcgcggggggttactggggagctggggctgggctggattttctgcgtgagcgcgtgggagagggacactccctttctttcccaccccactgggtcacgggatggggtctgcacgttgccgcaagggagaccggagggaggatgacggggctgcggtaagagtctgcgagggttgttagtaccgtaggggtgggggctgggcttgtgcaggggtgtcagcatttgcaggtgggcatcatagcagggcaggtgctgcaggggtgaggacgtgaatgttacgcaggccctggtgcgtgggtaagaactgggggctctgaatatggggacggtctgtagaggctgagggctggggatgtgaattctggggtatgtctgcgggactgtttgggctggagacattaggaaacaagggtatttgatgcctcgctgccactcctgattggacaaagggaactgtaagaatgctgagtcagggtcagacctaagaggaagaaggcccgagaacggggaggcggggccagagaggaggatcagagcaaaggggtggggcctaggacgggcctagtttgaggggcggggccggtacctgctggggctgtagcgggagtagctagggctgcggcgggacctagagcttctgctgggcgggctcctcttgccagacttggaggaatagctgggagagcgggagtaggacctgggggagaggtaacagcctctgaggagcctgctgagtgtccgcctgggttatccaagacggcttgagctttattcagcgggtccctgggcagtgacctttttctttctggaagccaggcagaggaactgggccccgatcaaagaatgaaagcccctccccaccggtggttaataataataccaacaacttctattttgtgcctactatcctggccacttactagctgtgtgaccttggcagatg

SEQ ID NO: 71780 - DNA, 1023 bp, Homo sapiens
agggctcttcaacatcgagaaccccaaccaggtggcacagacaaccaaaaaggtcacacaactgtatctggatgggccaaaggagctttcgaggagagaacgagaagagattgagaagcagaaggcaaaagagcgttacatgaaaatgcacttggccgggaagacagagcaagccaaggctgacctggcccgctggccatcatccggaaacagcgggaggaggctgcccggaagaaggaagaggaaaggaaagcaaaagatgatgccacattgtcaggaaaacgaatgcagtcgctctccctgtataagtaaccgcgacccatgggaggagatgccggggacctgggccgcgctgccaggacctctgctgtgtctcgcccaccctgtgccctggcgccgccgcaacagcccctcgtggccaggagccccccatggcctggggcctcctcttcattttggcacagaaattgtttgggggatgtggggggagctgggggaggggcagttgctatctttgagacagaaagatgagggacagcatttcacatgtaaccatttgaatgtttttgctgtttttagaattcagagcccttgctggggggtgcctgggagatggggtaagaagagctttcatttttctggtagatagcatgtaagggggtggttgtcccaggaggcagctgctgacaggtttgctacacccagccccggactgtgttgcctaggtgctcattcagagaggggctgtcatctgggagcctgtgcccctgggtcctcgagggttatggcttgtccctggtcagtcctgtctgatcgaggcctcgcctctctgcccctccctgcccagttcctacccacctggctaaggccagtgcccatttttaaccctacccattgatcatttcaagaaacctctgtttactgtgtggcacccaggcaaaacatgttccacaagttcaacttgtatatttggcagattaaacttgacattatcgtaaaaaaataaaaataaaaaatataaaa

SEQ ID NO: 71781 - DNA, 1044 bp, Homo sapiens
ctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagctttgggagatatacctgatgctagatgacgagttagtgggtgcagcacaccagcatggcacatgtatacatatgtaactaacctgcacaatgtgcacatgtaccctaaaacttaaagtataataatacaaaaaaaggaattagcctcgaaaccaacaagggagagggagagagaggagagtcatggtgtgattaaattgtcgagacacattcccgttgctatcaatggctggtttctcttaaagagtgaaaacgcgaaccagatcagtgagctgggccatcctattagccagtaattccaaaatgatggaataaatcagcaatgacactgtagaacatcagaaaaaaattaagatgaattgtaggtttgccgtctgcaggacttactctcagagatctgctggtctccagaaacaggcatatcccctctctctatggagaggctgcagagggtcaacttttggtgttcaaaggctaggtttgccacgcaccagctgtgtgactttagacaggtgaattgcttagcctctctgaggctttatttccttgtgtctatgaatttagaacaggaacatcaactaggcagaagcagtgtgaggactaaatcgaataagctatgaaaattgtccactgtgatgttaacgctggataatgtgtttatgggacatgaaacagtgttgttgatttgaaaaacaaagaaaaatcgatacgtactgaatgactggagttaatggttcctgttttttaaatgatcataactggacgagcacaactgtaagtgtgcatttgttattgtatcctcaaaccccactttgcatggactggccaaggtcagcaatgctggtccactctagtgcatccacaaggcacagttgtggctcacagtcatgccccagg

SEQ ID NO: 71782 - DNA, 1067 bp, Homo sapiens
tgcctcccagtacctagcacggggcctggcatggagcaggtgccagtaaatggttgttgaatgaatgaatgtggtgaaatgggggttcagaggcttgccaagggcatcagtaagtgcctcaattattcagaattttgcctttcaatccaccacctaaaatcagggatttcaaatgtaaatgtcttcaagacccaggcaggaaatacaaatgagtaaattcagcttggggataaggacgtatacctccctatcaaacacaagaagagaccaggccagaccagctttgaggccgcttcaggaaaggtggtcacttaacgtgttccaacatgcctgaacctgtccaacgcctgattcagtcccataagcccaaccctgcacttagacaattccaaacaacacaatccattttaaagttccatttctctccaacccacagaatccataatgaattaaggaaagcatatcaaatataatcatgcactattgttaagttcttggcaaagttgccaaatgtcaggcagacagtgcgccccgtggtgcattccacatccgggactatggcttaagttgtcatgataatgaattgccgtgctcacttaggcttgggaatagatccagaatatcatgtcgagttgagaaaagaagtgcctcgcaaaggtgacaccttatacctcatttgcaaggcaacaatcccaaacacacatcacaggtatggatggatgagagaaggttattttcaacacagctctttaaaactgtacttgagggcctgaagtctatgtgaaggggtcacgtggatggagcagtccactcctccctgctcatctcaggaacagctctgacatctcaccaacaacctaggccttgaaggctgaaatgcagaagttcagtaataatttaagcctggaactggtgggggcattcatcaaaaacacttactcttcaacagtttggtttagaatatgaggcaggcatagtggctcatgcctgtaatctcaacactttgggaagctgaggcaggatgatcacttgagcccaggagtttgagaccagcctgggcaacatag

SEQ ID NO: 71783 - DNA, 1026 bp, Homo sapiens
aagaaaagaaaagaaactgctgtttcctccaaggaaacctttctgagggctgtcctgggccaggtggggcatcccttttgtgttcaggctgcttcctcccacaacatccagacccctgtgtgctactttcctgtttacctttccatcttccctactggactgttagctcccagaaggaaagggcaaggattagtcttctccaaccctagccccagagcattcagcccattagtgctgtgaaaatgagagtgcaacgggctatgatgcaaactttgttgtatagatgcattcatcgggatggatggtctctggagtcaaggagtaagctagaaagggcagaagttattgggttatcagaacagggaagaaaaactttcagtggctttctggtgctcttaagatcaaatcccgcatcataactctggcatttgtggcttgcgtgatgcagccctcatctaccacttgtccatcctcttcaaattctccatgtcccttctggacttgggactttgcatgcacttttccttctacctggaatgtcattccaccttctcatcacactgctggctcttcctcatccttcaggactcatctaaaagtcacctcctcagagaggtcttcccagatttccccatctagattaggtacctatgctctctatctctgtctcatagcaccctgttctcttactgtaggacaatgattagaatttgtacctatatatttatggatgcagttattttgtttctgcccatattttccagaagactgtgagctccctgaggacagagaacaagttcttcttgtttgtgatatagccccagcacctggcacctggcaggcatatagtaggtacccagtgaatgctgtttgaatgaatggatatatatgtgcgcttacttcatgaggatttccatcttgtcctgcaggcagaagccagcctcctgggctacgctgtaaaacttggccctcatggtgttacacaccccactcttgtagtggatgttgatgtcacaattagtgcgg

SEQ ID NO: 71784 - DNA, 1024 bp, Homo sapiens
gaaactacctggaacatgattcatacagttcgggggaagagggttgcgatctaaagtgttccccttcttggaggcgggggcttaacaattcctggactctgagggaggcagtggaaagatgccctggcagaatatctggcgccctaagaaaacagattccgttcgttgacaggagagttcttcatcattgtctagttaggcctggaagttctgccaccaggatttcttgttaccagttcagaaatcacagtggtaaaatgatcacaatgggctcactgtggttgacagtttgttgagcaggacttggaaatccgaaatctgtgcttttatctgggtaattagtcttttagagatatcatctagtttttttgcagatagttgagaatcagggaatggaggaagtgtgcccaaatatcctccaaaatatataacttactgatacatgtaattttaagccacttacaagctttttagtcaaatttccacctagggaaaggaaacggacccctcactgatacgaagctaattccacgttctctacagacttctgtttcgacacttacttcctcaaaatgttatttactccttatggctcagttttctgcacttcatgcttttctcagtttcttgctgtgatatggttgggtcacataaacggggcttgtcccctgaaaaatgacattgagggaattggcagagctggggcatagcagattttccctggaccagtcccaggatctggcgaccagaaccatcccacgcgttctttggatgatggcttggtaccttctggctggccaaacgtcactatccagtgttctagcattatgaaatcctgctcttgtagcagcttctcagtgtatctgaataatccagatactcaagcaagagtttggaaggaacttgagtgtaatggagttaaagagcctttagatattgggctttcaattttcccccccattttgaaatgtgcctcgtttagcctgttttctccacggcctctgtgtaaacagactgcctcatc

SEQ ID NO: 71785 - DNA, 1234 bp, Homo sapiens
ggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattggacatgtgcctggaggagctctgattttattcagtcccttggagaagagactggaactcttcgagagttgcgtttcagtaccgttcttgtggctctgagcggacagggctactccagctgcccaggcctgagaaccagtcctgtgactcacacccattcacacagtttggaaccttaagggacccctaaaactgagcccc

SEQ ID NO: 71786 - DNA, 2153 bp, Homo sapiens
gatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgtgctttagtgcaatgacctcttctttttttgagagactgtgaaagaaaaactatcaccagcgtgtcagtgtaggtgtattatcatggatgggaccttctttacgttgtggggagggttttcctctggagtgggatagaggaagccacgtggtggttagggcacact

SEQ ID NO: 71787 - DNA, 1029 bp, Homo sapiens
gtcccatggcatagctgaacacctgttcacttaaccagttctaattaggcaaagcagtaaggccatgcccgttttgtttgtaagtgtaaacaacactacgatgaacatccttgtactaatctttttgcacttgttagatagcaccccctgattataagctcctaaaagtggaactgttggatcaaagactaaacacacatacacatacaagtatgtacatacgtatctgtgtgaatgttctgaaatgccgtcgtggcccagatacccttcgaggctattttgtttctctcttgctgcataacaagccatctgaaagcttagtgacttcaaacaacagcttattattggccccaactccgtggcttgactggacagttctgcttcatgtggtatcagcagggccactgggacaactagaaagcccaagacaggctcacaaacatggcacgcaatgagtgctggccataatgtgggcgcttagctgcggctggtggctggaggccttgttgctttccacgctggcttcttccaagaatatagaagcggaagctggcaagcgtgctcacttccaccacgctctactggttagagcagaccgcagagtcagcccagattcaaggccagggaactgcaccggggcacgcataccagagcccatgactttaaaagtctaataccaagtcttgccacaaggaataatagtgctttttccctttaaggcagaaaatatttccagtcctgtgtgctctagtttcagtgacactgtcatgcagagatagagtattaagaagaccagcaatgtctaaatagctgtgaacccagtcttttttttaaaatagaacccagtcttttttttttttttttttttgagtcggattttcactcttgttgcccaggctgtagggcaatggcacaatctcagctcactgcaacctctacctcccgggttcaagtgattctcctgcctcagcctcccaagtagctgggattacaggcgcctgtcaccatacccggctaattttttctatg

SEQ ID NO: 71788 - DNA, 1076 bp, Homo sapiens
ccaaagtgctgggattacaggcatgagccactgcacctggccaaaattttttttttttttttttttttttttttttttgagacagagtctcactctgtcacccaggctggaatgcagtggtgtgatcttggctcactgcagcctctgcctcccaggttcaagtgattcttctgcctcagcctcctgagtaactgggattacaggcatgcccaccatgcccagctaataaaaattagttttttaaattagaaattattttcattctaatatctgaactgttcaaaaaatgtatggaacatatatgtaaatcataaagcctaataatgtcgtaagcatccacacactcactacccagtccaagaaatagaacattgctaacaatttcccttttcttgtgtgttcctcccttatcccggcccatcttcattctcccactgtaccagctgctgaccttcgtgccaggactaatttgagcagtaagcctcatttggtgaatgataaacatctggttgtagcaggagacgttaaaagggtttcagctgttctagaaaaagagcgttttgatgtagaactctgcacgtgtatgagttcttagctaagaacttttccttttggattgaaattttctctaaatgtgggccgggtgtggtggttcacacttgtaatcccagcactttgggaggccgaggcaggcggatcacttgaggccaggagttcgagaccagcctggccaacatggcaaaaccccatctgtacttaaaatacaaaaattggccaggcatggtggtgcgcacctgtggtcccagctacttgggaggctgaggtgggagaatggcttgaagccgggaggtggaggctgcagtgagccgagatcatgccactgcactccagcctgggcgacagagtgagactccgtctcagaagaaaagaaattttctctaaattcgtttagcagtctctaccacctttcctctcccttccctcattctgtcttctccctcctcacaagggaagtttgtcaaaagattctgtctccagcagaaggcacatgtgtgggaaaggtgtgtggtgtcagg

SEQ ID NO: 71789 - DNA, 1038 bp, Homo sapiens
cccgcgactgtgtttcttacgagcttctgcctgcctgggttcaggtaaagagatgcagaggcgtgctggctcgctgctaacacggcgcctttgcacttctgctgcagccttatgggggaaggagtctttcatgtgtcttattaaccctgcgcaggtgaaatctccttagcttcagcttatttcttattacagaatagctttccatgtctactaccctcccttatttctgcatcccagccaaattataactcagatgctaattaacagctgccccagagataccaatagcactcgcattttgcatttggagctcagatcaaaatacgggctgagctaagagcatatgtgcgtttctgagcatttccaggaataacttggccttaaccttctcttggtttctctggatggtttggtcataaacagatcagcctcacgatgtcttctgtttttcttttctttcacctatgaaaagaaactgcttggaaactccctgctgaaactggaaggtgatgaccgtctagacatgaactgcacgctgcccttcagtgaccaggtaatgcttgcatgggcacggccagctggtgtctggttacagccacaccccatcaagaaagaaagggctgtggaggccttgttgctcttactagagattgttctggtgacgtgaccgtgcttatgttctgccttcggacttctgcccttgcaggtggtgttggtgggcaccgaggaagggctctacgccctgaatgtcttgaaaaactccctaacccatgtcccaggaattggagcagtcttccaaatttatattatcaaggacctggagaagctactcatgatagcaggtgtgaggccaaggacatggtgttttttctttactttcaagggagccaatatgttgaagccacgtttcatgctcgtaaaacacaaaatagtagagaggagccgttgtagctcttatctctgtgtccccatagatgcccaagcctcagctaatggaccccctctgtccagattcagttcccttccagtatccagttt

SEQ ID NO: 71790 - DNA, 1912 bp, Homo sapiens
cctgctgaatatgccacacacttcaccgaggccttctgccgtgacaaaatgaactccccaggtctccagaccaaggagcccagcagcagcttgcacctggaagggtggatgaaggtgcccaggtaccatgtcagggtggcttgggctggagcaggtgctggcacaagccactctgtccctgatgttttctagggaagtgtcttttctaggaactctgccaccccctcatcctatcctccagccggatgtttcttctgagttcagacatttttcttttccatctttctttccccaggaataacaaacgaggacagcaaggctgggacaggaagtacattgtcctggagggatcaaaagtcctcatttatgacaatgaagccagagaaggtaaattaataattcagggggaaggtcattgcacgtggctaacccaggtctccccagtgctggcgcgaaggctttgttttttggactgccttgcaagccttctacgcttttccatttttgaaacttacaaaccaaatgacttctctaaaggttattggtgcgatactcacatctataggtctcccccctgaagaacccgcagggcgctgccctgaagattccacctgctaatacaccttccgagaacttctgcctcagtcaactaacccataaatccgcatcgtcatcagaaatttgactgtgctactcatctgacacactttatttttttttatcttccctctctgccttctctgcacacctctgtcccttccttgttctcgtgcgcctctctttacacacgtaccctgtctctctctcccttgctgtctctctcgctctctcttctccccttgttcttgttcctgttcttttgtttttctttctgcccttcctctttgcaccaagctggacagaggccggtggaagaatttgagctgtgccttcccgacggggatgtatctattcatggtgccgttggtgcttccgaactcgcaaatacagccaaagcaggtgaggaggagccggaggagccccgccctggaggtgggccgggcttggccaatcagcagggacagaaggggtggtacagggaagattggctctgcaaaggaggcccatcttcctccgctccccgccttggcggtaactgggatttgcgtggtttggtgggcatctttgatctctcaggcccgtccctcccagtgggaacgggggaaatccacacccaatcctgtgctctctgaaatctcctagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaaaaaaagagaaagaaagaaagttagccaggtgtggtgacatgcacctgtagttccagctagtagggaggctgaggccggcggattgcccaggagtttgaggctgcagtgagctacgattgtgccactgtactccagcctgggcaacagagcgaggcatgg

SEQ ID NO: 71791 - DNA, 1046 bp, Homo sapiens
ttcatggctgaataatactccattgtgtagatggcacatctgattatccattaatccattttcattagtccattttcacactgctgataaagacatgcccaagactgggtaatttataaagaaaaagaggtgtaatagactcacagttccatgtggctggggaggcctcacaatcatggtggaaggcaaaaggcatgtctcatgtggcggtgacaaaagagaataagaaccaagcgagaggggtttccccttataaaactatcagatcttattcactaccacaagaacagtatgggggaaaccacccgcatgattcagttatctcccaccaagtccctcccaacacatgggaattatggcagctgcaattcaagatgagatttgggtggggacacagccaaaccatatcaccattggtggacatttgtgttgttttcactttgtagttgtcataaattatgctgctgtgaacatttatgtacagatttttgtgggtacatatgttttcagtccccttggatatatagccaggagcggaattgctgggttctggggtaactatgtttaaccttttacagaactaccagactgagttccaaagtggctgcaccatttttacattctcaccaggaatgtgtgagggttccagtttctccacatcctcatcaacacttatcttcctttttttagactgtagacatcctagtggttgtgaagtggtgtctgcttggggttttgattcacatctctctaacgactgataatgttgagcatcttttcatttgctcgttggccatttatcctcttcggggaggtgtctatttaaattcttggcccattttaaaattgggttgtccttttattattgagttgtaagagttctttatgtattctagatatgagtcccttatcagagatttgatttgcaagtattttttccctttctgtgggttgtcttttcactttcctgatgggatcatttgcagtactctaatgattttttaaaacattttcctccagaatttagtcggcgtcttaaggaacgc

SEQ ID NO: 71792 - DNA, 1047 bp, Homo sapiens
gtactgtttgtgttggattttcatatattagtgtcctaacaacttcactttttagtttcttaaagtaccaactttaaaagtatacttctgtctggatttgaggttagtttgttttcttgaattttaggttctctattctcatgaaaaggtgaaaatggaaggcactatttctcaacaaaccaaactcattgattttctgcaagccaaaatggaccaacctgctaaaaagaaaaaggtgagtcaaagtgtttgaaaagtgggaattgtcagtttcactcatcattcatggctcagtggacaccactgtgatatatgatcataggaacatagaagaaaacaaagtatactttttttgttgttttattttgggttgaaaaatagattttgagataattataataggtcttactgaaagatatcagtgatcaagtctaacaaactactttttgtttatgaccattcaaatcatagtatctttgttaaagaagtaatccctccccagcccacacacatagcagttggggcagagggatgtatgcagagagaaagatttataccaagtcatgcatacatgactctagagggagttagcaagtcacaagtatggggcttcagcagttcaggtctctcgtaccacactccagaaaggactttaacagtgatctagtccagtccttttgatcggctcacaaagagactagaactcagggagctggggtgacctgcctgaagtgtctgactggacacttctcccctctgccaagtactgaacaacccttttagattgcaggagacaaattacaaactaggggcagggttatacatagtgcacatgagaagattgtttttcataagcctgatctatacatgctttcccaaaccactaaagccttcatactaggtttggccaggtgttctcagttccagaaaagtcttgaagaagcttgcagtttccttccaaatgcagaagcataccatagcagcagtggcagtggttttgcaggagaggccttgatgacttggaatacctaggaggaaggagtggag

SEQ ID NO: 71793 - DNA, 1069 bp, Homo sapiens
ctgcatggagtaatttctcatagcaacaattaagatcttgaaaacagaaaataaagacattggaacttagttgtcatggcactgagtcgaactgccttagatgtcaactcagatggctcatgccatccaaaatatcctcaccttaatgtaccaaaatatcctcaattggaactctgtctgggaaggccatccctgcagcctggacttcctgtgacggtagggatcctcggacttgttggccagcagaggtttctgtgcaaattcattttaactgtgcttgcatccttttggaatagatgacaattggtaattctgaattgagatgatttcaaaagctgtacttctggtgccatgcctgaaattagtttgaaataggaacagcaggggaacaaattgtattgtgtgcagtatcaagcatttccctggcccttctccccactagcaagccaaattacagcagcagatggacctgcagaaaaatcacattttccgtctgactcaaggactgcaagaagctctagatcgggctgatctactgaagacagaaagaagtgacttggagtatcagctggaaaacattcaggtgaggactggcagagggaatctgcttaaaaatggtctgcacggctgggcgcagtggctcatgcctgtaatcccagcacttcgggaggctgaggagggcagattacttgaggtcaggagttcgagaccagcctggccaacatggtgaaaccccatctctactaaaaatacaaaaattagcctggcgtggtggcgggtgcctgtagtcccagctactcgggagactgaggaaggagaatggcttgaacccgggaggtggaggttgcagtgggctgagatcacaccactgcactccagcccgggcaacagagcaagactttgtctcaagaaaataaataaataaataagtctgcagaggcaaagcatgattgtacagtcatctggtaaaatggtcagtatctttgtgctgcatattgtgtgtattttccccaagattttattttcaaagattgcaaacattcagagaagttggaagatttctatagtg

SEQ ID NO: 71794 - DNA, 1050 bp, Homo sapiens
aactatacacttaaaaaatggttaaaatggtaaattttatgtcgtgtattttgcctctgtaaacaatttaaaaaataaaattaatactaaacacacacacacacacacacacacgtatatttggtgaacacacataggaattcaccccgtggccttaagaacaacactacagtggaaatgttaaatgtacctcgtggtcaaatagagaattagggtcttttatctgcagtgaatagacagtgttcccacttaggcacatcctgcaaacagaaagaacagaaataatcaatgctcttgcctgtcctattttccttctgagagggcgagttggccctgacagcccagtactttggtccaaggttatgtggtgagtcagtgacgactctaggaatagagtgccgggatcccaattcagttccctccttctcacttctaacctacatgagaacatttccagtttcccaggatgttcctcacagaaagatttttgagcacagacttctggctgacattgagccggaggcagatttcagtgacagttgaaaccattctggaacaaagaatgctctttattgtccacattgtgattgggcctcctggttggtgtgtgctgtataagcatatgtgcccaaggcttccacctaagtatcctcttcgtaggtgcggagacttttattttttatttttatttttattttttgagacagagtcttgctctctcgcccaggctggagtgcagtggcgtgatcttggctcactgcaacctccacctccgagggtcaagcaattctcctgcctcagcctcccgagtagctgagattacaggtatacaccagcactcccggctaaatttttttgtatttttagtagagacaaggtttcacgatgttggcccagcttgtctccaactcctggcctcaaatgatccgcccacctcagcctcccaatgtgctaggattatagcatgagctaccatgcctggcctataaggagacttttaaatggagccagaatcaaagtctcagaattgaaagaatttttatatcatcc

SEQ ID NO: 71795 - DNA, 1020 bp, Homo sapiens
ttcaatagctttaggggtacaagtgtttttttggtgacatgggtgaattgtgtggtggtgaagtctgggcttttcgtgtacctgtcacgcaaatagtgtatatcgtacccgataggtaatttttcatccctcactcccctcctcgccttcccccttctgaatccacagtgtctattataccacttgtatgccttcatactcatagcttagctcccacttgtaagtgagaatgtgcagtagttagctttccgttctaggtggaattttgaaattgacaatttgtcagatccaaattagatattttgaaattagaattttcaagtaagagtatgggggtcatgtaatacttgtcttaaggtatttaacacattaaaagactatgtcatgaaggccagagggtctctgtcatttttatccttctatgtgatgcttaatggagtgtcaagcacatagtaagtgtgtgccaaatagaagtttattaaatacatgggtgaatgaatattgagttaaattgttctttagagctaatatccaaagtatattaagtttcatgccgataggacatccatgcaaattagcttcctgcacagggcagaattttatcagattattctgagtaccaaatttcatgaaggtttttgaacattgggtaatttagttaaaaataatgtgtgccctgcttttgaagcataatagacaagctcagactgatcttctaaacccatcccttacgtgatggctggtaccttttcacagaactctgagaacggctatttaaattgatgactacctcccactccccaaccagagccctgtgtgttgaatcactgatgattccgctttgttctttaggattgacctgcaaggacaaatgcactttataatgaaaaattggactccaaagagtattctgtttaacccttagtgagcctgacagtttaattaaccagaatgccctgttctggctgatgaggttttgtcacgtgatacccatagctcctgaggcactttgctgataga

SEQ ID NO: 71796 - DNA, 1019 bp, Homo sapiens
tctcctaattgggttgaatttctttcccaagcctttcttatcaaacttataagctgacagagcagtcattatttgcatacatgtctagttatgggcctttctgacttgacgtaagatccttgagagcttggttatcctttcatcctaaaagctataatgcaggtagtaagcattcagcgtatgattatttaattaaattcagccaaagcatgtcagataaataagtccttgagcagttatcctcctagaacttgtcacagccatatttaagagccatcccttagaaataatttccatcctcatataataacctatggaagactcaccagtgacagggacttctgtatttagaaaaaagcaacctttacgttctgacctttagaactcaatattctttctccgtgaaggttcgtggacattcataaacgttgtcagcatctaacattcctaagtgtggcattatgccaatctttccaaatgtctagctcaatgacctggagaagaagcatgctatgcttgaaatgaatgcccgaagcttacagcagaagctggagactgaacgagagctcaaacagaggcttctggaagaggtgagtgtgaaatacctgggagaagggccaagtggattttttttttcttttaataggcttcttttttttggagcagctttaggttcacagcaaaattgagcagaaagcacagagagttcccacatactccctgtctcctcctcccacagtgtccccagctatcaacaccctgtaccagagtgtccatttgttacaatcaatgggcctgcactgacacatcgtcatcaccccaaatgcatagtttaaattaggtttgctattggtgttgtatgttctatgggttttgacaaatgtgtaatgacagttatccacctttactgtatcatacaggatagtttcactgccctaaaaaccctctgtactctgcctgttcatccctccccaccctcaactcctggcagccactgatctttttgctgtctccatagt

SEQ ID NO: 71797 - DNA, 1047 bp, Homo sapiens
agtgaactgtgatcatgccactgtactccagcctgggtgacagagctggaccctgtctcgaaaaaataaagatagataaaaacaaaatcaaatgctttgggggatcaatgtaaatggcttgattttaagcttggtcacttcccctggctttgctttggatcctgcctctaaggtggctgcagaactggcccttcatccattcttgcctggtccccttgggctgcagaagcaaaagacaaaccgcatttcaaactgtagttagaaacttgtgcttttctgaaactgacccgaccaaagtaatctccaggaaatccttgtttaaagacaaggcacaaatcagtgctactgatttgcagacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcaggtggggctttgtgtttgtggaaagctcatgacaggtgaccgcaggaggatcggcctgagagttgtggacagggtgatcagctattcccgccgagactgagaagtttcctgggtcacaagcctcctggtgctaaaaaccaggagactcttgggcaaaccaggatagggtggtcaccctagttgtaaacgtagatagtgtgagttggattctgtggctatgactggtatctgttttccccatgcagaggcctgggcatcagggcaaatacctctgttttctgtgcagaaaactctcatgaggtttcttgtcagagtgaccatagcaaggccatagcaaaaccattaccattttaatcctggtcttccctccaccccagggttcctcaaccttggcactattgacatgtcaggctgggtcattctttgttatgggggctgtcctgtgcattgtaggacgggacagcatccctagtctctactcactagatgccaccaaca

SEQ ID NO: 71798 - DNA, 1448 bp, Homo sapiens
ggaaagaggtagggggaggaattagtagttaaatggagacattatgaaaaacatcttaaggaatgggtttactacgtacaggaaggagaccagttgaactactgggcattgtttattcattgtttctggttttaggagatttaacatgccacagaaagggaaaggcagggaccctgcaagtcataagtgtctgttaggaatggcaaacgtacagattttccttatttgtcttccttgataaagaatgtatctgagctaagaacctgaccagataacttttattccccctcttgtagctgacagtgtacttcaaaatcgtacataggaattaatgtggcttttgacattaaaaagcaaattactagaccattagaccatacactaaaaggttatcagctcagttaacaaaatgaaaagttgtatctcctctgagtacatttgtggacaagtgtacttaattgatgttctttaatttcatgtgcctgggaagatttttttttaaattgataatcaaagagggttaaaatagggaattagtcatgaaagcaatggcaacatttcataaacgaaatcgactctaggtttgaaaattggaaacaattaataactgtaggcttaacggcatttccttttaatttccttctttttgttacgtaaaatttaatttactgcctgtgtgcctcagtccaactattattagaaaattgcccttaaacttccaaggtattatacataaaagctctctgcaagccataatactaaatctcagcaaagagaataggaaagctaaatgttctgaaattgaagtcattctgctactgagcaggagagtaatttagcaaaccccgattaaatctctctcaataaaataacaatttcatatacatggcttcccattgtctgatagccaactgtatagtaaaatccattaaagtcatgccatagtacagtgtattgtattttcagggtttttctgagtttccctgaagtttttttcctttgttgtatgaaattaaatttattgcttgtgatattatcgaaataactcctggcgtctttccctgtcagtcttccttgataagaacttcattttgctttctaagactatggccatctccaataataaggtcctagtgatagtgtcatgggcatttttagcttaattagtggatggtgataccagtctattcttaatttgcattttctttccacattatattatttccgtcaatttgatctcattcgaagtcatccgtttcatgcagtgattacttttgattgcttttgccatattttttagatgtgtcctgagttagagagaaactgagtctttttcttccactgctcgtgtttagagttaagtggctgggcataggagcttggacatggctctcacggtcaggtgggcaaactcatgagcggcacgttgattgccagtgtcacgtggg

SEQ ID NO: 71799 - DNA, 1089 bp, Homo sapiens
cctttcctgcctcagggtctttgcaaatgctgctccctctgccgtctcctgtccattgcatggctggctcctcatcatcctataggtttcagcttacatgccacctcctcagagaagccctccttgaccatcccatctaagtaagtttctacctacctttcttattccttttttttttttaaactggtccctatttgttttctttataacatttgtcccaatctctaatcacgcacttattcatttccgatcttccgtcaccagaatgaaggcatgggtcatggatgcctatatccttccacagtgtcaagcatatagtatgcactaaaaaagtccttgtcaactgaaaaaatgctgctggtttaaggcagctttttcctggagaaagcctatatatatttatttcaaggccgatgtagagttttctgaatgtccgcagcttttaatgaaaaaacaacacacacacaaagtccctttgtcttggctattgtcctgtgtgtgcgtttctgtgtgtatgtgtgtgtgtgtgtgtgtgtgtgtgtgtcagggagtaggctggggaggagtcagttggagggaagagggaaaatactcatcttttcagaatgggaataggacaaatgaaggagagtaaaacttcatcctttattgctttttttcccttttctcctaatagcctgtaggtgttaatataaatgttaaaaatatttgtacagggtgtgcatgtatggtctaaagaattaattgttattaacacagcattgtgtattcctgtaacttatttctggtgttggggatgatttgattaattagttcttagaaaaacagatgctggtgccgcattctcggctttccaggcaaattgctattctctatatttgacccgtagcatgtagaattgtattctaccctatgaaaaatttataatcaacttcttaccttttaggcacatagagatgaaatccagcgcaaatttgatgctcttcgtaacagctgtactgtgagtattaattacccaaagacgattaaaataacatgaaactaaaacagaggaggaaaaggggacgtctctttaaaatattggtgact

SEQ ID NO: 71800 - DNA, 1341 bp, Homo sapiens
tcatttttgtttctcttaatgtaacatgtatttttctctggctgttttttttttttttaagattttctttttattattggacttaaacagtttcattatagtgtgctttaggttaattttcttcacatttcttatgcttggtacttacttgttgaatattttgcatctgtgggtttatggctttcatcaactttggaaaatttgtggccattatttcttgaaatattttttctgtctcctgtactccttctgggtctctaattgcatgtatgttaggctacttgaagttgtccacaactccctgatgctctgcattttttgaaaatgcctttttcttttctcattgtgtttcattttggtttctacttcttgtcttctacttctttgtttctacttgtcttcaagttcactaatcttttcttctaaagtatctaatctgccattataaactgacaatagtatttatggaaaaatagacatattagaaaaaacatcacagctctaaaatttttgactcagttatcttatagacttttttttttttttttttttgaggcggagtctcgccctgttgcccaggctggagtgtggtggcgtgatctcagctcactgcaagctctgccttccggttcacaccattctcctgcctcagcctccagagtagctgtgactacaggcacctgccaccacacccagctaattttttgtattttttagtagagaccatcctgttagccaggatggtcttaatctcctcacctcatgatctgcccgcctcggcttcccaaagtgctgggattacaggcatgagccactgcgcctggcctcctatagaccttcttatggagactttttttttttttataattaaatagaaggatcactcttacatctgccctaaactgggttctgggttcttatttgggttttcatacataagcagatgggaccatatccactttgtctatcaagtgaaaagtctgttagggcgtctttgactcctctttcctcttggccacacatctatcagtaagtccttttccttatgttttcaaaggagatctcagtttcatccactttctctgtttggtttgtttgtttgtttgtttttgccaccatccttctccaagccactatcatctctcgcttgaatgacagtaacagtaccttcattggtttccctgctacgttctacctttgttctattttgatcctcttctccctgtaacatctaccgtgatcttaaaacaacagtaaaatccgtcactttctttcttaaaattttccattggttttcaattaattgaattttgaatgaaacctaaattctttactggacct

SEQ ID NO: 71801 - DNA, 1069 bp, Homo sapiens
tccccatttccgtcagtgaacatctctaaacctctctttgattggggttacttccgtggaatgaatggccatgtacattcattgcttacactttacctcgatgtaatgcacgtgtacatctctatatctctatctatctatctatctatctatctatctatctatctatctatctatatctatatatatttaacgtagtttcattcttagaagttattgcccattgttgggtttggggatcccagtatctgaaccaaactgggaatgtgatctgacagtgccagggtctgtataggaccagtccaaggtttagtggcttccagtatgtttgtgcatcctagattttctaggacttacaccaagttcagatattgactgcacatttaggttccatagtctctatgagaacactcattaaatgatgccacatcatgcccccaaaatttgctttggcaaaaaataaccacagtatgtctttgtgtatactgtcttgtttcacagtggactgaaaaccacttggaaagatgcaacacagtaaaacagaacaaaataagaaacaaaaggcaaagagaaaataagtctgtagaagaaaaaatggagctaggaatgaagttgatatataagagttcatgccaagaaggcttatagacttgctggagttgggagttgggtgggtggagagagacagataacatttcttagcttttaaagggaggcacctaaatttcaaccactattatatttaacgcaatgtatattaatattttcctcctgtacctatacccaacctctgaaagaaaaagagacatcagcaatttaatccatatttaataagcccttgctatgggcccaatgctgtgtctttagctttttctccccaggggattggtctgtaattcctcaaatccgtttatttcagagcagccgagaaggacacatttatcttgctgctctgttggaattgggaaggaggggtgactgtgtatcttatcctggccctgtttggaaggaagagggcataaaatagagcacgtgtcactgctctttatctatggggaaattagtcctt

SEQ ID NO: 71802 - DNA, 1036 bp, Homo sapiens
cattaaagcagattacctaatgaggacacatcagagaaagcgtgtttaaaataaatagaattcagtctgttgtttcatttacaatcgaattgaaaagatgtccttgttactaatatgttgttatttatatctgcttagctttaaatgtttttctaataagagtaatcatcatcattttcattagtgattcttgctgtgtggcttttccttttaaagtcttcccaggcatttgaatatatgtaagtaaggggtggttaggagatatagcccttacctgttcttactcctgttgaattcagagatgcatggaactcaggcccattttgttgcattttcctctcctctatcgagtgccgagaaggtggttccaagaccaggtttcagctgcaggttgagtagcaggtcatgtcttcactttctcttttgttcagaccaagcaagggtttatctctctttctctctctctctctgtctcaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggtaggtctggggagcaacatcttcaggttgctaaaggcctcagctaggatgagtgtggaactggcactgagtatactggctcacccttagaaattccaggagggaaaacatgatccacaaagatattcagtggccaggaaattggcttacataggctgctgcttcattggaactagtagatgagcttggttggttatattcaaacttttcttagtatcttgaatagttcctcctttacttatatattttccttcttttgaaaaaatcatcattatattttaaagtttggtttcagtttgtttaaaagtttgtttaccttggctttctactttagttttcaataatcatttaaaataataat

SEQ ID NO: 71803 - DNA, 1056 bp, Homo sapiens
tgaactcctccattaggttcacctggagtgtctggttttattttcattttttctagcaatggggtcttgctatgttgcccaggctggtcttgagctcctggctttatttatttatttatttttcttttattatttcttaggtcaggatttctcagaaggaggacgtctggctttaagcagtcctccctccgtggcctccaaagtgctaggattacaggcatgagccttaagccttaggcgatggtttaacttttatcatccaggctatactttcactcttctgtaagtttaacagcaagatcacgggagactcgcccttaagtttgagtctaaacaatccagatggacttctctagcttgggggccttgactggctgtctcttgccttccctttgcacaaatgttcctcttaggagcctgccctgctgctgtagctcatctgggctattaaagtgtcccagggaagctgttgtttttcacttgaatcagtagagccagcccctcaaggatggtaagagaaacttcaaacgtttcacgagaggttcaggctctatattctccctgggagttttgcagtttagctctaaatataaccagatcagtccctcttcttttggccacatgctgctactgagattgagggcagaggcctccacctggagtttgatccgccttaaaggacctgggccttcccccaactttgtgtgtgcagcgttagctcttctctagccaggtgtgtggagtcacaaagatgcaggctcccgggttcttccttcattgtatagcatccagctcccgctcctccccttgagtcactgtcacctgcctctcttggttttgccaaatggcatcggaagcattttcaggcttgctagtagaggtccactctgctgtgactgatggtgttttagtaagacagaagggtacagtgtttaccctgtacatggtcaagtgcaatggtcaggacacgtagggatgttgcaggaatacagcaacatgttacatggactcttgagccagactttctgggtttgaatgccagtcctgccttttaaa

SEQ ID NO: 71804 - DNA, 1138 bp, Homo sapiens
aggctgtgttttgggtctttgagtcgttctaggttttgatacttctaagcagtttgctggagaggtgagggagatctgcagagaactagaaggaataccattctttctccttagtcctttttctccagggcctgccttcatgagttactggggtgcccttgtacattaatctaaggaggcccccttctgtccctacacagactcacagaagaaataaacaggcctgtcaaaggagtgaaatgttagtatctcttgcatcctcctggaccttacttaatcccatatgtgagggactgacactgagtggtgatgagtaaatggtccccacgttcgtcatgccgggatcatgcttatgaggccagatcaggagacagctaacccaggaatggccctagtccacttagtgaggagacatgtctaactccgtgtccgtctacctcccgtggaaacgggctcaaccctaatgagactgtgattttgtttggatcctcccaccacccccaccaggaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtgagagcgaggagtcatctcctgggaggatttgctgggcgattcgggctctgaacaagtcagctttcgagcacaaatcaatatctatacaagagacattgtgcttggtggttaagggggcagacttgaggcaggagaaaagggtctggaggcaaggaacctaaggccaattcatgctgaatcaaggaaaaacaccaaggtttatggcagggaatctgaggcccttgtgctaacctcttttttttttttttttaagagagtcttgctctgttgtccaggctggagtgcagtggtgcgatcttggttcactgcagcctccgcctcctgggttcaagtgattctcgtgcctcagcttctcgagtagctgggactacaggcgcctggcaccacacccagccaatttttgtagagacagggttttgccatgttgaccagactggtcttgaacttctgacc

SEQ ID NO: 71805 - DNA, 1016 bp, Homo sapiens
gggtgagaaggaatcactcagaaaatgacaaccctcgaggaggtggtgataaatgcgaatgtgcagatttgagttaagagacttgcaggcccaggtcacatgtagatgagatggggtttaacaaggcctgattactcccaggatgttaggttcttgaataggtccttatgtctgttttaaatgcaagccacttagccagtgtggggagatttcatcactgaaaaaacaaccaagtaccatccatttgagtggtaccatctgtgatcctcagagtacagactagttgagtgccttgttacctctagccaaattgccgtcatttcagatgaaacttttaccctggcccgcactgcccctgttactcctgttctggtgtgtgaagtttcataggtgccctgtgtttcagatgatcaatgctatggattccaagatcagatccctggaacagaggattgtggaactgtctgaagccaataaacttgcagcaaatagcagtctttttacccaaaggaacatgtaagtattcaaattctaactgccctacattattacactttggtctcctctcctgtggcataaactcccttcttctgtttgatggagctggagtggattgaatgacttctgtagctcagcccagccctcagatacttacgtcatcttgccctgtcttaagtggtctcactctgccacttttgagtcgggttttcttaaatgccttcaattaccatcacattacagagtgttttgctctctctaatgaggctatttataatttgcttgtggaaagctgcagttcttgttccctagacttgcatcctgtaattagtaagaggtgaaattgtgtgtgcccagttgggccatccatttagttgtcactaggttagaccctatggaaggaagtttggggttcagcaagggctgtgttccaggagcactttgagctgaatcttttcccccagagaattagaatctccaggatttttttcccccttaggtttctctcttcagagatc

SEQ ID NO: 71806 - DNA, 1928 bp, Homo sapiens
ctcataattttagaatcatgctcagacatccaagagagtgggccatttctcatccttttgagcttcttcctttctctcatgaccctgttcccaccttttggtcttctcttccaacttccattctattttttttcatcagtcagttctagtttaaagacctctttgaaatctgttctttcctttctttctcctgtggactccctccccgctgactggctctttttagggacgtcgtccccatgagctgtgacagtcctttcacaatagacattgttggaaaggcagattttagccctctctgtgaccccagctctttcagctttattcccaggatcctgttgtcctccttgatgttgttggtgttctttggaaaagtcgaatggagcctctgtggtgaggaacgtagggttgtggtcaaaggcttgggcatgttctgatgtcgtcttcttttttccttcctttttgcttgttgttttggcaactcgtagggctgtgtgtgccccaaagaacattagatcaagttggcgattggtgataccattactgttttatgtttcctcttgggaacagtaggtgcttacagtggcattctgagcactgagaacacatgatctctcttcccctgggaaaggtttcttttcccagtgacttttttttctccccctagttggatcagaggaaagaaccagggaaagaggcatttttttctttcttttatgttgtctttttaatctgttgaccatccacctacgttattggtggccaaaagcctcttgtccctggttgtttctgagcatcatccttggtcacatagacttcccctgtcttcggcttctctccctcttgcacacagcccaggagtatctagaattaatctgtataaattaggagtgaggaatattctgaaaactacgggtgcactggcgaagaaaaagttgtccccaggtaatatctgcagattataagaaatttattctctaggtctggatctagagcaatcttgtttcctcctcccttctcattctggagtctgcctcattttgaatatatctctctggtctttgggctgctgattttaaaataagttcttggttcaagtcaacctgttacttgccattggatggtaatatttgacttttcaatcttatcctgattgataagcggactcccagtttttgccttctctttgccccagaatttggagacctcgggcctctcccctgcttttctcctctttcctagattttctcaagtgtccccgtttagtcttccctcctcagcttggctcctgagaacatttgctgctgcttttgtttttgtaggtgttggacaatcagataaagaaagacctggctgacaaggagacactggagaacatgatgcagagacacgaggaggaggcccatgagaagggcaaaattctcagcgaacagaaggcggtaggtagaaggagttgccaagccagtgttcaaaggagggtttttgaaatatgccaagaatcacccctgataagactctatttcacctggtgaaattccttctgttgaatcctgtggagttgttggtaataggaggctttctctgaaactgtttcctttcctaaaagcaactgaggtggtggctctggatggccagttttgtgtttttcaagaactcatgctgttctgctgtctgctaaaatactgtccttctaaatgcccctgacaaaatgtccagtggctcttggtcttcctgctcttttttttttttttgaggtggggttttgctctgaagcccaggctgcaatgtggtggtgcaatcatggctcactgcagcctccaactcctgggctcaagtgatccttccacctcagcctcccaagtaactgagactacaggtgcatgcccccatgcttacctaatttttaagttttctgtagagacgagatc

SEQ ID NO: 71807 - DNA, 1059 bp, Homo sapiens
acaactccactatgtgaagtatttgaaggtctgcttctgctctgttgtttctcttggttctttgtcatggtgactgttttattttccttggagaattattaatggaaattctttgaggccttggatgaaatgtgtgcccaccttggtgggtggtcgggggctttcatttctgccttttcttgaccactgaggctataaaaactgaaacttaagttaatttgtttcagtaaaatatctcaggttaaacccttcttacctctccctgcttctgttttacttagtttttggcaatttcttactctcttgccaacttgtaggtgcttttgggaaaatgttttttatattttatctagcattttaaatcattttcaagagaagggctggcctgacatgtagcccactatgctattagaaatggctgccgctctatcaatttcctttaaaatcacatcccattttcatgatgatttggatcaagcctttaattcattcttatgttcttgagaatcagatgctgtttattatatcttgaatattgtcgcttcccttttccaaccagacattgaagggggatttcaatttttgtgatgatcttgttattgatttggttggtattctcaaagaattgagtggtcctttcttggagaatctaacacgtacatgctcacacagcatcatcaccatcaccaccctggcatcttttaccgctggcgttatttttggttgtttttcagtaaaagaaatataggaggccaggcacagtggttcacatctgtaatttcagcactttgtggggctaaggtgggcagatcgcttgagtccagggattcgagaccagtctgtgtaacaaagtgagacgcccttctcatcttgtctacaaaaaatacaaaaattagccaggcaggtggcacacatctgtagtcccagctgcttgggagcctgaggtgggaggatcgcttgtgatcaggaggttgaggctgcagtgagccacctttgcatgatgaaagtaaccttttgtgaaacatattctatgatttggtgatatattgatgttcctac

SEQ ID NO: 71808 - DNA, 1087 bp, Homo sapiens
aaaacttgaagtgcttggatcataacattagttttcctttttagctagggttcttgagcaataattctgttaatgaggaaaatacaaagtatttttaaaaatcataatcatatattaaaatgacttttctcatttaaggctcaagatagtggtcagggctttgtcatgtactaaactttccagtgttgccttgttactcttatttctctatgcaaagatgaagagctgcctttgttcgacctgtcatactgacgtatttgtggtctcaggccttacagcccaccagctatgtgtgtatgtgtgtgcgaatacttggacttggaaaacccagggccaaggcgtggtggtttccttcccaagagccttaggctagtaatggaggaccagatgaccgttacctgtggtacctgtaccaaagtcatgtttcctgtgaatgtctaacgtgcattggcggtgtcctgccctctgcacacctgactgtcttttcttttgtgtctaggagctcgaagagaaacatcgggaggcccaagtctcagcccagcacctagaagtgcacctgaaacagaaagagcagcactatgaggaaaagattaaagtaaagacattttctgatcttccctggccttgctcctatagtaccatgtagctcccatctcttcctgggcccttgtggccatttcttgctggaccaaagtactgtttggggtgaataatgtccttattccatggtgagagatttcagggtgttacttatgtgaaggattggaaatctgaagttccaaaaaaaaaacctttttttttttttaaatgtggtcatcatttatctcaatttcatctttaaactgattttttaaactcattgtcatttaatccatgatcatttctataatcctttttcttttttaatttttgtgggtacatagtaggtgtatatatttatggggtacatgagatgttttgatacagacatgcaatatgaaataagcacatcatagagaatggggtgtccatcccctcaaacatttatcctttgagttacaaataatctaattacattctttaagttattttaaaatacacaattaag

SEQ ID NO: 71809 - DNA, 1082 bp, Homo sapiens
attctgtctcaggctctgatcaccaaattaacttgatcaaggaaggttcgggtggtatttgcagatgtgttgacgttttgcccctgccagggtggaagacagcacctttgaagggctctccttggacctcagtcccacagccagaaatttgacatcatgtttgagactcaaggatgacttggagtccattcctatcccacctgggagagagtctctgaagtcattggtcattcctctccaccctaaggaggcaaggtcgtgagcagggcacttcatctctctctcttcacatcacttctgggaaatgagtcaccagcaactattggaattccatagtggccaacttataggtctatacttaataccaaatcaaactgtttacaactttacatttctgtttgtgtgtatttataaatatatggatgttctcgaatcaacaggtaaaagaaaaatgggttaaattgttttgctaagacacccagtctttgtatatatgtctgcacacaaagacaaatgtgactgttagtctaccctttctgttctcttgttccgtcatcaaagtttctcttggctattgtcaagtgtttgaattttatcatgagtataaaattagatcccactgagatcccaccgctgctgtcccttgcttggtataaacggagtggttaactctcttgtggttgcaaagtgtttctctgtttaatggtgatgtgttcattcattcattcaacaaatatttaatgagcttctactatgtgccaggcactgttctaggagctggaaatttagcagcaaacaacagtatttgcataacaggactgaagagttgatccaatatatctagaaaatacctgtttaaaaaatgacaacaacaacaaaaaatgccaaactaccaaggagtcagatttttagaatatctgctcttcctaaggttcacttacaattaaaatggaggagtagagagttctgcattcttggattatgtgttataaactcccattcacaaatagaccagaaatttggtcttaaagttgtcagtctcagatacctgagttttttgatctaatcttagattctgattt

SEQ ID NO: 71810 - DNA, 1126 bp, Homo sapiens
tcttccccctcctctcctgtccttcctcctgcaaaacaccatataccacccccctccagagctcacgcctctctgatgtctctgctcaactgtccaattaaaagtcctctttcctgcctgcaacctcctgcagcactttgtacctctttgctttatggttcttcctcctcttaacctatattatgattatttgtgtttatcttatctcctccaagggcaggaatgatgccatcttcctctgtattttccgtgatgcctaggtggcactttgcagatagtaggtgcttggtaaatatttgaatgaatgaatgcactcttgtaacctacacaactgagtacctagattatagaatcttattttctctgctgttgcttcgggtgcctgagacttttcttcctgactcgagtgtatgcttcttgagggctctttccctcggtgcaggtgttatgcccatagcggttactccattaaaactctctgattgattcatgatctacaggaacgccgccattctctggagaacaaggtaaagagactagagaccatggagcgtagagaaaacagactgaaggatgacatccagacaaaatcccaacagatccagcagatggctgataaaattctggtgagcaggaatgaaagtcgcaaagttaaaagataacaggttagagtttgcaaagggaagggggtaagaagaagaattaaccgccacaataagggaggtatctccaagtagatgaattgagtgaggtggtttcagcatatgccacatcgtagagtagtatgaataaccaaataacggacatttcagcactggtaacagatccgtaaatatcgttttttgctctgtttgctacagcctggctttttttttttttttagtggaacgtgcatctatcattttcaatacatttttaaaggcgtgttgacatacttctatcagcagagctttggatagctgtcaacttcgcattgccaatttaaaaagctgtaggggtttagacctttaagaccgaaattcagattcttgcttttagagaagaaagcaattagtcatacagaattgttttgctaggagtagtatttgtcatagatccatgttcacccactcactttctctgctac

SEQ ID NO: 71811 - DNA, 1024 bp, Homo sapiens
atccatttagatctttctatttccattcattacgttgcatcgaatcgaagatgctaatgatggtcagatacaccattatcttatataccccaagaaagaaaaatgcatcaattttaattgtggggtggatttcaaattcagtgatgttaaaaaaagtgcaccttagaataatgaaatatagaattaaatgattgtgtatttgttttgacaaatggtaaattcagtattacctgctttttaaatttaggacactgtcactatctttttttttttttttttagattatactttaagttctgggatacatgtgcagaacatactgtcaccatctttttatatgaataaatttgcccacctatctccttttccttctctcttcctaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggtgagcagggaacctccagcccaggccccagcggcctcggcctttggctgtgcccaaggaaagaaactgccagaccatcacttgcttatgtttgaccaaagctgctttcccttctgaagatccctttgaaacctgagaggctgggaatcatttccccccaggggaaagaaagatttgtcatagcagcttcaagtagaaagatgtcttcatagaagttttttctttctgtttattttcctctgacctacccactaatctgggagaattttgatttttataggtaaaccgaagctccatcactggttttttctttctcttccctctgttttttccttgcctttcccctccacgatattaatagcatattaattttcaaggcttcacctattacctgcgcgtcaatgactctcagatctatatttttgggcctcttgtctacttcaaattctttgttgttgttgttgttgaaatcatttgtataattttaccagaaccacatg

SEQ ID NO: 71812 - DNA, 1306 bp, Homo sapiens
tgcctcctgggttcaagcgattctcctgcctcagcctcccaagtagctgggactataggcccgcaccaccacacccagctaatttttgtatttttagcagagacagtgtttcaccatgttggccaggatggtcttgaactcctgacgtcaggtgatccacctgccttggcctcccaaagtgctgggattacaggcgtgagccactgcacctggccaggtcttttctttgccagtctctcttcactgtgcatcttccctgtgtggttaatactcttccatcctcactgcctgtctattcttttcggagttcgaaagttctcttttatttcattgcctgctctttaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggtagtcagccaccctccaggagggtgctttttgggtaaaattgtacatgatcttagcaagaaaaaggagaacctagtttaatgagaaacaacctagtttgagaaatagtaggataccttggaaaactcttggtctttatttacagaagataacattattcttatttactattattatcttggtcacagagaccaagaaagtagtctacacgacttttttaggttgttgagatttcccaatatgttgtgtctttttaattacaggctaaggatcaagggaagcctgaagtgggagaatatgcgaaactggagaaggtatactttccatgattggttttgctattaatattttgggtagataacttttttcatgttattatcagtggcccatcattgatgaagagtattcttcatcaatgaatagagacctctcttcgaggcttattttgatagtccacctttgggtgaccacatatgactttatggctctaaaagaggtaaaagacagctcatttttgtcacacctgcccacagcaacaaacccagacacttagtaaaaagtataggaaaattgttattgttttaaaggactgagcgactttctctttttgccatttgtatgttgctggtcctacatgcatcatcaacatggagctttgcactgggacaaagtcttccctgagaggccactgttcttcctctcccttaataggttctggaaacccaaagaaaaagaccccatagaaacctcaagagaataggactgcaataaatgtagcaagatgttaatg

SEQ ID NO: 71813 - DNA, 1143 bp, Homo sapiens
actgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcaggtaggcctgcttgcctgggagcacagcagcatctcggcttgcttggacctctaatttcaggagaggcgtgtttgagagagaaataggaagaaagggagagagagaaagggtgggggcagagtggaagagagacaggtatgtaggtcattcagaaacttcagatttctcataatttatatacatcatagaatgcttgttccagctccttttgaagctgataccccataatgtctgcttttaaaaataaagatgtaggtttagagcaagagtgggcagacttcagcctgtggggcaaagctggtccaacacctattttctatggcccacaagctaagaatggggttacgtttttaaacagttggaaaaaaaatcaaaagtaaaacaatatttcatgacatttgaaatttatatgaaattcaaatttcagtctccataaataaagtgttttttttttggaacacagccatgcttggtaatttgcatatcggccctggctgctttcaggctacagagtcagaggtgagtggttgttacagagaccatgtggcctgcaaagctgaaactacttactatctggcttcttacagcaaaagtttgccaatccctgctttagatggttaaaaacaattaaatgttttaatagcttctcagatgcacttttaagtttttgagtgaagccaggctaattcatagttttacttacataaaga

SEQ ID NO: 71814 - DNA, 1640 bp, Homo sapiens
cactaaaggtggggccctcagctgagctaattttgagtcccctcattttggcttcaagtatactcattcttggttttcccaagaatatctgggatttgtgatctgtgttatctgtggtttggtgtcgtattttgcaggcatagggtcctattcctaagggaataaatggatggcttgatgcttaagcacgaacttaatcatcgcagtagtgattaaagagtattcaacatgtacacttgcttgtaggaaggagtacacattgtattctcttttgatatgcaatattttattcatagccctattaagtaattttttttaacaaagttatatggattatttacaggtacatcacgggaaaactgcattttataattttcactgaaatgttgaggttacatgtaaagcaatttttatgtcatatctgatacattttaagaaaacatgtcttcctgttacagcggtaatgaccatgcctgctctttcttctgtgtcatatgccattatccctattaatactctttgggcttctataattataaagcagatgtgtatatcagggagagatgttgatttcagagtaagtttttctagaaaatagaagctggaaaaaaaaggaaaacccaaacttggcttcgtgctcgaagagacagcactgctgtgtgtgggcgggtggctgcgtgcacccgctgctcagaagtgccttttctctccatggggataactggctgtgtatccgagatgtggccaggagtaggcaagcaacgtgtgggcaggctgcatgttcttttattagcatcttcattgtactgcatctcgtcgagcccagagcatgaactggcctgggtttctaatatctaccctgcttcccacctaattactcccctgaaccctaaagtgagggagggagagttgctcttgtggggtgagctttccctggggtggctgtgaaccaacctggcatgtggatgttcttgggtatccagagctgtcctggactcaggcttggagtcagcttcttagcactgaatgcagccagtcatggatggaggtcactgtatctcacatgttccgctctccctttcctccatgaccttgcccctctgagcctctgtagcacttttcttgagtgtgtccaaggccatctagctaagaagtagcagaaatgggatttgaagccatgactgtttggtgatagagcctcagctttgaactggggttctactgcctggcacccctgcacaaatcatggtaacgtggtaggagaacatagaggtatagggcaagcccctccttaatgccatgaataatacccatcttataggattgtggggaggactcagtgaagtaacccatgaagcactaaacacgtgcctgacacgtgctcaataaatgagcacttgtcctgatgacaaaggtcgtggcattaattctctctcctagattgttacttccttgaggacaggaattgtggcttccttaatggccactgcagcagagtttctcaagttggcactattgacattttgggctggataattcttgttgtgggagctgtcctgtggattgtaggatgttgagcagcatctttggcctctacccactacatattaatagcacccctagtcatgaaaataaaatgt

SEQ ID NO: 71815 - DNA, 1036 bp, Homo sapiens
aagatacctttaggaaatctaatccagacaatcctagcccagtcctgaagattaggctccagaagatctgtcaagtgtgttttttgctggcctacacatgctaatttgcatggttgcctgggatcccttaagaagacagtcattgactaaatggcgctacatgttcccaagctctgcgccagtctggcaactcttcctttgtctacgtgaatttctcctagttctttttgctttgcttgctgttcatctcctgacctctctccgacaaacttcctgaaagaagagcctgcactcaacacctcttttttccacctcttcaacaatactgaaatgactgtctcagaagccgttgattgtacctaaccaccaaatctggtgatttccatctcaccacgtgataccattaatactacctttcttcgagacaacgttctactttcttctcttctgtattatggacacttggtttccctcctacctctctgactgtcattctcactcttttgtggctgccatcaggctcttgcaatgtacgtaccatctcctcaagttccatcctcagttatctttctagttggttcttggtgatctcattcagttccttgactttagttcttacctccccatggcctcctcccatcgtacactgtgttcctcatcaccaggatgttttaccagtttctcaccatcccatcctctgttcccttcctacatagacagacccactcgctcactcagtaagccactaggtgctagttttggcttcttcattttatgtaagaaactaccaccttccctacccttctaggcaagaaagctgagtcatcgtaaattcttttctgcctcccccgccatcccatcagttgccaatttctccaagtggtgcctctaggatgccacttgcatccatacccatctttcttcctcattggcacccatcatggactcttgcttggtctggtgcagtagcctcctcagtgattcccttgcctctggttttcctggctgtaatccattctccacaaagggtggaatt

SEQ ID NO: 71816 - DNA, 2374 bp, Homo sapiens
ttacaaacttgtaagttttgagccacattaaaaaccatcctgggctgcatgcagcccccggggccttgggttggacaagcttgctgtagaaggtaaaaatcagttggttttatgtttttgttttaaacatgctggttgtatgcttttggaagagttggggaacactgagggtaatgggatcttgatggggctggaatttgtgggaagatggtgtctgggtaggctgtttttaggaaggggcactctcttccttttgattcagagatttttcctttcttttcgggtggttctgaaaacacagcgatggatccaggcattcaaacaccatggaggaaggaagagtggctgttgccattgcttcccgagttttctgggaaccagtttttggtgcctcttccttgctctactggggcttctctgcatgtcagtttcttcaactgcgaagtggaaggacagcgatacttttcttacaggacttttgcggggatggatgaaatacgtaaaacacttggtctagtacctggcacatggaaaagccttggtaaatgttcactgttgttatttttgttattactaatacactagtccatgtatgtatagtgtcctcctatacacaccaagagaatatggaaaggactcagcaatgattaggtagtccaaagtcataccagattggaaaccaagcttcccaggccctgggacttttctgctagagacacttcacggttctgaccaactacaaagagttaatatgcagttgccaaatacctgttggtaaaaggtggatgttggggaggagtggattggggaacagaattagaaggtccagtcccagaatgggtaccttcccatcaagttgaacaagtcaaaacaggttatgttgaaacaactgagagaaagtaaagcaaacaccattgctgcagaatatcatggtacaaattggacatctttgggagttagcggagtaaggcaaaatccagtgagggacgcttaatgggtaatgccaattcacaattcttgttaaattacattgctgatcttccttggaatgtctgtccattcccccaagtagactgtgatctcaaggcaaggctgggtcttattcatcctggttttcctggagcagtaaatacttgtgctggaactgggcttataagcatactaatggaaagtaaaatatttgggttggttttttaaaaagacagtggatttggatcagtggagaggaaggtagagggaatttcaggtgggcagggtgctaacaacagcccatccttacagggcaccaactgtgttctaggctgtgttccaaccactttacacagatgaattcatttaaattgcacaaccagcccaagaggaaggtaccattattattctcattttggatgtgaggaaactgaggcgtggggagatcaaacaacttgcctaaagttatgtagctttgagtggcttagctgagatttgaaccctgtgggtataaacgccacagatgggaaatttgtgtggggtacccaggttcatgtgcttgttagaagtggaagctatttgtagagaatcacgaatgatgaggttggggcagggtgtgatgggagctgacaggcaggtctaaatgctgggattcattttcagtctctgtgtttattgagtaggtagacggtatagctcttggatttctcagattttttcctcttttcatttagagactcttatctggtgtgtgtgtgcccgcacacatacataaacccacgcgtatatactctttccctgaatgttcttatttgctaaagcttaagcttggcaaagagaggaaactgcactgaccttactctccaccatatcttcaggctgatcatacacaagttgcttaataagcatttggttaatccatctaaatcattcttatggctgcaactctcattttgttgatgactctactatctatgtctattcacatctacattttgtacttttgtttgcctcccatctgtcctgggatggctgataccagtggaagacagcctgaactctccaatcagtcctgtttcctttttatgaaatacttggaggttggaggatcttcccttaaaaagtgttttcctttctacatccagccaaaggctcttggtccttgtgcttgctacctagatccctattggaaagagtcttgcctgcaatttgattttttaaatagcagcaataacagagtcgtctctgctacacgaagacatgcatctgctgtatttcccagacaagttcaaaaaccttaactagcttctgcccatggttattgctctcaagtgccttgtgttgttcccatcccctcattatctggattagatgtttaacatttgcctgtgtgtgttgtgttgga

SEQ ID NO: 71817 - DNA, 1003 bp, Homo sapiens
tcgccagcgccgaaggagtaagacgatcttctccgcaacagtgttgaatccggctgaaattttttttcctccccgcctcctttcttgtttttctttaaccagctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtaagtgaaaatttgactttctaaagggacctgcattgatgcaaggcttttggagccaaaggtggtggtgggggggtgggggaataggtggggggagtgcagtggagggaagctgctagtcacctgcattgggaaagcagtctacctgttagggctttgcgggggtagcctgttaatattctcattttgcagtgtgtaaggtacctgttcctgtctgtggtatgataattgtcaattgggtactttgggttagttttccaatctttggtcttctttaaaggggagagagtgggagatttccagcagtgcagatccccggtcaaaggagaaatgtgcaggagttaagatgagctgcccatctatctaaccatctatgtatctgtctctcaagtgggtggatgggggttgctatcttggctgtataaagaatcctaaaaaccttgtctcataagctagaggtttcctgatgggtttaactgagctgcaagtggctgaaccagagctctaacagagagatggtgctcggctcctctccaagtatgctgcaagatcagggatctggcagctgagcctctctgagctggtggagcgctggcagccagagaaagccccgttactgtgagccaccaggagggagtgtgatgtagccgagtcattgattcacagaaactgggcttcatagggggaaaaaaaaccaggagactagaaaatggaaat

SEQ ID NO: 71818 - DNA, 1056 bp, Homo sapiens
atggggtcttctgacctacaatcagacaaggcagaggaaatttctttatggccagctccaagtcagaaaggtgggggaagattagagtcctgccttgagcagatgaaaggagggctggaggaggtcagagagagagagattctgtttttcaaggcctgcttctaaagcctaaagcacccctaaataacaaaagattgtaacaaggactatgggagtcataagccaggaaccgtggatgaaaacctatatatatgtatatatatatctcataataattcaaacctgtctcctgttaatcccatcctctctgtttctgttatcatttccttagtgtagatctgcctaagtgtagaatttgtagaatttgtcatgttgactattgtagacttgtcttttagagtttctagcactagcctcttccacccatcactattgagatgattgtatccgtctcagtactgacactaacccagcactctggttttacatctgtcaatccatcaagacttcactttcactttcttccctgcctcattattcactatgctcttgggccattgctctggcttctggggcttttctaaagtagcacttttccccactccagcccatgaagataccttttaaccagctcttgagattaaatcccctccgtgacactttcctgcaggaacttgcaaaaaagtactgcattccccactggcaaaacttgccatcagccagtttatgtattctctgcttttcacacccatatcttgacctctgaacaacacacatattctcctcttcatttatttcacagttctgtcttcataacattgataagtatgatcacattagcgctctagattttaagcaactggaagatagctatttttttggtactcttcctttaaatttgaacatagtgtctaattagtcaattaacatttttttaaaagggcgagggacatcatggtagagagaacgaagttgaacgtgtttttggttgaatattagcgcatgcccactgtattctaggcacagtcctgattcattatatcatcacacaataat

SEQ ID NO: 71819 - DNA, 1098 bp, Homo sapiens
attgatgaacacatttgggtatggccctaccttcattgaatttagagtctaagagcctaaccggtcttttgcttgaatagagctgtagtcctgttaaattgctgtacctccaaatggtgggaagtttaatgcttcgtaggcctcccctcactagtttactgaaccacatgtgcttgatttttttttgagatggggtctcgctctgttgcccaggccggagtgcagtggcgtgatctcggctcactgcaagctccgcctcccaggttcacgccattcttctgcctcagcctcccgagtagctgggactacaggtgcccgccaacacgcccggctaatttttttgtatttttagtagagacagggttttaccatgttagccaggatggtctcggtctcctgacctcgtgatccacctgcctcagcctcccaaagtgctgggattacaggcatgagccactgtgcctggccccacatgtgcttgattttaagcaaaatacagactataggctgtgacctggtgatctcttccccacatacagcatcctgctaacctataactctccccatgtctcagatctagcctgggaaaggacaatgttggatcgatggcccacttctaatcttgggatttctaatctcaagatgagttgagaagactcaggatgtgtcctgttttctgtttatttagaacagggtttctcagccttggcactgttgacatttggggccagataattctttgctgtgggggctgttgtgtgaattgcaggatgttgaacagcatcgctgtgctttctccatggataccagtagcaccctccccctgcagttgcaacaaccaaaaatgactctagacattgcccagtctccccttgggggctacagtcaccttcagttgagaaccattgatttagaagaattggccaggttattatcaggagagggaacatcacagtaatctgaatctctcaatactgccactgttactgttaacgaacagcaaaactattacgtggaggcagtaggaccttgctactcagagtgtggtccgtggaccggcagcatcggaatcatctaggagcttgttagagcttcaga

SEQ ID NO: 71820 - DNA, 1039 bp, Homo sapiens
tcttacataacagtgtcactgtctaagtgtttgaaaaactatttgtcaaaactaatattggtacattattgttaactacacttcagactttttttggattttaccaattctcccactcatgtcccttttctgtttcaggaatcaatccgtggtaccatattgcagttagggtgtttatatttgatgggactggtcctagtttagatacttagtgtagctcagccagcaggtgggatcttcatgcccaccgaggattggtattgtgttttcctggtggttttatggcatttccgactatgcagagaggcatggtattaacttcagtgtctcctagcaaattttcctgtttttcaccaacctctgatccctgcattatttgcaatcaactcagagatttgtgattgaaaacattgcttgactccatgctctttaagctattttctaactaggtaactgtaacataaattatgcttttatctagcactgtttttcataaacacatgttgagtgattttcatcaaccgaaatacttcgaatcattaagtttcccaagttcatggatgctgcttaaatgcctggtggttccaggctgtcgaatatttctgccttctgcaataagagattgtcccttgttaaaagcaacattagcctttgtgcggtttcacccccaattcttctttttcttgttgtaaccaatgaaaggaagtactgcttaacacagcaggtaataatcttctaaaactcattatctcaagaggtggtcctggcaggatatataaatgcaatttaagaaaggtcttggcaaatttatgaatgacagaactgggagtggctaccgagagaaactaggatgcgcctttgctttgacactgaggtcaggcgtagcttctgtacactcctgggtcctgcctcttggggttgctgcaggcagcaccccatgaaccaggcatctgacccagttccaggatacttattcttccagcaagtcgaacactctgtgatgagtgactgccatgctcatgggtcaccaggctctcat

SEQ ID NO: 71821 - DNA, 2147 bp, Homo sapiens
aggtactgttaggtagcaggtttacagggatgagcagaagaagcaggccctctctgccttctttctttttcatcacactgaaatcacagcgcattgtgtgtgtgcaaaagtagagtgcagagggaacatgcagaaaggagttataggatagaaaaggtagccaaggaaagcagcaagaacagcatgatttgttcagggatctttaaatagctcatcattgttggacagcaaagggagagatggggaatgtggcaagatgagatgagaaggggagccggggtcaagccatggaggacgctgaacccctacaaaggaactaagcctattgatgtgaacaggccacttattttgggaacacgcctttggtccaaagggaagagggcacgaaacttccttctctaaaaaacaaaaaaaaagaaacttgcatatatgagaaatactttcttcactttgcagcatgagaaacggaatccctactaaggaaataattctcttattttttttggaacagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactgtaagtagggctgttttccttaatttgggatgttgggattatgaaacactcaagagagatctgagattgttctggcccaaagaagcttctgtaaattacataaataaaggctttaattatctacaggagtagtaaaggctaatgatgtagctgtctttgagtaataattctgccttaaaattgtttgtgtagaactgggtcatttatcaaactctgtgtttatgtggcctttagaatattatccctcagtaagttagaggcacagattaatggagtttgaaggttgtcacttggtttgacacagtttcttccaaaaaagtggatctaggtatttcattcacatatcaggaaaaagactcagattaggcaacatgcccaggttgttctgctaatggctgagtttaaacaaaaaccataaacacctccctgtgtttattcatttgtttccctcgataatatttgtctttgctcacaagcatgtaaaacctataatgtatatgcacagtagattcattcatacatcactttttataatcagttagtgcaaactgaatgaattcattaaaaacaaagacctggtttattatcaacagaaaccacacaatgctcttttttcttttaccagttggtgatcttttaaaaatccttttaattcttggatgtgttgttgattgaatgtgttctactgaatgatcagcacggattagagccagtaggaaagcagttatcctgtttgagtatgtgttttgtttttggtgatggagggaggttgggaaatggaatctgtttctaggtgtcaaaaccaggcttctgattggagatgtgttataattataattgcttgcaccttcagctaggacatagtatggtaaaaaatcagtattgtccagttgtaaaccattttgatggtttctctaaccttctgctgaaatatttaagtaggtcgcatttccataaatctttcttggcaaatgtttttattattcgggtggccacattgctttatttttctaaataaatagacatctccccccaaatctccaaggttcagaccttctaatcagtaatatattttcagggcattcttccttttatgcttttagaaagatgtaatagactttcttttagatgctgttcaagtacttaatcttttcttgtcttgcctttttatctctgtaatcttcttgaataagcagttaattttttttattcatgaacctgctgatcatgtctaagaatgtatctccacttaagtaagtcagtgaatggtgattacctgagtagagttaaagtagtcccccaccctcctatctgtggcacatatgttccaagtctcccagtggatgtgtgaaactgatgatagtactgaaacccatctaccttttttcctgtgcatacatacctatgttatataaagcttaacttataaattaggcataatatatttgactcccagctcccagtgtagtggctctgaagact

SEQ ID NO: 71822 - DNA, 1249 bp, Homo sapiens
ctggggtaggagggttgggggaagtggggtttgagaacccttagttgatcatgcctgcagtaggttgagaagcatcagaaagctaattaattagacaggaatatgtgtttgcagtaagaaaacctcagcaaactaatcaagttccaaagttactgcttggtaaataaataggaattaagaataagaccctatctctgtgtctggggtcattctcttcggagctcttggtggagagacagggttcccagtttcaattttttagtgcttcagactgcccttttcagttataattgtaacaaccttcactccaggtggggagcctcccaggtttatttacaacaaggctcaatctctgattattttggtcaaggagatatgacactctataccacacacttgagaatattgcctctctttttctcttgagcttttagggttggaacgtgacaggcagataaggaattttttgcattaagtgcaaagtcctttttcttatagaagagcaataatctgcacactagatcaagtcaagtgtggatataaaattataatttttggggggatatttttaatagtggttttgggttaaacatatttcctttaaatgaaatgtctgtaggcctaaagtaggttctaaatgttgcctgtactcatagtataccatataaaatataatccacatttactggaactaccatatattacttaccccaaatcaatcaatcccttccctatcacccccacgtaatatcttcgtattttggatacctgtgaatcttagatctgttcagttttccattatccattgtcttatttcaagcttctcattcagaatgttgctttggagtattttctgttagtaaacacagggcctagtgactctaggacctgctgtgtgacttaggtcacccacttcactttattagaatctcaaagaatggtgaacagctgagttccaatctgtctcatttggctctcatgaaaacagtcataaggagattgtagataaaccacattatatagcatagtaagtgataatcaaccccatttggcagttgcaaccccacaagagatagccctttttagatttgtgtaggagtgaaaagctttattttccacaagaggaacgacatagtaagaactccttttccccctgcttctgcaggtatatgcttatgccctaggcaacttgatgggtaaagttaggtttaaatagttttatttgtaagctcttctcttctcttctctt

SEQ ID NO: 71823 - DNA, 1033 bp, Homo sapiens
cccgccaccatgcccagctaattttttgtatttttagtagagacggggtttcaccgtgttagccaggatggtctcgatctcctgacctcgtgatccactcgcttcggcctcccaaagtgctgggattacaggcataagccactgcgcccggctcttttttttcttaaactgcttccagaaaagtggatattattaggttgatgttaagaaaaggcttggagttgcattaactttttgctttctagcatctggcctgtctgttctgcagacctgagacctacttgagataattttcttggtgttcaggcccttggaaaaataagttccctatgttgtccagtgtcaaagtttctcaacctcagcactattctttttttcaggttattttcttgtaatctgttcacttgatcattacattaagaattagattatattgctataactacaaagcattttatgttttaaaaattatgtacaatttagaaacaggcatgaaaacttaggtattaaatttagtggaataaagcacagaaaaaaagttaaaataatgcagttttatcacttaggattaaacatttatatgggccgggtgtagtgcctcacacctgtaatcccagcacgtttggaggtcgaggcgggaggattgctggagtttgagaccagcctgggcaacaaaatgagacctagtctctacaaaaaatcaaaaaattagccagacatggtagtacatgcttgtagctccagccacatgggaggccaagacagtaggatcgctggagcgaaggaggttgaggctgcaatgaccgtgtttgcaccattgcattccagcctgggcgacagaacaagaccctgtcttaaaacaaatttatatgctgcattcgtgaaattaaaaaaaaatcatggatttagaaataaattgaagcaaggtacattgacagtgtaacctcagcactactgacattttgatctgaataattctttgttgtgggggatgcgctgtataagatgtttagctgcatccctgactcctacc

SEQ ID NO: 71824 - DNA, 1025 bp, Homo sapiens
tctgagaatgttgtgggaatacaatgattgttagtccaggaatcacaaaatttgagatagagtctcagcttttccattgcctagctacatgaccttgggaaaatttcatagctccttttggccttagttttcctcatgtgaaatgtgtgtctctaggagaaataatccattgaataatatgtgtttcatttctcttccttttctttctctcctatccttccttgctccctctcgccctttttctctttccccctctctccctctctctctccttccttccttcctttcggttaaattcattttgcaaaatgtatgctaataatttatatccaccaatagaggaggtctatataacagaatacataaacaaagatttttggctcaattgagattctaggttagcacttgcttgctgattgggatggaggaggcaattcatggtcctgattttcttacagagacatcaagcctgagaacattctcgttgaccgcacaggacacatcaagctggtggattttggatctgccgcgaaaatgaattcaaacaagatggtaaaaaatggaataagatagcttaatagagtttatactaaaaagtattcttggtcctcctaagtttgggaagtgttgggataaaatggtgaacaatgttttggagcctttggcagtgtatgggggtggggacagggacacagaaccatttcccagaccgtggcacctttttatttatagtgcctgttaataccctccaagacatttttaggagcattgttatagtttggttagaaataaaggaaaatgcttattttgtttctctcttcattttccttgcctgttatagactgtcttttgttatattatcttttttactttaaaatattttgatgaaatggaaactcctgcatgtcaaatcctctatttcctatgcagcaaaattgaaattaatcactggagcatttgaaccaaatatccttaagtgttaagaaccaagtgctcaaaatatcatttttaagtcttggatcttt

SEQ ID NO: 71825 - DNA, 2283 bp, Homo sapiens
gtgtctggcttaatgtctgctgttgtcagaaaccatgtgaatggagtagattcccaggttataaggagcccccagggaggatgcgcgagtcactggcttctccaggggtctctggtttggggttgccttggtgctgggcacacttcctggagattttactggaccagcctgaggcctttggggctctgtgcagatgctctacttctgacttgtctagagctttcttctaattctggactaaaagcaagcaggagtttggaggatgatggtgagaattcacatccccgagttggcttttggaatgcagtagtttgtgagatttagtgttttttttaagaagtatattcagatcttgcctttttcccagaaagcatatgagacaacttccaagacatttatagcatggctaataaaatgggaaatcagggcgaaggacaggagaactcaataagggttaacatggctacagcgattgtctaaatgggttctttttgctggccagagcagaaaggatcatgcagtaaagtgggggggaagaaagggaattgaatggtaggtgaagacttcatgttggtgccaggcactgtgccaggccctcctaggaccttgtcttactcaatcctcacacagtgctgcaagaggattagtcttatccctgttttagagaggatgaaactgaaaggcagcgaggtgaagtcaccagcaggaggctgaagccgcccaggctaactggccttatagctacctagggactcaggaatatcacacctgtttatcatcaaaaggagaaaggatttcagttccttggggtagaagagtttctttttgctaatcaaacattttacttgaggcttcatattcttcttcaagatttttttcctgtgtatgtaccaacacatgtaataattccttgtttatttcaaaaaaggggttgtactttattctttacaagatttcactttatattgtcatggacaattttccatggcagtatgaataaatggaatctgtttgtttttaatatctttgtcttatcccattgtttacatatgtcatattttagccagtctctaactgatggatagctgaatgatttccatgtttttttcccctgttacaaacaatactgcaaggaatctatttatctttctatttatctgcaaactattgtaagtacctgtaaattgttagaagtggaattactaggtcaaaggggatattttcacatttaaattttgaatagaggctgtcagttgccttccacactgactataaaaggaaaagattgtatcacatttattgcaagccttctgtattctgctgggtgctgaggggaatacagaaaggatataagagtggttgccctctaggaatatccgtctacactgtacctaatcctagggaatgtctggggtgtcaacttgtgggtgggaaagtgggtggatttaattcaactgttcaagcttgccttgcaaacactgtgcatggtgtctgggactagtctttcattatattgattcccctgggtaacagatgtaatttccttagggcagggacttcatcctacatgacttacagcgtgccttacacatcttctttgctttgtggagaccttgttattataacacgtcaggtgatattcgaggatctaattgaggcattccctatttttgggtgtgtgaagaattaataactttggcattctatacaggtcatggaatatcagcctggaggggacttgctgtcacttttgaatagatatgaggaccagttagatgaaaacctgatacagttttacctagctgagctgattttggctgttcacagcgttcatctgatgggatacgtgcatcggtaagtgagactctggtagcatttttatgctgaggattttcctgtgtcgcataagagttcctgcatggaaatgagtggatgagtgatttcaagatcaagataacgccccatccagtttttagccagtctaccaataactggctgaaagcaaactttccaagatggaggacatttcagcttgcttatccagcagtgcaatagatctagaattgtaatgtgctcaagtttgctagtaatatctattaatgtagctaaataagactgggaactcttgcatgagttctttgggttatatgatagaagaactgaatttggtttgcagaaggaaatgtcataccacatagtagtgtaagaccatggagctgtacttctctaactctgcccgttagaatttacaattttttttttttttttttttttttgagacag

SEQ ID NO: 71826 - DNA, 1048 bp, Homo sapiens
tatggatacaatccaaggaagatgaaccttgggctagtgggataaaactaagcgcatgtagttagaatggaatgatctggaaaccaggtcccaagttggtctaaattagactcatgttgactatgtcacactgtaaaccagtctaaatgctaataagcatgcttgaccaaacactgccctgcagccttcagagaggaagaaggaaaacataatttgtatcctctctccctattttctgagtctatgggattcaaattgtagctgccatggaaactgtactttggaatttctagagcccttaattttaacttaacatataaaaacacttttgtactgattttataattattcatgatggatgagaaagtgaatgtctttgacagtgagggaagctatccgaatgctattttcttttttttttttctttcataaagatgcatatatttgcatgctttatttacctggggctaactcttgcatcttttgcagattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtaggaggattttaacatcatgcttttccactttctgtaccggagtgttcattgcaaagacgataatctgctgcactggcgtctaggatcaagcacgttttcctctgtgactctatatttaattatagttggggcaaaaaggtctctcatgttcttagctcatcttcttgaactgatgttggctaattttgaaggctcacaaattcctcttgatgtatcatgtttctatcgttgtaatttatttcagaaccaaggtggccttttagctaatgaatttaagatgatcttttatgaccattagctgaggactcaggatatacatatggtggggtgaatcagattgcttttgtacacgctttaggtatttgtgttgtgggcatatg

SEQ ID NO: 71827 - DNA, 1229 bp, Homo sapiens
tacctcaatattcagtgcccactgggcccttagatactgcagctaaaagtgcacaggggtggagtgatgtgacggttttggggtcacagaagcagctggtatagagagaagttgtgaagttttttttttttttcctgagacagagtctcgctgtatcccctaggctggagtgcagtggcttgatctcggctcactgcaacctctgtctccctggttcaagtgattcttatgcctcagcctcccgagtagctgggattataggcatgtgtcaccatacccagctaatttttgtgtttttagtagagatggggtttcaccatgttggccaggctggtcttgagctcctgacctcaggtgatccgcccacctgggcctcccaaagtgctgggattacaggcctgagccattgcgcctggtcttttttttttttttttaagtaatcataggcttgaatgtagcctctcatctgttcaccttaataatccaaaagcctttagataaagaaatggagatttggaatggcttctcagaattccaagagagtattgtcatggttttgcctgcaaagcaccgtggtctgtctccttgtgcagttgagaaagctggtggtcgccactgacaggcccagagttattaagttggacactgctttaagcaactttgtaaacaatccaaggcatactagagaattaggagagattggctttgtgtatgagcaataacaaaatcaagttcaatccagcaagtttttggggaattataattcaaaactcaaatacttgatctggaagaaacttggaaagagggaaggaagacaggcttgttacagcattgtcagggtaaaaggaaaataccgtgcagcttttaattttgcttcttcatggcattccccatgtaggtgccctagatttgttttttacagtggtcacgacttcatgtggatccacccaccactcttgcctggttccccaagggaccaagggaaggtgtattcaggatgattgctgaagtgaggggtggggtctgtggctgagaagactctcaataccgcggcactcattataagcctctgacacaggagatttcaactccacccgtgcaacaaaggaacagggtgggcaagagtagttacagttgcaggctgagtgcgatggttcatgcctgtaatcccagtgctttgggaagccaaggtgggaggattgcttgagtctaggagtttgagaccagcc

SEQ ID NO: 71828 - DNA, 1051 bp, Homo sapiens
tgattttgcccttccctttttcccgttggtcgcgagtcaaaggaagatgcaatttgattggctctccccttcactttcctccatgcctttagggacatgggcggggcctggctgagacgcccatgtctatcataggagcggagacgctgattggtccaaacacggctgagacccgcccgcgccgttcctcgggttcaaacgcggcggcgggaggcgcggggcggaacagatcgcagacctgggggttcgcagagcgtgagtctgatcccccagacccaattctaccgcacccggctctgcaaggccaggggagggccgcctccacccatacaagtcccgggtttccctcccgccccggggagggcggcgattccacccccagggctgcgggaggcctggagggtcttccggggctagctgtgcgcgcgcccaccttccttgggagccgaggggtcagccgagtggtgctggggcaggaggcttgctcctcccctaaaccaggcggagtgctttgtctcttcagctctgcctcctgtcagcactaactgcattattctgcccagtgtagtcggccggttccttattatctgcgtgaacttagccatttacttaacctctctgtttcagcgtattcataccccgtgcccaccccatcacctcatgatgcccccgcctctttcgctctgctccagtccgtctggcctcgctgttgctggagaggccaggtcctgcctcagtgcttttggcttggctgtttcgtttgccacggatgtctttctttccccagatatcaacatggcttgctggtcattcgcttcaggtcttcaagtcttgggtcaaatggtggcttctcagtgaagtcttatttgaccacactaaaaattgcaccatctcacccccattgtccttttcttgctcgattttgtttttaccccatagcacttaacaccttacaacaagctatatattttgcttatttcagtcattcatttaataactattcgcacctatttgtgtgccaggctatgtgtgcccccactgcatgggggca

SEQ ID NO: 71829 - DNA, 1071 bp, Homo sapiens
cccaggagaactaagcagtcaggagagggagccctagagagcagtaggaggagggaggacttcggaaaccaggcatcttcatgctgatgactcagggatatgaaggaccagatgcttcgcagatcagcagcccggagagaaagggtttctgcggagaaataacggaaaaaactgctcacagatgggaatacgaagcaaagaacctccctaataataactaccgtttattcggcactcagtgtgtgccatgtcctgtattaagtgcttgatagtcattattttagataatcctcacaagaactttataaaatcagtactgccgcttgtcattttaacagagaaggaaattaaagcctgagagatggcatcgtctgcccaggtcattacaactggtagagtcaggattgagatctagccaggccgacgccagggatcacgtgaatcattattctttattttcttcacatagaagcagtcttgaggaagataaatggtcctttgtgaccaagatggattgggtggatatggaaggaacatttcctcaatgattaaaggaaggtttggagagcctactgggtgacttgcagtcattccttggtgttgacctcgttggtggtgctacgtgtctcctatttccagaaacaatcccatctaaagctagaattcgtccctatgcttccttttcctcttggacagacaacccattttttacttggatcatgcctttcttcttttcatcccagtgagatggaaatttcagaacatcaagaggctgaaatgggtcaaatagtttctcatggtttttatcgcttattaaattcagagcctaaacaatattcaagttttaacatcgttacccttagactgaaggccagaatctgaaaagctcctgggcctcagggctggcattgttcacttgttgactggaaaggagacagacagttgagggattcccacatcaatcttagagctaaatttctgcagttgaccatgttaccattccagcaaggaaatgttctaacactttttattatgacctcccaccttgagctggaattgtgggccagaggt

SEQ ID NO: 71830 - DNA, 1010 bp, Homo sapiens
tgtgagtgccctgtagttcggttgtcctgctaactaggtctgccagtcgatgaactcctgagatacctctctgaaaagtcgtttgtgaaacctataggtagactgccaaaaagcagcctaatgaattgaattgtttaattttcacttgaagtagaggtctagaaataaaaagccttccttttttttttataaagagattcagttgtacgactttgtaaagaagtacaactacagagatttatacttgtgatttgaaatttcttcagtgaaggacttgattgaagagacagctgacttgaaaggagcaccgtatcagtttgattagtgccagatttcatagtaatcctgagtgtgcaattacatacattctgggttccatgtggagcctttatacatttcttcaacatagggcaaagatttcagaatggtaacaaaaaaaggttgtattgtaaaagaataaattatctttgacattttgttatttacttaatggacaacaatagtttaaaactctttaaactattttttaaaaccttcattcctctgcaggtcagcatatgaactctagttttaaaagttcaattttaagttctggagatagtcgcacaacaatgtgaatataactaacatatacttaacatatacttacaggccaaatattgatcattgttgaaactcagtgatgaggggagtcagttatattatttcttataggtaggtttgaaaattataaaaaattttaaagttttaaaaatgttcattaaagatactaagagagtaccattagttgcttgttaatctttctagtgttaatgtgagagtgacaaacctggtttacagagtactgttttatttgacacctccggtttagttttccccacagtacattgtttgaacaatgtaggttttagaatgtctgtttagacaatactttctaacgttcagtacaaactgctgtactttgtacttttttcttttttagacaagatctcactctatcccccaggctg

SEQ ID NO: 71831 - DNA, 1120 bp, Homo sapiens
gctctgttgcccaggctggagtgcagtggcgtgataccagctcactgcaacctctctgcctcctggattcaagcgattctcctgcctcagccttccgagtagctgggattacacaacccaccatcatgcctggctaatttttgtattttttagagatggggtttcaccatggtggccaggctggtcttgaactcctgacctcaggtgatcctcccgcctcagcctcccaaagtgctgggattataggcgtgagccactgcacccagcccagatgcttaaagttctgaaggcatttttaaaaatttcttttcatctacaattagccgttttgctttaaaacttatatccggtcatgtccttagctttttccccagaatatgaagtaagacagtaacttgtatttatacaccttttttcttcaggaattaaatatttgttgttaatgtacagtatctcccttttttccatcatggctgagtggattatctctttactgcagagattgttctcttccctcagttatattttcctccttccccaggccaggccaattctcattagtccagtactgtttttttaagaggaagaacaaaagatgaaaatgaatacataatgggagtcactagtggatttagggaagaaaacccaggggttctgatttgcatttagttcttggaccttttaaagaacagtactttttcagaaccatgtactggacttctgagcatattgtcagttttttggttctttttttttttttggcagaaatccatttctgtaaagacctgttttatgtaaactaatgatcttaattttgggtggtggggtttttttagttttaaatagactctttttttttcgagacggagtctcactttgttacccaggctggagtgcagtggcgccatcttggctcactgcaacctccgcctcccgggttcaaacaattctcctgcctcagcctcctgagtagctgggactactggtatacaccaccatgcccggctaatttttgtatttttagtagagacggggtttcaccatcttggtcaggctggtcttaaactcctgacctcgtgatctgcccacctgggcctcccaaagtgctgggattacaggc

SEQ ID NO: 71832 - DNA, 1005 bp, Homo sapiens
agggaaataccagaatgtttgtgagagctgaggattcaggcaataggtagagctaaagatcttcttgcctgcaggtttcccatctggagaatccagtcaccatttgattgtctgggaagtaggaattggacagttcaggaagtcacttcacagagccagctcagtaacaggatttctgattcagttctaaaagcttttttcagcaactgggaatggaatctctatccttgtaaaaatttttatgtttttgactattttcattcattattcatgaaagattcaaccagagaggcctggctagattgatttatttgttcaaaaacatttaatacatactttgagtaagtgtttcttacggagacttatagaatgaatgcaacaaaccagaaaaattaaaggggaaattaagatttcttgggggctaagttcatgttacaaaataacatgagctaaagcagactctgccccgtgaaagataggtgaccaagagagacgaagggaaaaagcagatttcaacatgacatagcaaaagctcatggagcttggaatctgactctgttactcattaactgggggaccttgtttgtgcctcagtttccttttctttaaaatgggtgtaaaaattatgcctcatacaagtattattgaaatgaaaaatgagataatgtgtttatgttaaacagcgtgtgaaggtaaggatttgtttcagtgttgatggttgttttactaaagcagtgtctttataatttgttcactttgcctaatttcttatagaaaatcctgataagctgctcctaaaagaacgtaggaagataacatttctactagatctagatttttgttatcctttctggccttgaatataggcccttggtgagttttatagctttttcccttttttcaagcaggaccagcccctggggtttccatcagcagcaagtttagatagcgttttattaactgagtatccaggaactagaggagttaaatattttgaagtgaatt

SEQ ID NO: 71833 - DNA, 1055 bp, Homo sapiens
tttctgactttgaataaatcctcactctgggtttcaatttctgtcagtaaaacacggagattgaacgagatgattccttcgctctctaaatgtccacatgtacgtatgcgatctctgttggaaagaaaattagtagagagatagtctcacatgatgtggtatatcatgtctggtaactttgtaatgctgccgcctttgcatgcagaacatattcatccttctctgggaccgagggcggcttctcctctcacccaaatttactcctttgtgtaatgagaaatagagagaggttgagatgattggtgccacaacaaaatttattttccattccagtcatgacacataaggtactttccctgcacacgactgacggtgtggggaatgaggaggtgtttatgtgattttcctgtttaaaattatgcatcatagtactaaggttttatgaggttgacattctgtaattctccacgaataagtcagattttccgcattgccctggtatgattagttgcattcaatgctgcatgtttgtcatttgcagaactgtaagaattccccctatacacacctctcgtcatcagttgctaggttacggcttttcacattgtcccagtctggtgatgttgccatggataccagttatacctcctcctatgacactgtcctggtcaggctcagagggcgggcaagatgtaactatgatgtcagagatgttttagcatatgtctttccctttacattaatgataagatctaagtaatagatatcaattctatgtgttctcatatatgaattaaggacatgaggtattagctgaatccctcaaacagtccaccacttagaacctttattccattatgtattttttttcttttttaaaggaaagggaagggaaaggaaggggaaagcctttattccattataattctgcagaaatggaactaacagattataaaatatgaatataagatctgctatactgtgtccagctcattccctacacagaccagcaccccacctcccatagggtgggctatacatggaatatcattatc

SEQ ID NO: 71834 - DNA, 1534 bp, Homo sapiens
ctcagaattaaaaatgtcttatggtcaaataaattgatctcttaaagatttgcagtatatgttagtacactaaaagcttttgtaagtcttagcagtaaagaaatctgtttaatccagtgtttcccaaatttttttgaccccagaattattattattattatttttgagacagagtcttgctttgttgcccaggctggagtgcagtgtcgcgatctcactgcagcctccacccgccggttcaagtaattatcctgcctcagcctcccaggtagctgggagtacaggcacccgtcagctgtaatctttgtatttttagtacaatggggtttcgccacattggccaggcaggcctcaaactcctgacctcaggtgatctgctcgccttggcctcccaaagtgctgagattataggagtgagccaccatgcccggcccagaattttgttttttgttgctaatacccatcaaccttcttttaaaatagtcttttttcttccagttttattgaaggataactggcaaaaattgtatatattcagcgtacaacatgatgagttgatagatgtatacattgcaaaatgattaccacaacctaattaacacatctgtcaccacacttggtaaccctttgtgtgagtgagtgatgaggacacttaaaattgtctctaagcaaatttcaagtaaacaatactgtattagtaactatatttagtaaacaactgttggggcagaacatactctggaaataatagctatataacaagtggattgatctggaaatgaggcgagatgtagattattaatgtagccccatgatttagaggaaaggtcaacccttcattaaacccaagaaagagcctaataatgactatctgcgctattttcctgaagagatgggtgtattttggaaagtgagacaggcttgcgtcacttggagctagtaggttgatgaagatacctcacacttgtattgtgctttaagatttacaaaaaaatgtgcatttccgtgatcaaaaccccaggaggtagaaaggcttatattgtctcctgttttacaaaagaggaacctcaaactaaatgacttgcccaaggtcacataacattattgataggtagcaagactgatgttgtctggaaccctgggcttcaggttgcaagtgcaggatgacccacatcactaaaatagttgcctagaattatatgctaatgagtgtttcttttatagaaatatatacatctcatattcactttatttttcttccttacaatacttcaagttgcttttctacccctgggctattttttgtctttgctactttcaacagtaactgagtgaagagcacagcctgggtatgacaaataaccagtttgcctcaaggcatgggttttggcctcagaggatcagaaaccttggacttgaccaaatttcaaatttctcttatagaacatgtttctagatatgagtttagaacctactgtgtttaacctgttttggttttcataaattcaaccaacaattattaagaactgaccac

SEQ ID NO: 71835 - DNA, 1036 bp, Homo sapiens
tcccagcactttgggaggccaaggtgggtgggtcacttgaagtcaggagttcaaggccagcctggccaacatggcaaaaccccatctctactaaaaatacaaaaattagccgggtgtggtggtgcacgcctgtaattccagctactcgggaggctgaggcaggagaattgctggaacccgggaggtggaggtggcagtgagccgagatcatgccaccacattccagcctaggtaacagagtgagactccatctcaataaataaataaatagagaaaaagtattgactgcttattgtgtaccaagcattatgtaagataccactttctctcatttgatcccatgttaaccctatgtgatacgtagccttatcttatttctttgaaatgaaaaaatgaagctcagagatgctaaatttatcacctaaggtcaccacatatagtgaacaagtggctgaactgggattcacatcaaaggcagctgactctaaaaccctgctcttaaacccctgctaaactacttactgtaaatggagctctgagaaatgcccttgcgtcaaaatcttttttaaagaattttttttcaaaaaaccatgctctatacagagtataaaacataaacatacatattaatgaaatgttataataaaaggaaaacctttgtaaccaccacacaggttaagaaatagtgttgccagcacaactcttatttccctccataagcacgacctcttcttcccccaagaggaaccactaacctgacttttataataatcattcctttcctttgctttataatgagttttacctgctaagtatatgttcataaataataccattttgttttgcctttctggaattttatataaatggaatcacacattgtgaattattttctgtcttctttcacttaacatttagtttttacaatttatgtttatgcatgtagcttagtaaattattttgctttggtatattatatttcattgtatgaatattcacagatctgtttcactggtgatggtttataggttttagc

SEQ ID NO: 71836 - DNA, 1032 bp, Homo sapiens
gatagcctgttgccctgctcggtaaatgacctgaggatgtttttcctaaagtctgtcaatatcttctcttttctcctgcctcctattcccttccttccccctttcccttggaatgcctactggtattgagcagcaggtccttgaagtaagtagagtttgttccagtggggtttggcatgcctgtgtgtgaccatttgtgtgcatgacttgccattcacctgcctctgccagcctctgactccttcacgtttcctgtcttcctctttcctcacccgttcattttttctagaccctcatgaaccgggtcgtccccaggaatgtttattgccagattttttcacaagtttcagggtgtatagcgctgggtgagggagttggtggcctaacactgattccctgctttgtccatgaacactgctacctttaaaaggcaagctatgaaattgtttgtttcaagtaagttactttgtgtagctccgaactaagtttttttagggtcagttgtgtatcagaatcttattaccccatcacttcactgactgaaagttgggaaacaaagatgattcatgggaaggaaaatttaaaggtcagagggtatttaaatgaaaatcaactagagtaagaattgtcttcacatgggtaactttgcttcagtgtaggaaatagtggacccattcacaaaaggggcttgctccttttggtcccctacccagatgcacacttgagagacaatatttctttgtttggccagatatctgatctctctggacaaaggccacatactttgtttccccaggacaacatcctatctgattgaattggtggccagagaagatctgtgccctgtgagcagaattctagttcagagaatgagaacagataaaaagtaaagggaaaagtgtatctcgtaggactgaaacaagctagacattcatttcaggatttcccctggaaaagttctaaggttggtccccaaaacttgcacaagtaaaagccttaaggaattgttatcaaagctggactagagagctt

SEQ ID NO: 71837 - DNA, 1799 bp, Homo sapiens
ggagcaaatatttttttgaatgttcaaagacagtgataacatgatgtcaaatacaaaaactgcctgatttcccaaaataaagcaagaacttcaaagatgtttcaagcctgcagcagactctgaacagcaggaggtgactcctcagacctgctctgctgcccaggggctggccctcccgccctgttggtgccccgggcgggcagggggagtcagtgctgccgcagtagcctctcctgctggcctgttgtggctcgggggcatctgccgaggctgagtgagagcccaggctccagggccaccctcaccttttccgggtcagtgtcctgacgtgggcaggtgggtcccggcaagggggtgactcctgtcggggttgacatgctgccgcacactctggccctgcaggtattatcgggggacccacggggtcattgtggtttacgacgtcaccagtgccgagtcctttgtcaacgtcaagcggtggcttcacgaaatcaaccagaactgtgatgatgtgtgccgaatattaggtgaggctgcactcagggccgggtcggggttgggtgggagagaggcagccggctgcgcccctcagggctgcgctgactctgccttcgtttgaagtgggtaataagaatgacgaccctgagcggaaggtggtggagacggaagatgcctacaaattcgccgggcagatgggcatccagttgttcgagaccagcgccaaggagaatgtcaacgtggaagaggtgaggccctgggccactgtggctctgccacacacccgtggccgccttctccatgctgctggcctgcttgaggcatctaaatgaccaacagaaaatgtcatagtaactgccatttattgagtgcctactatgtgccaggccctttaacgatcttagttcatagttcaacagtcctctgaggtaggtacaattatacccacatttcaaatagggaaactgaggctccaagtgttgaagtaactcaaggaccaccacctggctagtaagagactgagtaaacctctgtcccacaccaaagccaagcacagtttccactccagtcctctgcctcattggccgccttgtgctgtgtggagcccagaggcctgtggaagtcgaggatcccactgcttcagggcacaggggccacacagcagcgggcacaggctcctttgtaagtcaggctggtgtcctgatgctggcccatccacctgggcctgtgggcaaggctggtatgaccttgggcggtgacttcacctctctgggccccacatgccatgaagtggcgtggagcaggcagaccccgggtcacctatgtccgtgaacagcaggggcactttcatctgtcatgtcataagattccagctgggccgggcgcgccggctcacgcctgtaatctcagtgctttgggaggccgaggcgggcggatcacgaggtcaggagatcgagaccatcctggctaacatggtggaaccctgtctctactaaaaatacaaaaaaattagccgggcgtggtggtgggcgcctgtagtcccagctactcgggaggctgaggcaggagaatggtgtgaaccagggaggcagagtttgcagtgagctgagatcacgccactgcactccagcctgggcgacagagcgagactccatctcacaaaaaaaaaaaaaaaaaaaagattccagctgaaggaaaggggttggtctctctaaaagaaggactggaaaacccctgtgagattgacttccccaagtccacacagctcatgggcctctgatggtgttccttttttcagactt

SEQ ID NO: 71838 - DNA, 1041 bp, Homo sapiens
accagcccacccggcggggacatcagccagaaagatggtagccattgagttctagctatgtgggccttggtttcctcacctgcaaaatagccctgatgatctcaagggtcctttcccgctctacagctcttcattttgggcggctccctaactgatgtgctacaacgtgctgtgcacttttctagggaccatgttgtagacgcacttgggggccgtttcgtgtggttgaccttcattctgctttgtcgtctggcatctccctttgggccagccctcagcctagggcctgggcaccagtccctttctcatctctcccccaggggatttgggagcagcttgtcttacacaaggacgaaggaaaaggtcagggatcgagtggaagagatgttcttggtgtgtggccgctcagggaggtggaaagagcattgagaagtgagctgggtcccaccgagcttcttaagagttgggactgaggcatcctctcccggaagaagggctggggctgcggggaggggacccacctgcccccctcatcgcagtgctttctctcttgcaggtgtgggcaagagcagtttactgttgcgttttgcagacaacactttctcaggtgagtcctcccctgcagtgctgctggggtgtcgtttttgtttgtttgttgacatcccctccctggcaccaaacagagttgcctctgcctgatgttgggaactgtctcattctggttgccagaggagggaagaagatggagtggggcttaggaccttgtggcgcttctgtcagaagcctctgtggtctgtctaatgcacctgctcacgaaaaccctttggctggcccatcattttcccacccatggtccaaacaggaaggttcccataacagcgtctatggtgccacccgggacacagtccctgctcctgccccctatgcctccctggcagcctgtggtcagcgtgtgtctttctgatttctttctgcgctccacatgcaggcctttgtggttcatctgagtgcggtgggctttctgtgcttgaaggcaccaca

SEQ ID NO: 71839 - DNA, 1118 bp, Homo sapiens
agatggaatgatagttggatctgccttatggggttgatgtgagtattaagtgagattctgcagtgttgctcacagctcctggcacatagtgagttgtcactgtttgctgttacactactatatacagaggggtcctggggatgggacagccaaaattataaaagtgctttggccacacacacacactgcttgagggctcctagctctgatcactgctctagctccagtgcctagaacagtgcctggcacccagtacatgcttaagacatatttgcagaaggaattaatgaatattaagtgtccttcgaaaaggtagactggtttctgggaaaaggtggagggttttagagctgtttggagtgtggcaggtgagcaggtttatggagtgaccaagaggtcaggaaggcaggccccagaaggtttatgggagcgaaactgaggtgctggggttatatgatgttcatgaaagagtcttgggagcatgctcagtttgtagaccagacctgagctgagtgtggggagggatgtcttatgattggaggcagaggccaggctggtggtagagcccatggactgttaaggaaaggggatcaaatcaagtgagcggtatgacttgggatgtaggagtgttgggtagcgatgtcagagctaggtcagggaagtgggtggttttggcctcccttttaaagctggatggagatgtggttggtggtttggatcaggtgaaggatggctgaggtttccgtggttgctggaggaggggagaggtaagggggaaagctgggggctaaccagggagatggaagagtaactgaggttggggaaggaggtagaaaggtggagtactgactggttatggtttgaatgaagggaaaccaggcaagctctggagtgttctcttggagatggcctttggtattcttcagggtcttgaggcttcttcctttacatgatttccttgcagccctggcctgggttctgagggactggcactggggccatttctctctttttggagtgacagcccgccgtggtcaggagcctttatccctctgcaagacatctggacctctgcgttgatatccaacagtgaaaagcctaaactcagcaggaagatg

SEQ ID NO: 71840 - DNA, 2736 bp, Homo sapiens
agtagtagagtccaaaccagaagccctggactcctggttctgtcccagttccatcagcctcacctagtctggaagcatctgtcaaatatttggctgcgagcactgtggggccagtagggagttgagtctatggagaagagttttctgttcccttttcagacagccctctgttgtggtctaatttactttgtagggccaatctaggaggagagggcctttgggctcacatggttttacacgtcattgacacacacacacacccacacacactcctcctgcccacacctgcaacacacacacttgctgctgcacttcccatggctccaaaggcctagttctggtccccaggcgccagctgtcggactccagccccagccttctctgtggggacagacaggaaagtctgctgtcttggtcacagtctttcagggcttctacagagtcatgtgtacagtgcaagcaaaagttagtattgaaacatatttgcattttaccacagtgcagcttaaaatagatgaagttggagagagtcggtgtcagagccagctttagcttggcacctgggcttctgcttcgagctcagaggcccaaactgctggcagtccattctcttaccctctgaacctccactcagattgaaggtggcagttcagggtgccagcctggcattagctttttgggttattgagtccctggttggtggtttgttttggggacatgttgagttggcacctgtaataaggaacataacttaaaatcctctcttggtattccatagttagctggccagggaggagcacggagccgctcgcgtacctggctctgatttgaacaggaagtgcttgcctttccttatcttccttggcttgattagtggctttagtttgacttcctaggatgaacccaagtaatttcggtggcagtggggcactcatgcagtagggagatagcaggagtcattctggccacaagatgacacaaactctgtgggagaaaggagctcagagtggccgtctctagccggcttccctggtggctgggggcaggtgcctcccctcctgcccctcccgcccctccctgcctcacagggctgttgatagtaattgagataataaatatgaaacattcagccttcctaagaagaaagatgctatgtaaatacagttattactgctattacaaggatgattaccatatgcatacacactggggttttctataattaagtgaagtgctggctgtgtaatgtttaactccataccagtggcagcccaatctggcaggggagcacgagtgcctacaggaaggactggatcttgagtctctgagttggcttttccaccttctttgttgctgtccatcctgggctctagagctgcctgccttggttcccacacagctggtgttgttccctgcaccccctcactcccttctcttccctgtcaggacaacactcgcatctcctcagccgggtgcctaggggaactgtgtgcctttttgactgaagaggagcttagtgccgttctacagcagtgcttgctgggtaagtacactggagagttccccttcagggacctgggcctctcagccctagcgaagagtcgacgggcatctccctccctccctcagaggatcttttagcaactggactgtcctttccttgggaatccagcagttaaagcaaaatccaggccaggggtggtggcactcacctgtagtcccagctactcaggaggctgaggtgggaggatcagttgagcccaagagttgaaggttgcagtgagccttgatcacgcccctgcactctagcctgggcgacagagcgaggccctgtctctaaaacaaacaaacaatactgaatttgcagtggtcccgtagccctgagtgtctctgctcaaagaacacagctgtaagcccggagtggttcatgagcaggctttccttactttccttaatgtgccactttggggagcttctgccaagatagcagggaggtccatgtgaatgtggcctggagttttccttgtgctctgggtcagcacactggtctccagcggggtgggcccatgggcctcatgggtgctggggacatgctgtaaaataccggttgatcccagtcgtgtccttccacccagcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacagggtaaggcattcgggccatatcccataggcataggccacatcccataggcagcaccttgtggacacagcgcgggtggaccccagactggggcttaagaagcttgggtctaattttacctttgtcagtaacttgctgtgcccttggaccagcacttgatccctttgggccccagtttcatcatctaaacaaggaatttgggttgaagaatctagatgccccttctgggtcaggtcttggatccctgttcctgggaaccagtgactgtactcatctgcctcagccggggcagcctgcctgagagctgtcatggtgtaaggggtgatgtggtggtgatgtagtggagggtcctggagattactaggaactggggttttcctggctctggggaaggggtggggggcctcccgtctagcgctgtctgttctccacagatccccattgcggtgagcggg

SEQ ID NO: 71841 - DNA, 2550 bp, Homo sapiens
aaaatttttagtttaagacaatctcactctgctgcccaggcaggagtacaggggcaccatctcttttggctacagcctctgcttcctgggttcaagcgattcttgtgcctcagcctcctgtgtagctgggattacaggtgtgcaccaccacacccagctaatttttgtatttttagtagagatagggttttgccatgttgaccaggctggtctcgaactcctggcctcaagtcatccgcccaccttggcctcccaaagtgctgggattacaggtgtgagccaccgtgcccggccccttctctccttttttttatttcacagtaaagagttaagttaaaagacaagtcaggcaaagagagttagggtggcctagctgggtcagagtcccctgcctgtgcttcttgtctgcttctgctccttctttgcctttcctgcatctggtacagttgtagcttgccattgcaggtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggtgagtggatctaccacacacctacctaccagtttggcttttgccgtctttgtagatggaaaatacagggcgattattctgccaaggcagtcgcaatgtgggccctccagagggagtgggtatagcaagatcagacttggctttgtgcttcgccttcggcagtgaggaaatgtgggtgcaacaggagggagggaaacaagtggagaaggaagttggcggtggctggttgagacagcagagatgcagattcctcagggttgtccccaacaccctctgcaggatgacgaggaggtgtcagagtttgccttggatggtctgaagcaagtcatggctattaagagtcgtgtggtgctgccctaccttgtgcccaaggtaaatcccaacatgtggtcaacaccctctggctccagggcattgacatttccagggcctgcagtgaagaccagttctgaacgtagatgttggagggctgggggaggagggtgcagtgcaagcattacatccttcccctgttgtcttccaagatatgctggagtagatgcttggctctgagcagtgggcttgggctctcttgcccacccgtctgttcccagagcctagcgcagcacctggcacagtattcactgagttaatgtttgtcattccaccagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggtaaggggcgagcctgctcctgctttctcatgtcccgtctgcccggaggatccctgctcagcacacatgtcccttgtggtttgcaggagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaaggtgaggggactgctgaccccacagccaacttttgcttttagaaaattccagacatttacaggaatagacttataagaatcccccacgtacctgtcactcagcttcggcgtttacccactcgtggcaagtcttgtttatactcccgcccacgctttccccatatattctttggaagcagtcttgagagggctgtacatcctctcgctttttcctggattcctgcagaagctggatgctggcaaccagttggcactcattgaagagctgcacaaggaaatccggctcatagggaacgagagcaaaggcgagcatgtgccaggattctgcctcccgaagaaggtaagccagggcctcgtgcagggggctgtgggcgtgcagtctgttgtgcccttctggcccttacccctgtcccaggtctgcggtaggggctgctggagcagtagccgtggtggttggtgttcagcaccttcgcagacagcatgttttcttccatggcagtcagatggggacagggttcatgctgcctttggtttaagctctgcaggtcaccttggccagagtgagtgggccacagggtaacagcagtgcatgttctctctgtgtgataggcctgttggggcccttgtcgtcttttctctgccaagaccgttccatagccagccctctcaggctgtgatcctgagattcagcccaaatcaatatctcccatggagttgaggggaggacagctgtcaggaccactttgcttgcatgggagacaccagggcccaggg

SEQ ID NO: 71842 - DNA, 1009 bp, Homo sapiens
cgtacctgcccagcgtgacgcctggcctgaaagcatcgcttttggaccctgtgcctgaggtgagtctgaggtaggctgggggatgggccaggcccctcatccagtccccataaatggattcctgagaattccccaaagctgcttttgtgtctgttgggtaaagagaaagaggccctcggtgccccttcctgctcccatgtggctaccttgttttgagcctcatcttctcacaccatctctgctctcggttacctgacaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacagggtaaggccagagcaggtccagtggccagcctgggaatgctctaaggggccctcagatccagtggactcattctgtcctttgttgcagggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagtaggtaccatgaccttggcaagggtagagtccttgaggagggcaggaggcaagtgctcacctggagagctagagatccctgctggctggggttggttggcagagccctcagccttcagtgagccccatgttttttgggctgggggcctgggggtggcagctctggctgacccaccctctgtgtgcccaggctcttgctgatgagaatgagtttgtgcgtgacaccgccctgcgcgcgggccagcgggttatctccatgtacgctgagacagccatcgccctgctgctgccccagctagagcaaggcctctttgatgacctttggag

SEQ ID NO: 71843 - DNA, 1041 bp, Homo sapiens
ctgacaagagccacaaccctaagtcaggatatcctaaagctctaaagctcctctttggctttaaagttttccccccccaggaaagctctttttgaaaataaccttaggcaggagaatctcttgagggcaggaatttagaccagcctgggcaatatagcaagaccctacctctaccaaaaaaaaaaaaaataggccaagtgtggtggtgcatgcctgtagtcccagctactcaggaggctgaagtggaaggatcacttgagccctggagtttggggctgcagcgagctataatcttgccaccacactccaacctgggcagcagcgtgagaccctgtctcaaaaataaataaataaaatgtctggcaccctaataagcaaacagataaaagtagagctgctctagttgggggaggatcaccatctaaggccctcccactcaacctccttctcagtccttcaggcttcaccctgtagtttgaaacaacacaaatctaaatcagtttcctcatttgtggatgaagaaacagttcagagaaattcagtgaattggccttggatctcactgtaaggattaaaccaggtcttacctatcctggtctctttctcccatactgccctgcctctcacctgggatcccactgttcagcaggccacaagagctttttcgacccctctgctagagccagccccctctcccctcctcccagtgactgcttgagcaccgtctgcaggggccagggtagatgtcccttgctcatgtagccagcacaggtgagttgctggcctttgctcagtgattcagtactgggcttgtgtctgctatccacagggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctgggtaggcctttcccgtgagggtgcttgccctga

SEQ ID NO: 71844 - DNA, 1064 bp, Homo sapiens
tggcttttttaactgttagtgccaagaagtgaaggtggctcccctgtgctgtcctccctttcgctcagccacattcctttgctggggcttcttgagctgaggcagagggtgctgcctcctcatggggcatctactagttccacagctgtttctgagtgtttccagaggggtgggaggtggcagggaggttgctgtcccttctgttctctgtggctacccccaggggacattctcttcccagccgtcccaccttcttttcccctaggagccctctttgccttcgagatgctctgcaccatgctggggaaactttttgagccgtatgtggttcacgtgctgccccatctgctcctgtgctttggggatggaaaccagtatgtgcgtgaggtaagtccccggactgctcgggagaacagcatggaaactttatgagatgtgttcccagctgtgtctgcaggccttggcacagggtctgacataatagaaccccagtaagcgttggttataggaggaacgctaggactggtgtcaggccttgccccttgcttgggtgaggaggcccctgaatgtgttttctccccccttgaggctgcagatgactgtgccaaggctgtgatgagcaacttgagtgctcacggggtgaagctggtgctcccctccttactggctgccctggaggaggaatcgtggcggaccaaagctggtaagaccactcgctctgcctctcttcccagcttcctgttatgaaaaccagcctcagcaaggatcctgggtagccacagctcttgtcctgtgagctccccagaccagggatagggttaagactctgcctttttaaaaatttgagatggagtcttgctctatcacccaggctggtctttacctttggggctcaaaccattctcacaggagcatgccactacacctggctaatttttgtatttttttttgtaatgatggagtctcgctatgttgcccagactggccttgaattcctgggttcaagtgaccctcctgccttggcctcccaaagcactgggattgcaggtgtgagtcaccacgcc

SEQ ID NO: 71845 - DNA, 1045 bp, Homo sapiens
gagtcccttccttggtcccctgccccactgcccaggcctaggttttccatttagaccagaaatggcaccatatgggccaaagcttttgtcgtcagcagattgtagtgtgcaccctcagaggtatacaacactgtgtatacctgtttgcttctctggtgccctgtgacatccgcaggcagtggctgagatggggcttgggacatctagtggtgggtgctgtgtagaatggtcagaccccccaccaaccatgaaacggctgcagcggagccacagcattgacaggtgggcccttccccaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggtgagcatctctgagcttggggctgcccagcatgggaagttggtccccaggttgccagaggaaggaatctgaccgtggcgccccaggtggaggccgttgcttgtgcgtgtactacagagggccccgctgtgtgcgacccagtccagctgcgtccttgctgctttccttggacttgcaaatttttttttcttttctgttttttttttttgagacggagtctcgctctgtcgcccaggctagagtgcagtggcgtgatcttggctcactgcaagctcagcctcctgggttcatgccattctcctgccttagcctcccaagtagctgggaccacaggcgcccgccaccacgcccggctaattttttgtatttttagtagaggcggggtttcaccgtgttagccaggatggtctcgatctcctgacctcgtgatctgtccgcctcagcctcccaaagtgctgggattacaggcatgaaccaccgcgcccggccacaaatttcta

SEQ ID NO: 71846 - DNA, 1050 bp, Homo sapiens
acgggaggcaggcgctagggctgagcaggggccagaaatgctgagtgccaagagtcctggcagagcactttgagccaaaaagaccatgatagtgtgttaaattcttttaagtctgtggcagtcctgccagaaaactggaagagccactggctggcatgtcaggatgcctgtcccagagctagacttggtcttggtcctcagggcagggactgttgtccccagatgcagcctgtagggttgacctgaggctctgaggggtttggctttccaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtacctgccatctggcctgggacccacatgtcggttagagaattgggacccggctgtggttaggcggtgggatactaggggtggagttggacaatcagggccctgaaagcccagttcttgttaaggattcaccccctctcgcaggggagagcctggtttatagtcaggaacactcctggagagggagtttctttgttactttgttctagtagacctcccagatagtttcatttttttctactcacctggtttatagtgaagaatgcccctggagagggagtttctttgttactttgttctaatagacctcctagatagttccattttttctattcactaacgtgcactgggaatccaaagggaaaaaaaataaaaggtcaggctttctcttatgtcaagcctttttctggccctctacatgtgttggttgtgtgttacaggtgcgttttaatgtagcctctaagctacagtgcaaataaatttctttttctttgttttgaaaaacacgcatgtatgtatatataaatatatatatatttatatatatatattttgtgtgtgtgtgtgtgtgtgtgcgcgtgtgt

SEQ ID NO: 71847 - DNA, 1468 bp, Homo sapiens
agaagtcagaagttcagtggcagtgaggatggtttggtggctcagcccagcccagatctcctgaacagccacatgacagcagtgagcagaggcccttgagacctttagcttcctcttagctctggagaaacaaacaccaggtagggtggctggcagttctggtggccttgcttctgtgggttgtttagtggccttcagcagacttctatcctggcctaacggtgatgttcccacgggtgaggctagaatctgggaactgttctgagtggaaaagtcagctggtgcatatgaaacctgccagaagtgtcacctggctgtctgggcttgttgcgtagaggtggagatgctgcacagatagagctgtactcttggctgaatgactctttggtggcccttgtctcctgtcagcgtactcatttcttaaatgtccaaagggcaactctctgcctacctgccctctgaggctgtcacaaagatcaagtgagaaattaggctggggacattttggcgaagcagaaagatttttttttttttttttgagacggagtcttactctgtcacccaggctggagtgcagtggcgccatcttggctcactgccagctccgcttcccgggttcatgccattctccttcttgagcctcctgagtagctgggactacaggcgcccgtcaccacgcccagctaattttttgtatttttagtagagatggggtttcaccgtgttagccaggatggtctcaatctcctgacctcatgatccgcccgcctcggcctcccaaagtgctgggattacaggcatcagccaccgcgcccagccgcagaaatatttttttaagtcagaaggatgaggcactgggtcccctgttttagcctgggctggattccacatctctgtgtgtcatctcctgctgggtctctcctcttcaacacaggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtaagggctgggacgggatcaggggcaccaggcggtgtgagctggtgccaggaatgctgctcaaggcacagcgtcacccagggcctcctgagcctgggggattggaccatatggaggatttctgaattgaaccttcgtagtctgtgaattgcagtgagcccagttgagggtttactttttgtcactggtgtccccatctctgttttaactctcacatcctggaactgggcagtgtttggcagtagaagcagaattggttttagaactggactaccagctgctgtctctgtcctcgtgccatgtgcttccaggtgtcagaacgggcctctggtccatccgttccctactttccctgaggatagaaataggcagcagtgg

SEQ ID NO: 71848 - DNA, 1461 bp, Homo sapiens
gtgcacgtgtctcctctgctaagtggtgttgctggattccatgtctgtccctccacttccttgaagactgggacccatctagactcctgatagcaggcacagcgcctggtacagtgggacttctggggaatcatgacttgattgctgaattcagctttgggcagagcaggttctgacaggagcagagcacacaggactctttccttctcagcgtttgctcttctctctgtctttacaaggcaggattcttcttgtctttctcatctcagtccacatgtgtgcttctcagagaggtggccagcttgtccaccctatccaaagtagaccccacccttcctcccttttactaaacatcatatttgtttctttactaacatttatcataacccaaaagcatcttgtttatgtgcttgttgacttgtttattatctatcttcgcctgctagattgtgagctccgtgagggcagggactttatcttgttcctacgatattcctgccatctggaacagtgcctggcacaatccaggtgctcactaaatgtttgctgaatgagtgagtgagttctgtggcttgttgtctcaggccactatagcaggccttttctaagcttcagcttatcctgtgggagagcttatgtaggaaggggttggagaggaggaggctaaagttttgattctgaatccatttggctgtcagaatacccttttgagtacattgaggaacctttatttctctaacataaaaagccctcttagcctttgtcagtagagaatccagtaaaacaactacttctctattgctgtctccattctatagaaaccaggtggctgtggactttgtgggaggttgggggtgcacatggtgggttcaggggcccaactcacacttagagctggtatggtgctgtttgtgtggaagcaagctcaccttcctctgttggggagggaggtctgttccctggagatgggattggttggtttgcccatcctctttaggagataaagaagaagaaaggcatcaaagaggaggtgcagctgaccagcaagcagaaggagatgctgcaggcccagctagacagggaggcgcaggtccggaggcggctgcaggaggtgagtggccacctccgccacatgctcaagccggaagagtgctgggcagcttggtcctgctgcttgctgtcacaagcagggccctgctgacctgccttctggacaactctgcttgcagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggttagtccttgtttgctggctgcagggatggcc

SEQ ID NO: 71849 - DNA, 1057 bp, Homo sapiens
ccttttttccagggtttttggggtttttgttttgttttgttttgttttgctcactgcaacctctacttcccaagcttgagcgatccttccacctcagcctcccaagttgctgggactataggtgcacaccacctgcagtggccgctaattttttgatttttgattttttgtagagatggggtctcgccatgtcgcccaggctgatctcgaacttctaggctgaagtgatcctcctacctcggcttcccaaagtgttgggattacaggcacgagccaccgtgccctccccctttatccttgattaattgaataacactttatgtttttaaagcactttgtactttttaaagcattttctacccattttttccttttgattttttttttaacaatgcgtttcaaaggcaaatagggcttgttattcttgtgtcatatgaattgaccagggttctaggagttcaaatgacttgcacagggtctcccccgacggagggagaccctcaaagacctggctgttatttctgtgctctttgtgccgtgttccactgcttccctccctcccaaagcctgttgaggaatgtgggccagtgacagacttgccaccacaggctgggtctcctggaccagttcctggtgccttctttacccctgcaggctttttagatgcaaagccacaggtgcttccttcttccaggcacatctcacagcctgtgggtcccattgcaggaagctgggcatccatttctactccagcaaggaccccagggaagaactgagtgaggggccgctgtgtccgtagcatatttggttcctgtgttccaagcctgcacagggctcttagcagtattatctcatgtgtctccacacaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatcctt

SEQ ID NO: 71850 - DNA, 1549 bp, Homo sapiens
attctcctgcgttcaagcaattctcctgcctcagcctcccgagtagcttggttacaggcatgcgccaccacacccagctaattttgtatttttagtagagatgaggtttctccatgttggtcagactggtcttgaactcccgacctcaggtgatctgcctgcctcggcctcccaaagtgctgggattacaggtgtgagccactaggcctggcagcctctgagatttttttagtcaaggacctattatgtatgtcaatctgggttggacggtgtgagctccatgcagttcgaatccccatatcaagatgcacttctgtattcacagtgctcagcatagagcctgccatgcagtggtcagtaagtatttgtggaattaatgaaggacaggtcaaggcagataagaagtaaatgaaacaggacccttaattctttacctgcatggcacttaaacctcactgaaattgtatgttcatttgtgtatttatttgtttaatatctcttttttcctctgaattctaaggtacatgaaagcagggaccggctgggcgcagtggctcacgcctgtaatcccagcactttgggaggccgaggcgggcggatcatgaggtcaggagatcgagaccatcctggctaacatggtgaaaccccgtctctactaaaaatacaaaaaattaggtgggcatggtggtggacacctgtagtcctagctactcgggaggctgaggcaggagaatggtgtgaacccgtgaggcggagcttgcagtgagctgagatcgcaccactgcactccagcctgggcgacagagcgagactctgtctcaaaaaaaaaaaaaaaaaaaattagctgggcatggtggcacgcacctgtagtcccagctacttgggaggctgaggcgggagaatcacttgaacccgggaggtggaggttgcagtgagccgagattgtgccactgcactccagcctggcgacagagcgagactccgtcttaaaaaaaaaaagcagggaccatgtctgtcttcctccccttgtgccttcattgtctgattcataataggtgatcaccaaatatttattaaacgaacactagtgggaacagtgtcgttaaaggacagaactaaatgtgtggggtggagggaagaggagctggctggagttgagtgggagaggctgagtggagatgaagccaggatttggagggtctgatggaggtctttacaggctatgagagccatgggaccctcagtctcatgtcccaccttgacctgagtcttccctggtcctggcaggtggaagtgcagtgcctgctcttgctggaggtgctgggtggctcccacaagcacgccgtggatggtgctgtgaagaaactcacgaagctgtggaaagaggtgacaggactgcaggggctggtgggcattgcttcttccatgccactcccccactgccatcttaaacacctgcctggcactttcctcttcagaaccccgggctggtggaacagtacttgtcagccattctcagcctagagcccaaccagaactatgctggcat

SEQ ID NO: 71851 - DNA, 1037 bp, Homo sapiens
caagtgatttttattgaccgctgtctgtgtaatctctggtttcagatcttccagagggagcagtgaaggggctctgcaaattgttctgcttgactctgcatcgatataggtgagtcccagccaaaggccccatatgtggagcactttgtacagagaggggatttagagtagtggttagagcccagattagagccagactgcctggtgccaaatctgggctatgtcacatcctagccattagatcctgggcaagttacttaacctctctgtgcctcagtttccttgtctgcagaatggggatggtgccattctctatctcatgggtggttgttagtaagcgtgaggtgcctggaacagttgcctgctgtgccatagtggtcaatgtgtttatgctgccatttagtcatgtgtgttaaatcgtctggcctactttgagacccttataactgctccataaatgtaggtgctgcccttacacactcaatggcttatttgcccttatgagatacttttagaactctaggaggaggtgagtttatctagttatttcctaatcccttctctgttatccactggaatatggtgtgatcagtttctcctgagaaagaccagtgtatggcctgagcagccttgcccctgcctctgcctgaggtctgcatgttcaccctttcctttgcctctccccctagagatgcagcctcccgcagggccttgcaggcagccatccagcagttggctgaggcccagccagaagccactgctaagaaccttctacactctctgcagtcttctggtataggctccaaagcaggtgttcccaggtaagaggtaaaagttgtggccccctgagaattggtacagtcctgctcaggagaagctgatgcagttgactgtgcaccagagggaggagccaggatagcaagcttagtggagaaaaccactttcccgaggagcagggttgggaaacagtggaagcaaggccattttgaggggaaccagttgcccaccaggcccctaatggtggaagccatctgttt

SEQ ID NO: 71852 - DNA, 1035 bp, Homo sapiens
ctggccctgcgggctggaagtgggtcaggggctgcaaggcgggcccatagcgttacaccgcgggctcaccacgttacaagcgctagtctcccacgaggcgcccggggctgaagagcgggccctggggaggaggccttgtggctcgggcgcgggccaactttaagcccgtgatccggctgcccgggctgcagcggccgccgtcctgcccgggggcaccaagcccggggccctgcccccgctggctcccggcctcgccctgccgcgtgggccacgctgtgacccggaagcgttccggaagcggttccggagtcagccccggcaggatggcggcggacacgcaggtgaggcgggcggctgcggggccaacgcggccagggactgggtgcggacggtggccgtcgggcggggcccctctcgctcctcggcttaggggcgttggaggtggtggctgtggaggtcgtagtctcggggccgtctcaggctggactctcagggctgcgggcttggcccggcccgggcggcgcaggcagaccgcgggctcgaggagtccggggctcccgcctcgacttcagcagctggagctcggcggggcctttgcccgaccccagagttgcagaagttcactttaccgagcctctacttcttttctccaaagccctccggctgtgagccccgggccaacgccaagtcttccttaaactttgtattcagcaaatattctttgagcacctactatgagcagggactttgagtgtagtctttggattcatacagatctgggcttgagttcctgctcgtcgatttctgtgacatgccaaacaagtgacttaaccccgccaagtctgccttttcatctataaaatgaagttaaaacaatacttatcttaaaaggttgttgtgaaggttcagtgagataaaatacggcttgatatatgttggttgttatcagatccagggttagtgaaaagaactgtcctgtccaggaagagtgttacctatgggtaccttgtagttcaggaaggacctgggaaaacc

SEQ ID NO: 71853 - DNA, 3124 bp, Homo sapiens
tacattttcccacacttagaaggttttcagacacaaaacccaaaggaattgtgtaacaatccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggaggtatatgctgtcagccttgccccctcttacactgatggttgagagcatgacaaggttcagactgagtccctgtaaccaaggactgtgttttcatctgtctacctacctcatctgtaaaatgtcagtaacaacataagattgttgaaggattttttttttttttttttggagacagagtcttgctgtgtcgcccaggctggagtgcagtggcacaatctcccggctcactgcaagctccgcctccgggttcacaccattctcctgcctcagcctcctgagtagctgggactacaggcacccgccactacgcccggctaatttttttgtatttttaggtttcaccgcgttagccaggatggtgtcgatctcctgacctcgtgatccgcccaactcggcctcccaaagtgctgggattacaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgatggggctgaattgctctgccaggagcatttggtatgagatgaaatggcctctcttgagactgagctgccaacctggcaattattgtctgctaagggttctctttattcacccttacttggacttcctttcctgtagggaatctcacgtaaaatgaaatcttccctcccccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtaaaaggatcccaccaggaccacagtgggcctgactgtgacaaattagcagggtgatgtggccttctaccttactgcttttatagttgtattttatatagcagataattttgtgaggggatatttgagaggttgggaggcagggaaggcgtttctcacttgagaaatgacaagagacccaaagagggggttaatgggcaagagctgggccttaggaaccctgcctcactaggccatacccaagctgtcctgcttgggctgcttctgacaggaaaggcttcacacggactttgatattgttggtccttaaactctaccaaggcaggagggtggtgggtaatagaggagtgtggatgaccattttgaccacttcccccctcctttcaggtcaaggccttcttggctgatccatctgcctttgtggctgctgcccctgtggctgctgccaccacagctgctcctgctgctgctgcagcc

SEQ ID NO: 71854 - DNA, 1084 bp, Homo sapiens
aaaaaaaaaaaagagaaaccattctgtttctaagcatgtgcaattatgtctcagctccacgtcataccttttagtttgctgagctcgccaggtggcacagggaaccgggactccgaattcgcagctccagctccagctccagcccagcaggtggcagcagctcagagcaagctcctccaacgcgaggcagcgccttccttcgcgaccctacttaaaggcggctttccgttggctggagtggcagcgatattatccaatggttgcctgtattcgttcagctttgtctgacgggcgatggcgcagccaatagacaggagcgctatccgcggtttctgattggctactttgttcgcattataaaaggcacgcgcgggcgcgaggcccttctctcgccaggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatcgtaagtgcagggtgggtcgcctctgctcttcatgttgccccagcgcaaatagggacagtcagctgctatgtgctgagggtctactcacaccggctactgaattaggccatttttgggaaaatactgtttagttaacaatttcctgagataggtcccttctgttgcagataaacgggctcaggcaagttaagtgggtcctaagatgacagcattcgtatccaggtctgtctggcttctaaaagagcgcgctttatacttttttttttttaaacggagtctcgctctgttgtccaggctggagtgcagtggcttgatcttgg

SEQ ID NO: 71855 - DNA, 1127 bp, Homo sapiens
tctctgtaaacttccaagctggcttttcccatttcaattcctgtgatttatgccaataaagtttgcccatgattttcacctgtgctagtgctatttcttggtggtctgaacctcatggtcccagcagagaccaaacccaccccagatgcagctggatcaccagatggagggtaaattgtggatgtttcctttcttgaggtcaaaatccctggggctggggtccgtggtccttgcctgtggtcacaggtcctccccgtgggctttgctcctgcctgggcagttggtgaggacaggctggggagcagcgggatggggccctgtggggcagggcctgcccagggtgtgatcacctgggtttaccaagggcatcctcactcacgggcttgtgggtggctttccactcatttagaagtagggaaagaggctctaggacaagaacctacatgtacaaggcaatctgagtgagggcagagccatgatgcggacccagggcttgcctctgcctgtgttcctgcacagaaccagacgcggccgtgcctgagcccacacaacgtgggttagccccttccctgccgaaggcagttacttacagttgaggatgggtctctactgcctcctcgtcgtcatgtccggatttgcgtgcttcctctttgctccggtcagatccagagctccagtcctaggccctagagcagggatgtccaattttttttttttttttgagatagagtctcactctgcccaggctggagtacagtggcatgatctcggttcactgcaacctccacctcccaggttcaagggatcctcctgcctcagcctcctgagtagctaggattacaggcagctgccaccacacccggctaatttttgtatttttagtagagccagggtttcaccatgttggccaggctggtctcaaactcctgatctcaagtgatctgccttggctcccaaagtgctggaattacaggcgtaagccaccactcctggcttttttttttttttttgagatggagtctcactctgtcatccaagccagagtgtagtggcacgatctcggttcactgcagcctctacctcctgggttcaagcaattatcatgcctcagcctcccaagtagctgg

SEQ ID NO: 71856 - DNA, 1030 bp, Homo sapiens
gggcaatatagtgagacccccatctctacaaaaaaaatttatttaataaaataaaaatgaaaaatgagcgtttaggacaacacggcacatgggaaacgcctagcaagtaggagtcactccgagcgtgccgactatgcccacctcggccccatcacacagggtgcagctctagcccgaggggcagctccctgagcccctctctccgcctggcaggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttcc

SEQ ID NO: 71857 - DNA, 1047 bp, Homo sapiens
aggctggtctcaaactcctgacctcaggtgatccacccgcctcagcctcccaaagttttgggattacagacgtgaaccactgcacctggccataactgccagcattaatatagtgttactcactctgtggcagccactgttctaaatacctcccttacgttcccttatcatttcctcacaacagccctctgaagtaggtattctagctgacgacactgaagcacagagaggtgagcaacttgcccgaggttagttgctgattagtggtggagctgggattggattcagtgactgtcgcatacagccctttgctgacattgtagactctgttctgattcctgctcgccaatgagggtgatgccacgcggtgccactggggaggagggaagagaggggacagtctggtgtgtgtgtgtgtgtgtgtgtgtgtgtgtgtgtgtgtgtgtgtgtgtgaaagtcatctgtggattgtatatggtgtgcttgggggtgcagtaattgaggaaacatagtcaaccaggtgtctgctgagggcagtgggggctgttgaacactgacccctatccagggttatcagggactgaaaatgaccccaggagaagtgtggtgtgagctggcgtgcttccctctggggaaggtctaggggctgtggacagaggagggagcatttcctgctctgtggccatcctccagccccctcttctaccgtgagcaaaggctggggtccctcatgttccccagaccagcagtctggcagccctctgtcctcctgctcttcacctctcttgggttatttgcttatatcttccactggcttcctttggaagagttttttctcaattattgagctttctcaactggagagtcaaagtctccagtttccaactaggattgtggatttgtcactttttcttttcaattttgtccatttttgctttatctactttagagctctgttgttgagtgggtgtacatttaggatgattatgtcttcatgatgaattgactcatcattatgaaatgtccctctttacctctggtaatatt

SEQ ID NO: 71858 - DNA, 1052 bp, Homo sapiens
accggagcctggggtgggaggaatggggtgtgcaggaggggagaggaatttgcctttgcactggggccccgtcagctgtctggatggcggctcagcacactgccatcagctgttttccttagggtggctcagctgttttccttagggtggacacaaagcccagacctcttgtttttatttttctcctgagcgtgctctcagccgtgtgcctcctggtccctaacacaggggagagtttatggtgtgtccggtagcaaggccagagggtgcatcacctcctctgtgactttgttttttggtctaataaaaaatggggaactcttctccttcccatagttgccaatgacagactcaccatgtgctgcttaataagttacaaatttatagctctctgagcagaaaaatatcaacacagcgtgttctgcccttccctgtgtgttctctccactttgttctttggggtggctgcttggtggcttttcttattactgtttagatgctggtttggcccagagttcgctctgttcaagttctggccggagtttcctggacagagttcccacaacactgagatgcactctgactgtgttttctaacccgattgcttgctcttcctctgttcatgttctcagtgtacttggtgggggctttgaccacaactgtggtctaatcatgatcatgtgcgcttcatgggagacaggcactgtactcagcactttacgagctgtatcacaacctttcagaaagggaggtgttttcgctccactttatacatgtggaaacctgagctcagggaagtttagtggtagtgctgggatttgaacccaggctcatccaattccagatccggttatcttaatcatcataaggtggtaggtgctggtgactaaccagggggatgagccttggggcctgctgagtaattgatagttacctttaacaatctctgccctaggggcccatcccaggaaatggcaaagggtgtgtccagtgcaagactgggtagctttgccttcccatcctctagcagggggaacagccagctgttggca

SEQ ID NO: 71859 - DNA, 1548 bp, Homo sapiens
cccatcactcattttctctcactgacctccccgctctgtggaccagcccctcaattcacagaccagtccgtctaccatggtatctaagtctagaacggtaatttgggagtcctgattctctccccacccctagattctggtgaaatgccaggggaatgaggtggaaggtgggccccaaggtatgaccatccctgaacgtgtcctggctagcagagtcccctccaccctctctgcgtcaggccctgctggaagccacgcaggtgaaagaggacaggatgcccagaacagagttttactgttttcctgttattggagccccaaggctactcttttcagtccagtcttgatctggtgttaggggaaagaaagtatctcctggaagccgactctaaacccaagggggttggtgccagggttctaggaatgccttgggtggcgtgaacgcaggagtgggaggattcgctgtctctccctccccttcacgcctgtagctggagggccctgagcttgggaggtgaggaggggggcaacgtttcttctctgcaggagccttgtctttcctctctggactgtgggtggcttgtgtgaccactgatgcttcctctgtcccaggctctgaggagtagattcagcagacaggactgatggacctctaccaagcagcgccgggcactaagttaagactggctatttgtaggtgctggacttgactgcttccctccagcttccttttgggatcagggtgcccctgagatcctggagctggggttggtgtagggtcctgcctgttttgcagagtgagatggctgccaagcgtggttctgcctttgggtcaggcttggcacccatttttccagtgtgctcaaggttggcatggcttccaggcaggtatttttttttttcacataaaaatagctcagctggaaggaggctgggggatgttctttgaaccaggatctaagagtctgagtgctttcccagtgggaactgggagcaaagttacagtttctaaagtgctggtgcagttctgttgcttctcggcagtccccgtgctgtttcaaggactgagaaagtctttgtagagctcgccatcgaaatctggaattcctgtcttctgacagtcttccatttagggccaggaaactgagttctgaaaggaaagagagtactgtatacgggagaggggattgtagggatttaaattgctgtttgtggagtacttccctctacctcgatttgtgatatcctcacaacaacccttttatcagattccaccttaaagccaatgctgtcatgaccacctgcctttttacagattgagaaagccgagacgaagagaggctgattctcttgcccaaggctgcacagccatgaaatgacaaaaccataactggaagcccaattcctagctcccagatctgtggctcttgtataccgagaagactttttttcctggggaggaggcaagggcacttgaaggaggggttgccactgggtgatggcgatcacctgtaacttctactgctttctaccatagactcccagttg

SEQ ID NO: 71860 - DNA, 1024 bp, Homo sapiens
tggacgggtgtggtggctagtgcctataatctcagcacttagggaagccaggcgggaggatcacttgagttcaggaaaacagcccatctctacaaaacattaaaaaattatccagttgtagaggtgccaacctgtagtcctaggtactggggatgttgaggaaggaagattgcttgagcccaggagttggaggctgcagtgagccatgatcacaccattacactccagcctgggtgacagagcaagtccttgttccaaaaaagaaagagaggagcgcagcactgccgcctggcccctccagcttcccggaccacggccaacctcgagcgcaccttcatcaccatcaggccggacagcatgcagtgcggcctggtgggcaagatcatcaagcgcttcgagcagaaggggttccgcctcgtggccatgaagttcctcccggcctctgaagaacacctgaagcagcactacattgacctgaaggaccgcccattcttccctgggctggtgaagtacatgaactcagggccggtcgtggccatggtctgggaggggctgaacgtcgtgaagacaggccgagtgatgcttggggagaccaatccagcagattctaagccaggcaccattcgtggggacttttgcattcaggttggcaggaacatcattcatggcagtgattcagtaaaaagtgctgaaaaagaaatcagcctacggtttaagcctgaagaactggttgactacaagtcttgtgctcatgactgggtctatgaataagaggtggacacagcagcagtctccttcagcacggtgtggtgtgtccctggacacagctcttcattctactgacttagaggcaacaggattgatcattcttttatagagcatatttgccaataaagcttttggaagctggaaaaaaaaaagagagaaagagagaaggggagggaggggaggaagggagggagggaggaaggaaggaaggaaggaaggaaggaaggaaggaaggaaggaaggaaggaaggaaggg

SEQ ID NO: 71861 - DNA, 1050 bp, Homo sapiens
agaccagcctggacaacatgatgaaacaccctctctaataaaaatacaaaaattagctgggcatggtggcgagcacctgtagtcccagctactcaggagtctgaggcaggagtatcacttgaactcaggaggcagaagttgcagtgagctgagatcacgccactgcactccagcctaggcgacaaaagggaaactccgtcttaaaaacaaaacaaaacaaaaaaacacaggatgcccagataaatatgactttcagataagcaatggataattttttggggggtatatgtcccaaatattgcattcattgtttatctgaaagtcaaatttaactgggcatcctgatgtacttgtattcacttaatctgtcagccctaaatgtgcatcagtggaatggctgccagcttattccagttaattcttcttgccccagattgtacaaaacagggtccaccttggctcagtcctctcctttcatccctctccaggcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagacctcatgtttggatattgttttattctctgtctataaactaggtctctgcctactcttttatttttatgtatttattttttctaggtggagtcttgctctgtggcccaggctggagtgcagtgatgccaccttgcctcactgcaacctccgcctcccgggctcaagcaatcctcccgcctcatcctcccgagtagctgggaccataggcatgcaccaccatgcctggctaatttttgtattttttgtagagacagagtttcgccatgttgccctggctggtctcaaactcctcagcttaagtgatctgcctggctcggcctcgcaaagtgttgggattacatgcatgagccgccgcgcct

SEQ ID NO: 71862 - DNA, 1055 bp, Homo sapiens
cttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctcagtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttg

SEQ ID NO: 71863 - DNA, 1044 bp, Homo sapiens
gctcgcacctgcggctcaaacttttgtgaggctgctcccggagcggcgggaacccggccggagccgtcccccttccagcccagctcggccctcggcttcccggggccccggtgggcgccaggaggctcagcgggaacggggcgagggcggtggggggcggcggcagtggagaacgcgcgggcagcttggcgcgggggcggccgggccgctccggggtcaccgggggcaaaggacgggggggggggaagggcgcggggcccgggctggtccgaaggcgggtgtgtggttacagaagggctgcgcgaatacttcggccagttcggggaggtgaaggagtgtctggtgatgcgggaccccctgaccaagagatccaggtgagcccctcaccccctcctcctgctcccggctcgcccccctccacccgccactcactgccttgtaaccatctgcctctccctcactacggcgcgcaggggtttcggcttcgtcactttcatggaccaggcgggggtggataaagtgctggcgcaatcgcggcacgagctcgactccaaaacagtgagtggccctcggggcttcgggggtcctttgggagagggaggctgccggaggagagggtcaggactctccccaggggacagctggacggggtccatgaggaaggagggagtttttctgagtaagagggctgccatgctctgaaactttgtcactagagttgggggggagagggaggagaaaaatccctggcctgccatgagatgctacatcccccctcccctagtcctggtgaggggagaggcagccgccaccctctccctagaagtactaatcatgatgcctcagagcagagcttggggtggggctaggtccctcccccagcccaaattgggtgagtcagggtagcactgacccacccggtggcttctgtgaactctaactagtatttggctctgcgacaccccctcttcatccagaccaatggcaaagcatcccttgaagccccctccctctctccttccctcctcccccgacttttggtca

SEQ ID NO: 71864 - DNA, 1224 bp, Homo sapiens
gggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcct

SEQ ID NO: 71865 - DNA, 1025 bp, Homo sapiens
cgcgcctgtggtcctgtacttgggaggctgagatgggaggctctcttgagtctgggaggtggacattacaatgagctgagatcatgccactgcactctaacctgggtgatagagtgagactccatctcaaaaacaaataaaataaaaattcaaggcaggaataaaacagtaactacataatgagctcacattttaataaaagagatataacaaatgaacaaaagtccattaaaatgttagggaaaaaacccaataggatgagttactaactagaaggggagaagggatttggagtggttaggagagccctttctgagaagataagctgagacctgtgccaagagggaggcagccatgcaaatactgagaggaaggaaaaaaacgaagggccagtgcagagatctagagaggaaaagaacttgtcttgctggagaagcagtcaaggtagccaaggagagtactgagaagagtacgttggagtgagtaggtagggactctatggagtagggccttaaaggcgatgattaggccaggcgcggtggctcacacctgtaatcccagcactttgggaggccgaggcgggtggatcacggtcaggagttcaagaccaacctggccaagatggtgaaaccacgtctctactaaaaatacaaaaaaaataagccgggcctggtggcagtcgcctgtaatcccagctactcgggaggctgaggcagagaattgcttgaacacgggaggcggaggttgcagtgagccgagatcgagccactgcactccagcctaggcaacacagcgagactccgtctcaaaaaaaaaaaaacaaaacaaacaaacaaaaaaaaaaacaaaggcagtgattagcagttcgggttttgtttccacttacactagcgagagcatcagtaatgaacaaggggaagagtgaagccactgactcgcgaggtgactgtgggcaagttcctgaatcttgctaacactctttaaccccctggaaaactgttcgctaatcgtcacattaaacggct

SEQ ID NO: 71866 - DNA, 1099 bp, Homo sapiens
aagtttcatttatccttggtatctgagttttatcctggactcatctcaatttaataatcattttgggggcggagagggctcctttgtcccaggcccagggctaattttaggataagttctcttttcagaaagagaaacactaggtatgactagtatccctttggcatataatcactttgtgggatggcagatagttctaggttaggagttcccaagctctagtctactttcaacactcttcagaccttagtaggaagttagccctcttctgggaagaaagtgggagcccaggaacaaattcaggtatgttcggtaaagatagggctgctcaaatcaatgcaaatggcaactaaaaatgacagccaaggttgtcacatagtgatcaagatgctccgtctaccagttacgtagatagaaaagttcactttcatgcagttggtatggtcctttggggggagttaaaggcagataaataatgtcttccatactgaacaggcctgttaagtgaattccttggaagctgacttttgcttttctttcacctcagttagcatcaggaactcactgccttgttggggccagatctttcccaattctgtcttcagaagaatctgttattaagaaatgcttgagcatccattttttcaggggactgaaaaaagcaggaacattagtattcacagtaaaaaaatactgtcattatgcttccacatgttcacagagtaccccctttccagaatgagctactcagctgtgtgggaatggctcttgttcatccagctttggcaaagagatattacctgtttgaaaataacaaaagagaatttttgtttgtttgtttgtttttgttttgagacagagtctcgctgttgcccaggctggagtgcagtggcgcaatctcagctcactgcaggctccgccccctggggttcacgccattctcctgcctcggcctccagagtagctgggactacaggcgcccgccacctctcccggctaattttttgtatttttaatagagacggggtttcaccgtgttagccaggatggtctcgatctcctgacctcgtgatccgccctcctcggcctcccaaagtgc

SEQ ID NO: 71867 - DNA, 1313 bp, Homo sapiens
cctcataatgttatgaaggtttaatgagatagcctcatgccaggcacagagtacacagtaagtgctcaatacttaactattattgttagatgttggtttgcttattcttctggctctgatttttttcccctttactctttttgtttttgtttgcatttcagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattgacatgtgtggttgtccttgattaagttcacagatttcaccaaataggcacactaatttaaaaaatcactgagttgtagtcataacttgtacccagttaggagcaggggtagataactttatttatatggggatagacagttgctctgatgttggtttgagaacgtaaactccaagagcgggttctgggttctcttttaattcaaggccaagcttgtaaattaggctgccttaaagaaaaaagcattgcagataaaggaagggaatgggaaaaataaacacacggtggcttttgcctgtgatcctagccctttgggaggccaaggcatgccagaggatcccttgaggccaggagttcacgaccagataggcaacatagcaaaacccccacctctacttaaaaaaaaattaactggacgtggtgatgcacatatgtagtcccagttacttaggaggctgaggtgggaggatcacttgagcccaggagttggaggctgcagtgatctgtcaccactgcactccagcctgggtgacagagggagacccctgtctcagaaaactaaaaaaatgagcagcagcataaatattattgggaaattcttagccaaaaccaactttggcagtttggttagaggaaaaactctctgattctatcacttt

SEQ ID NO: 71868 - DNA, 1824 bp, Homo sapiens
acatggtagaaaggcattcaaggagccagatttgaacaacttacccagccttggatcctgaagaagatcagattttgtggtggttttagaattaaatattttttaaaaccccgtaacttaagagtcttagagattttattggaaagtatagactatttctgtctagtgtttataagtgatgaaatgctaaactgggaggtttatctatcttcaaaatattaacacactggaaagacctggggccttctgcatattgcatgggagttttagggccctggtggaatgaaataaatcgaggagcctggcacctttttaagatgtgaatgtcacacaatcacagcatactcccatgtgcttaagagtgatactctcagtatctgcctatcttgtgtccctttgtaattttttaaccccagaactctattccctccttcaggatgtcatacattatctttttttctctccatgctgctctgaaatcctgcttagaaaactattaggaaatggctgcagtcctgagctgtgagcggtaaacacagcctttgagagcaggagcacatttccctttcatgacatcaggtagggttgtatgactcccgactagttttagcatctgagtcttaccttcccccccactgtattgaagaatgttggtgatcttttaagaggtactctgtatagtttgtcattcatacctacaagaaaacaaactttagattttttgttgttgtgttgttaccttcagctactctttggttatttcatgtctggtttcaaaattcccatgtcctgtgaaaccctgtcaagcaataaataattggtactgttaaatttcataatggaaaaaattggaactcaaagtattaggagtttggcattgattttaaaggacaaagaaagaggctatgaattctcaaagatactaaacctgtaatgggatggacttcttgctctgttgaaaaggcctggtctctggaagatgaacttaaaaccagcttctcaaggtggttcatttaccacacatacttcagtgctcttttctgatttcatgtcccttatcaaggtttatgatttggggaccctcaggatttaagtgatcatggagaaaggaccataggtattgctggctcttaacagggcagttaacatagctgaaggatgtgggctttcttatgttctccatgcctaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgaggtgggtccttgccttctgttgaggagcttgtactcaaatcactccacttgaacctgacctagcagaggtagcaagaggccatgccatttggtaacctcacagtaccataagagatctatcttaggtggacaaagccatggaatttgctatgcctaagtccttcagggtcatagctgaaagaagtatgcattcatggtacgtttgttttttaatatgctttattctgcatattagtatcacattacacagtttggtcatggtatttgtaacctggagagaatactagtgcagtcggtcttcataccaccccattcacaaccagcttaaatggcagtatccctctgtgaactcaactacccctcctgtgggtccaggctgagctctacaggtcagcctcttcatctcagcccttctaggtcctgctgtcagggctgagctgtcacttcacttttttcccagagt

SEQ ID NO: 71869 - DNA, 1053 bp, Homo sapiens
tttggagggcccaagcccgcctgcaccggcctcggggggtccaaatgagccttgtccgcctcctgcctggggcagcaccgtagggggaagcggccgcggggcagcgcgggggtcgccgttcgcccttcccgctcgcctctcccccggcccgtgctcgccgtggctggagagcaagctgcagggtcgcggatgccgctggaggtcgtggagggatctctggtggaatagctcgccgttcgcgcgccccgccccgcaggccagggcccgggctttgtaaagggatcacggattcgggaaaacttctaaaacagccggagtggggctctgatttcacttccctcctttgatgagggaggcttggcgagatgctaaaggttccagggatttggaaactctagattcctaaccccgctctaaggagtgcttgtgattttgcaaacagcgtcggccctcaggccggaaaaagcccaggaactttcaaaactgtggttggtggtggttagcagctgcggcgctgacctggtcactccactccggccaaataagagcccgcaccctgttttcctagcatcatttgctcccggggaacgcggaatgttcgtagggtgtccgacctacctggggtggacgtattgatagggcaaggggagcatctgaggaagggcaggcaggaagcaccgcgaggcgttgatggctgaagagtcgactctgacagctcatccctagtatctcctcatttgcctcaaaaccggaactgggcatttttacccctaagccggagaaggctatgcctcgcttatttagtaaccgtgccattgtggtttttcaacagttgctatgggtcaagtgccatggtgtgtatttagctttttttctttccttcttatttttttagattgataaattaggggtttcaccatgttgctcaggctggtctggaactcctgagctcaggtgattctcccgtctcagcggatcaaattgttaggattacaggcgtgagcaacccgcccagcctgtatttagtatttttaacaatttatgaggtgtagg

SEQ ID NO: 71870 - DNA, 1052 bp, Homo sapiens
ttagccaggtgtagtgttgcgtgcctgtaggctacttaggaggctgaggcaggagaatcgcttgaacccaggaagcaaagcggaggttgcagtgatccgagattgcgctattgcactccagcctgggtgtcacagtgagactccgtctcaaaaaaaaaaaaaaaagtccatgcataacttcttgaaacaatcacttatcagtggacacttaagttgcttccagtttttcagtattgtaacagtgctttgttctgatgaatatctttcaaagataaaaataatctttttaattctactttcagaagtaataggtactcattgtataaaagtgaaacactgtagaaatttagaatctgaaaaagaaagttcctttgtaagatctgtaatcttacaactcaaagataatgttaaaatttgattttttcccggcatataacaggcttttttcctttttaccaaaatgggatgattctgagttccctgtcacgatatataaatctactttattcctttcataaacttccatgcatttccaccacctgtccccacccacccacccacatctgtatacacacattctgcctcccttgccgttaccctgtatgaactgttcatgctcctatctaaggccatctccctggcactgggtccatctcctctcattcctgtgattgtctcttctccctctcctgcatcatcagtttcccctgtctactggattattcccaccagcgtgcaaacatgctgtcatattcttttaaaaatgcttcccttgcctacacattctcctgtagctaccatcccatctcggctttcctccaagagttgtctgtactccctgtccccgattcctcacctcccattctctctttaatccactgcacccacacagctcaaatgtggtggtcaccggtgaccaccatgctgctaaacacagtggccaattctcagtgcccttcatggccatacatgtcacagttgctctcttcctctgggtcctcccttggcttccaggaccacacactctcttagctgtcctcccatctcactgg

SEQ ID NO: 71871 - DNA, 1069 bp, Homo sapiens
gtgagcggtgcattgtggtctgcaacaaaatgcaggagaaagatcctgagggaaccatggagtcaatggaccaatggaagaatgccgtgggctgcgtcaagccaatagggtcgcgcggcgaggggcggggccggcgggagcagggcggggcctgagcactaggcggcggcggctggcgtggggctgcttagatgcgccacggtttcggtagcgacggtatctctagccgggcctgagctgtgctagcacctcccccaggagaccgttgcagtcggccagcccccttctccacggtgagaaactcggggggccagggggtgtcctcgctgccttatttcgccccactccggacttagccctccgcgtagcccgcgcttcctgagaagtggggtggggggcgtcgtcccgtggtggcgccggccggggtgggggcagttagtgcctggggggcgcggcccaactcaaccccttaccccaggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggtgaggatgggcgcgggggccgatacgcagccgggagcagggggttccttccccccgatcctgctttcctaagggcgcctgacaggtcccgggaatactgctggcggcttggggcgtagaagcttccagaaaggacgcagatgcattttgcgctcctgtggagaagaccagacccccggcgtccgaagtttttttttttttttttttaattacccagctccgcggggggaaagcgccacctagcaacggtatctaagatcagggagcagcggttcccccttctgtgtggttcctgcgccgaggatccatctgggtgttccggaggggggagctgcgtgggtgtttccagccgggccgggaggagatcttgccagccttccagtggggagttgagggaaggtggtgggtggtggcggggctgggggctggggtaggggct

SEQ ID NO: 71872 - DNA, 1263 bp, Homo sapiens
gtctttagggctgacctttcgtcctttgacctcctcagcctccattcccatcttcgctcagactgcaagtatgtttgtattaatgtactatgtaggcggcttggagctggggaacattctttcattctaagaatttgcagatgctgacgttcctcctttctgcccctacaggctctggcttatccaagaggcaaacactgacctctggtaattaaaatcctagttcttttcttttgtcttttccaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgtatgtgtgtgaattacaatttgttcaaataacagcgttgaagacggtcacttgatcagatgcccaggttggtggggatgagtccatccttacagaagttaagtttctgtggggtatttcagtactctttagtcacattctctcacccatcctgcaactgttgtgcatgttgagaaatgcagtgcatgataaagaaacatttaaattaaatctttagtcctaatctgaaaaaaatcaatgtttaaggatatttgttaagacattgctatagaatgttctgggcctttggcctcaggttgtggtgatggatgtgtatgtagtagtacttgaagctttctatggctataaaatggaaataagctcaaaacaaagttgggataatgaaatggattccaggacccttgtctagccccctcccctgcctagaaagaaggtggccttaggggaaagtaaatgtttctgagcagcagttttcatgctcttctaataatgtaaattcctgcaaagactttatcagcctgctgtgctgtgctttgctgtggtcaggaacaagtgtgaattgataccttttcctgaaaagacccaattaaagctggg

SEQ ID NO: 71873 - DNA, 1002 bp, Homo sapiens
ttgagaccagcctgggcaagatgacgagacctcgtctctacagaagaaatttttaaaaactagctgggcagggtggtgtgtgcctatagtcccaactactggggatactaaggcaggaggatcctttgagtccaggagtttgaggatgcagtgagctgtgtgccactgtactccagcctgggtgagaaagcaagacctccccatgtctaaaaaaaataataatgattgattaaaaatataaaaggaaaaatatgtatatataaggaatatggtgaagctgggattagaatccaggcagcctaaccacccaggacttgggctctccagctcaatgctctacatgaaatgaattcactgggggcaggaaaaacagctacccacactgagacccggaactcactttctctttcaggacttgcatgggtattaggagatgctgaagaactgccctttgatgatgacaagtttgatatttacaccattgcctttgggatccggaatgtcacacacattgatcaggtatgaatggctgcatcctcagcttgtatgactctcaggaaattacctctgttgtagagctacagtgagtgaggaaagaaggagagttttgttttttgagatggggtcttggtatgttgcccaggctagtctcaaactcctgggctcaagcagtccttccacatctgcctcccaagtagctgggattacaggaaccttacaggaacccaccaccacacccagggagagagagagagagagagatagatagattttttttttaatcttaaaaaagataatgtttaagggcttggcgcttgagtggaatgcctgtttgaagtttagggtcctccatcctttaagttgacaaattttctagtcacaaaattgaaaaagactgaaaccacagagctgatctccatagaagtctgtcttacttggattggtattcacatctttgggatttgtcttgctctggccttttgtgtatttcctcatacttgt

SEQ ID NO: 71874 - DNA, 1023 bp, Homo sapiens
ataacaggcgcctgccaccacacctggctaatttttgtatttttaaaaatgtagagacggggtttcaccatgttggccaggctggtctcagactcctgacctcaggtgatcccccagtctcagcctcccaaagtgctgagattgcaggcatgagcccagcccaatttctttaattaaaaaaaaaagttagtgttgaaatgagtagaaacttccacgttcacacactcagctatgattgtgcctctgcactccagctagggtgatggagtgagtccctgtctctaacaaaaagaagaaaggacttggctttcagccacactgcatccagttagctaacacaggtactcctgtgcctctgttacccctttgggttttaggaaatgctgtttcttccttttttatttttgttttagtctgcatctttcctcatgttggcttcccacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggtgagtcctgcagaaggcagacacaggggaagtatttgtatctttatagaataaggtggaatatgtaaaatattgaaatgctttatcttttggctttcagaaacttatagatgggcaggttgaagatgatttgcatggctgaatctagtttgtgtgctgttatatgcattatgtatgcatagcagcccattgagtgagcttacccagccctatgtgactgggatcactagatcccaagtaagtcaagaatcttacccaagtcacacaacttctcagtggcagatcccaaattggagttgaatcttcagatctcagctctgagaccctgagacagaagttttgctgtcatttcccag

SEQ ID NO: 71875 - DNA, 1544 bp, Homo sapiens
caaaaactacatttcccagaatacctcaccccctctccactatatatacagtccatccgggttctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcggtaaggacgggcctgcggcagtgggcgggggcgactgcccctgctgctggggagagtcgttgctctcatcggctgggttactcggggacaggctccactttcttttatagctcctacctgcccttttccatggctctcatttgcagttacattaatgagcgctgtgctgcgtggtttacgtggatcatttacattaatactcaaaactgctcgattaagcaggtgctgttcttatcgccattttgcatatgatgagaaagggtaaggtcacccagctagtatttggctcacagcaggccttaagacttggtttgtgtgactcatcagtccacgctcctaaaaccactaagttgttctaccctttaatgttgaattaacattggatagtgttcaagtttagatgggtgggtgagggcccaaggacctttcaaactcagatctcttatttaataacctggtcccagatccattcctctgtcgaagaggaagtcatccttcagtggctattcattgtggggttaagagcgcagactatgaattcagtctttttgggtcccagtttgccagaccttgagtgagtgccccgagtttacttacttgtaaaggtaggtggaggtaatataattaaataaacttaaaaaactaattaaaaacaaaacaaatgaactaaggtcttaggatatctggcgtctattttgcgccaaatacacataatgtctattgttgtgtgttggactataggattgtcctttaacagggaaggttttatttctgtaatcaagtctgtcaatattatgaccatgttgataatagctacctttaattgagggcttaccatgtgccaagtactaggtgaagt

SEQ ID NO: 71876 - DNA, 1053 bp, Homo sapiens
tttgtactaatctctgctctcttttgtatttcagtcacattagcagtaataggaaggtgttttcagcgacagtggggatgttgtggcagagagggaaatatttgaagtccctaaatgtggaggtccagtttaaaacttgtcaagattaaaaaaactgtttagagtgagaccgggcgcggtggctcatgcctgtaatccgaacactttgggaggctgaggtgggaggatagcttgagcccaggagtttcacaccagcttgggcaagatagtaagaccctcgtctccataagaaaaaaaaaaaattagccgagtgtggtggcacacacctgtaaccctacctacttggaagggtaaggtgggaggatcgcttaagctcaaggaagttgaggctgcggtgagctatatcacgatactgcataccatccagcctgggtaacagagacccccatctctaaacagtaaaaagaaaactaaggctgacttaaaacaaacaaaaaaaacagaaaattgtaaggtctgctaactcgctcagagttcacctgctggatatggcaaacttgtttacctggtgtgagaccattggagtatgggttctcgggccgtgtcaggaaatggcatgtatgcagactgattttgcagttctgcacatgcgtagctttgccatagatccctcaaaagatagaaggtaaccagtccttttggtcagtgttggaactggtttagagtggtctgttcaaagcaattgataagtaagtttatttttgtactctattcccagatgtatgttaaggatttggttctccaactgtgaattctcaactaatttttctggggctcctctttaagccactaacatacattcattagtcagttgcaataaatgccttaagtttatttcttagcagtaggtgaaagcttgtgacaacttaaaataaaacaaacaaacaggtatttaaggaattttactgctatgtccttcactttgaatatgttggttagtggaattaactctgattacccaacaagatgatacagaattctatagtagtttga

SEQ ID NO: 71877 - DNA, 1009 bp, Homo sapiens
cctgcagcttctgcctctcaggttcaagtgattctcctgccttagcctcctaagtagctgggactacaggcgcgtgtcaccatgcccggctaattttttttgtatttttagtagaacggggtttcaccgtgttagccaggatggtcttgatctcctgacctcgtgattcacctgcctcggcctcccaaagtgctgggattacaggtgtgagccaccatgcctggcctaatttttctatttttagtagagatggggtttcaccctgttggccaggctggtctctaactcctgacctcaagtgatccacccaccttggcctccccaagtgctgggattacaagtgtgagccactgtgcctggccgagaacagtcttttcaactgccttgaagactagccattttctggggttctaaggggtgagagaggaaatctggcttactgctgtttgatggagtcacggtctaggttaattttagttcaagggatgcctttggggaatttggctggacttgaagcagaagaaaacagttcatggatttagacttctgcctgctgagtctttgggttctttccagagctggagctcagaactgaggctgaggtcctagtgcagtgcctcatgaaccagggctgctaatggcctgcatttgatttctaagtgaatagatgacaatttctgctgagggtttattggtagatcctgacagtctagctttttcctgtctttcctatttctagctgccaatttgtggtgtctgaagaccaagactacacagctcattttgctgatcctgatacattagttaactgggactttgtggaacaagtggtgagtagctcagccaagcccataagctatgaatgggagcactaaataaaggcactgtggtgacgcagcagctgttggctgtgtgcactgcttgatacccttttctgcctggcctttctatagatgtttcccagaggtcagttcctggttcttcctggagtccattttgtgactaattg

SEQ ID NO: 71878 - DNA, 1097 bp, Homo sapiens
ccttgatgctttgcttaaagagctatcatacaaagccaggcgcggtggctcacgccggtaattccaggactttgggaggccgaggcgggcggatcacaaggtcaggagatcaagaccatcctggctaacacagtgaaaccccgtctctactaaaaaattagctgagcgtggtggcaggcgcctgtagtcccagctactccagaggctgaggcaggagaatggcgtgaaccaaggagatggaccgtctcaaaaaaaaaaaaaaaagaaaaaaatgatcatacatgtacctacgttgtaaacaattttagaaagatatgttgagtataaggatgtacggggatagagatgagagagatgcggatgagagagtagagaggcctaaaactttgacagtccctaatcagttcttcaagcagtgaaccttctggtggcattttgtttcagcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagaggtgagattgagacatttactcagttagatcccaatctcttcactccttgccctgctacatatgagtgtccatgtttcagtgttgttgccacagagtcacatcagtatgttgttggtgataccattacgatgcagctgatgaagagggagaaaggggtgttggtggctttgcccaaatccaaatggatgaatgtagaccatcccattcatctaggaggtgagttctttaaattttggggacaaataatcctgggtacattctttaaggtgattgaatatatctaagcatcagaaagtgaagcctttgggcagggcacatctggcatgttcatattagtcataggattccagtaggttagggtggggtttgtagagagtagattaattattggtttcaagtttgtttaatctatacatcctaatttttcattttacaaggttttattacatagtgtctttcactgtgccc

SEQ ID NO: 71879 - DNA, 1026 bp, Homo sapiens
tttttgtatctttagtagagacggggtttcaccatgttggtcaggctggtctcgaactcttgatctcaagtgatccacccgccttgacctcccaaagtgctgggattacaggtgtgagccatggtgcctggctggtttgagcttttctgatattacatacaatgctgtaacaataaacgcgtgactaaagttttgactacatctctgggtttcttagatttcttatatcaagagcagagctacagaccttattttaagaccattgttaaattattttctaggaaatcatgctaaattaccccattttcaccccagagaaaaggctgtatttgaaaattcctatttagctacaccatcgtgagctttgaatgttgcatttctttgatcttgctggcattcttatagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaaggtgagaggatgcattggagatgctaaaccttttcactttctcggcgttctgtggtgaaaaccagaaatgctaaaccttttcactctgtcgggggtgagatgatggacgctggggattaagttagttccattccacatttaagacaataagcagagaatggctaaaaaagccaatttgttttgggctttgtttgatgacagtagagaaggtttaacctagggcttttaaagctctttctagagctgaaaggagcaagtcaaaatgattttataactaattgtgacagtggagttttttagattagctatgttcttaaagcaagttagagttctttgttttctgggaaaatacttaagattctattctagaggtgttttgaaagacattgtggagaaagtattatggcctgcccagtatgccttaggagtacctgaaacggcaagaattacacaagaacaga

SEQ ID NO: 71880 - DNA, 1249 bp, Homo sapiens
gagatggggtttctccatgttggtcagggtggtcttgaacttccaacctcaggtgatccgcccacctcagtctcccaaagtgctgggattacaggcatgagccaccacacctggccgtatgtgtctttacagtagaatgatttatattcctttggctatatacccagtaatgggattgctgggtgaaattttatttctgtctttaggtctttgaggaatcaccacactgtcttccacaatgattgaactaatttacactccccagtgtcagattctaagcagattccaatccttagtgggtattgcatgctttttgcttcctgtttccctcaaagttgagatatttaagcacctaattccttcccattgggtctcattgccttttaacttttggtcctgttgagaggccattctaagcccttgcccttcaagctaagtgtgtgtctggaaacttaaccttctctggtgttctctctggccacgttagactcgggaagaggctctgtcgggattggccggaagcagaagggaggtcactggtgttgtggctgctctggaacaactggtgctgatggctcccttggcgaaggagtctgtttttcaacccaggaaggttagtgtgttcctgttactaagtggctgccgttcctcaaatgctgtcattgagctggtaggcattactgtgagatctaaaccttctcaagagaagaggggacaatgagtattttctgtatgcttgttattagttctttccccaggggtgttaaatcagtgaacacgacagctaagataaacatctagggagcttggctcttaggtctgcatttgccacattgctttcggaaagcaggagatatcctttctgttgacttagagtttgctgcaacagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaaggtgagggtgccggaagagagggctgggttgccgcagaggtgtttcagaggtgacccggtgctctaagcagaggagcgccacta

SEQ ID NO: 71881 - DNA, 1096 bp, Homo sapiens
gggagatcaagtctgcagtgagctggcctgggcggcagagcaagaccatgtctcagaaaaaaaaaattgggcttcattttctactatttcaggccaagtgtctttcaatagggagatctgctttatcttccttcccagttatttattctgtcagtggttcccaggtttttttctgttctgtttttctgccaacaaataactttatcttctctgttcgtccccctcagctgtggggccttgaaaaaatcagaaacagctgatgggctttagattatttgttgctggactcagttcactcctttgcagtacaaaccaaaaataactggatttggttgcttattccaccttgctgtaggttgacagtttctctttggcttttcaaaatgaggataattgagcactactgtttccagccccagtgctggctgtgttatgtatatattgttggatatcggggttaggaccccctgctttcagagttaggcttgcttttgttgagtattggtcctttttccaatgtaggatgttcgacagcgtcacagatatctctctcacttgccactcacctgtgagttcagcatctgtgaactggctttgcaacctcctgtggtctctaaggaaaccctagagatgttctcaggtgagaatgcccctgctctgcttctctttatagtagggttcagggattcttgtggctagacacccagtgggggaggaaacttatggaactgtatcatgagtcttagtacctcctaaacacttcatctgttcatctagtccagctgggcctactgttgtgggtttagctgctaatactgggaggaggtaatgaccatgttgtcctgggtctacctctttacaacctgaccaatctgcagatgacattgagaagaggaaacgtcagcgccaaaagaaggctcgggaggaacgccgccgagagcgcaggattgagatagaggagaacaagaaacagggcaagtgtaagttcaggaactttcatctttgactagcactgctgtacgtcgttgtatagaactctgtgtctgggacctgggagccagaccttagccacttgttttcttcaacttttaaatgt

SEQ ID NO: 71882 - DNA, 1050 bp, Homo sapiens
ttgagggtctcagtaagaatctcttgtgccttctgtgcagtgttctttacccatttcctaaggaacaaacagcttatggtttactaccttgtgggtttcattgccatttccattagccaggatatagaggacatgactagaacagtgtgttaaggagagaagtacctggaaaatcttttcaaaggtgatagttggttctgtgcctctccagttagtcaaggtaggtctgaaaaagaagttggaccagctacttaaattctctcccccacttctttcccactttggcagatgctgagggttggaaaagcaaaagcagatgtgtggcccaaaactgctccaaagaaaggtgaggatggtccactggtgaagggggagtttggcttctttccataaaaggctgtttctagaaaaagagttgtttctatagttttaacactggtattttttagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctggtaagggcagaggctggagtgcccagggttgtcaaacatactacacatgtactgccattcccgcctggattcagtggcagacatcactaattaggctctttcccttctgaacccttcagcacactctagtgtcatttaaataatactccatttggtatgtcagataggacctatttgccaccccagagaaattgatgacgcctgaaagtgaaattctgaggaactcttccaagatacagtggggtgtacaacctgtatcctttagaatcttgagttggtacagggtggctaattagatggagaagtcagtctcgaagcctgttgcactctgttcatgactagacaagaatcacatatgtatggcgtgctatgtgcctagcactgtgctaattctcccaacaaccacgttaaatgggtgtacctcacgttacagatggggaaa

SEQ ID NO: 71883 - DNA, 1050 bp, Homo sapiens
gagaatatactcgcatacataactgtggtgcaaggttcccagggccccaagggtagcggctacatcctacacactattgtaaacttcagtgtgcaacagaaccatccattacagctgcaaggcgctccatcccggggttcagccctcaaactagtcagtgaccctccgcaggacgcatgcgcgcttacaaacgcagttgggcggggcttgagagagctgacagacttcggcctctcaactttctagctccgccctaatatcctgtctccttctctgaatggctgaaaggctgcggaagcaagcttcccattggcagcggacagaattcacatccggtttgcacgccggaccggagagcgcggaggcagccatggtgcggttcaagcacaggtaagcattcccttccagaccctcccagtgccttgctgggtcctcgcggccccgctagtgtccaccttcctctcgcctgccgcaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtgcaagggcgctgggggaagaggggaacccgggaggatggcgggatgtggagggggcaggcgccggaggaagaaagaaggggcacgagtggccaagcccgtgcaccgttttttgtaaggtatctctttaagcgcctgggaccccaagcgagagtccgaaattagcagagcgctaaaaggaggggcccgaaggcagtggggctttgagctagaagcctctttttacctgcttgacaggtaatttctgtaattggttgtgattgaatttgatagggtagagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgta

SEQ ID NO: 71884 - DNA, 1601 bp, Homo sapiens
cccgccagtcctggaagagagcgacctctacgaccgtcctggagatttgcgggggtcaaggaggggcgctccgagcaggtggcgccaaacccactcctctggcctctggccagtaccgccagggagggactcaggagagcaagcggtttggagtctgggggtcaagagaggggacctcagagaacacagaattacttgagggcgagggacactggccactgcctatcatgtccctgaaggcctgagaaaagttaggagatccaaaaatatgaggaaagagaagaggtgtctgggtaggcatggaggggcatgcagagctgtggctcaaactggaactttggggtggtttaaggaggctgtcactctagggatgccattggaagggtgagaaaggccacaaagaggtcatcagtggttccctcaggcctttccctcaagagtcccaggcacctgggagcctgccctttaaaagcagctccgtagtcacaatataggtctacagtttgaggctgtgctgctggggaaacaggctcagtagaaggaaacctctgaactcctgagcaaaaaagccagggtttcccctagttcggagtctgtaatcaagtcaaactcattggcacagctttgagacagttctgtggcagcctccgagaggtgtcatgcagaggtctgattagagcgtttgcgtggtttgtagggaaacagggggggctgtgcctttctgtgctgagatctagcataaagaagctgtttcaagctcctggcttgccacgccggatcagaattccaaggaggccctgtgtgttttgcttcagatctgcacatttcttttcaaaatactactcggcagtggctgatgctggtggaggtctgacatgaaggcagccgcacatggatttgggttgcgtggtgctgctgtggtggggccatagggcagtggtgtgtggctttgttcctgcagggagccctcgttagccgagttagctggaaacagttctctggagtagagatgtggatgcagagccgtgagagttagtgaggcgatgtgtcaggggagttcactgcagtgctttgtgttaatgaggaggtgtaggctgccagggcacgagtggtctttggattggggctgggttgcagcaggaatgctgggttgttgaatgggtgataccaattcattcatttatcaattatttcttgagcatttattaaggaaaccttcaggggtttccttagttcctgtggtttgtttgttcagacatttgctagacaccaggaagacaacagtgaaccagatagccagggccctggctgtacctagcagtttggaagggtaggtcattggcctagaatcatacactttctggttactcagtttgcagctgatctgactcagctcctgaaaaaaaaaaaaaaaaagagtcctttctttcctgtcttgcagaatttgcctacatgagccctttctgagctccgagcattgtagcgacgtgcttttgtttctccttctaatttctcagtcattaagtgaattctccggcccaatgttctgaaatgtcaccagggtcacctgagtcaggaggagctggaagttcccatcaaat

SEQ ID NO: 71885 - DNA, 1033 bp, Homo sapiens
gtaggtctcaaaccggacatctgaggcgtgagatgaattcatatcaaagccgaccctggagggacgaggaagagccagtcatctaaaaagctccagctgtgggacctcgaagagcgcttcgtaaagggcttcttctctgcccggcaccccaaggaagctggggagaggtctttgctgtggatgaggcagggggcgaggaggaggaggttcagagaccttttgctcatgccctctctgcctgcgctgcctccgtcatgctcccctcggggccatctcctggtttccttcgggtcagagaaattgcacacagagcagaaggatctgatctgactgttggctcatctgcactgccggcccccgagcctcgtcccatttcagtgacaaggcaagtgtgaaaaatggagcatgatggaggcgtcaccagacctcccaggctctcgactggagccgcagctctcaatgcagctggaattgccaggggcagtgagtgcttgtccagctcactgctctttggaaggggcattcatctccctgagcgcttgtgtgtgcatgcatgtgtgtgtgtgtttgtgcgcgcgtgtgtgtgtgcatgcacgtttgtgtgtgtgtgtgtgcgcgcgcgcacacacacaaggctgggagctgtgcggcaggcaccctggcttcgggaacccaaactagccagcttccctttctgggcctgctggcctaattcccagccgcagctgccattctgggcccccctccctgaggccatctccctgcagatttggcagcggggaaaggaggggccgagagaaggggagagaaccagagacaggactgagcgctaatctgatgtagatgatccggcagccttctccagcttggttcccctctgccatcagctctccaggtgactttccctgtgccctgcactctccccttctgctttcatctccttaagaaagtgcccagaaagttaaacccacacacaaacacacacacaatccacccaaaaaaaaaaaaaatcggagagcaggagcaggcagac

SEQ ID NO: 71886 - DNA, 3427 bp, Homo sapiens
gtccctcagtcccccaggagcctccttcatggacccggggatcccaagaggggctgcctcaacttaggatgggcaactgtgtcaagtatccactgagaaatctctcaaggaaggtatgtttttggagtttccaagatctggggctggggattgggggtatctcaccatctgtctcagaggttgggcacagaaagggtggctggagcttgctatccttcccaggggttctgtccagggctgcctccctgcttctaccccaaacaccctcctattgccgttttctgtgtcccaggctttgggcatggcggtcggggtgaaactgtgtttgggaatttgcacaaggcttaggaaagaaactgtgtagctttggggtttctaggatgtaaaatgaaaagggtggatccttaagatgtcagtgaacttgactggcacctcagtcattcaagggactggccaagtcccttaaaaccggcagaatctgaagacccttcccagcagcaagggcagggactcgttcatatcctttgagggtctgtgagcctctctgatggcctctaagccttcagaattgtggattttgaagtagatcccattgctactgaaaggaaccaaacaacaataattcttccccaataattcttgagttaagtcagagtatctcaaataggacccgagtggttttagggcccaggagtttttccattaagaagtaggctgcccgggtgatgtgttgagcaggggttgcatgtaagtcactttctgtggtggctttatcgccatacacttggatttgtttttgtttttgcaaaaattccttttagaaagaacatgatcatctctaaagcatctttcatgcaaggctgggtttgcacctatagggttttgggttaggtgggctctgcgtatttttctagccctctgttgccaggccatagaagagactcaggtattatttaaaggaagagggaatgatggcgttgttttcctccaattcttccattttccagacaaggaacttgattgacattcagagggaggggttaagtgacttacctatggcctcgggtgagctattggcgtctgtatccccaaccccatcctatcttggtcagtttaccagcctctcaatttaggacactttgggcttttctgcctgtcgtcttcctcatttggctaagctgctcacatcaaattccttctaatctttgctgttccttagatccttccaagggcttgttgtttcttccatgcacgcctcccccataatctggtatcttcttaggggagtcttctgcatcggaagtgccctccgcgctgtcccagagaagcagaaagtgatctgaattagcccttgtaataggttccatccagagcttgaggaagtgaacttaagaacaaggattatccttctgtcccacccatcttcccttacacaacagcatgcttaagagtcagattacacaggcctcctctttctggccatgtgaccttagacagattacttaacctctctgttcctcgattcccttgtccatccatcaattgggcatactaatatccacctcttaaggtgattctgggaatgaaataaagtgctgtgcacagtgcctggcctatagtagtcaataaatgttagtattcttgtcatcataaccataattgttccactctgggttttagagaagcgggatggaggagaaacaggaaataggagagattttcagtccacagagtaaaagataaaaaaacttactgcagtcaatttcgtgtttctatcatagtattaataattgcttttttttttttctaaatatctgcaacatacctaatgtctgttatctcattttctcttttccgctacatagttcttttggctgttttatagagaaagaagctggactcagagatagagccttcctaaggttacacagtcgataggaagcagagctgggatttaaaccctggtctgtgtaaaatcagagctggcattttatttttattttttcctctacgagaggctgcctctctctttcccctgctgtcagaaatgttattcatagatttctggatctgaccttagaagtcgtctagtccaaattcccgctcagcgcatcagtcccctccccgctcaccaggcactccctcattcggcttctccttgaagacattcattcggcaagagggagctttgatgtgcatactcttggccagcttgtattattagaaagctgttaggtcatgaggcacacttgcccctcctgttgccatgccacacttaggagacgttgccttggtgccaggagaaattgtcggtccatgggttgctgcccacttggcttcctgagcggtatctggggaactggaaatggtgagaggcagcctgcaccaggctcagagctgggcaggaccaggctgtcaggtgccatcattggccagaaaagaattgcagcctctggggcaacttggtgttaggcagtattatgatcaagagatgcagtggaaattccccagctaccactctccattcttcatgggagcaaattcctctccatccttctcatttctttcctgattggcagatgctcccccacttcctctgcagccagaagtaaatgccttctggcacccagcatctcttaaattacatcactgccaccaccatcatcatcgccatcattgccatcactatggcaactctatttattcacctcctcttgccatgccctagccaccatgcagagcactttatgtgtataactcattacttgtcgcaggaatcctgtgactagtcatgagcatctcccacagtatggagaaggaagctggagcacagagaggtgaaatgacctgcccaaggtcacacagcaagcaagtggcagagccagaatttgtccctaagactgtttgagcccaaagccagcaggctaaactgccttttaaagttttgttttgttttgttttgttttttgtttttttgtggttttgagatggagtctcgctctgttacccaagctggagtgcagtggcgcatctcggctcactgaagcctctgcctcctgggttcagtgattttcctgcctcagcttcccaagtagctgggattatgggtgcccgccaccacacgcggctaatttttgtatttttagtacagacggggtttcgccatgttggcaggctggtcttgaactcccaacttcaggtcatccacccgcctcggcctcccaaagtgctgggatgacaggcatgagccaccacgcccggcccgcctcttggagttctgtgccacctgctacctccctgccttcctgggttatgctatctctgagccaagtgcagaagattcagccagaaacaaaaatgctgactctctgcagacatctcctgagactggttcctggggttcggccagtcactgttatctcaggca

SEQ ID NO: 71887 - DNA, 4968 bp, Homo sapiens
gaagccccccgctgcccctgtctcttcatgcacttgggtgtgtgattctgtgcatatgtatgtgccagtgcgtgcgtgcgtgtgtgtgtgtgtgtgtgtgcgcatgtgccacacagagggcatcacattcagctctccccggaaccaccatttccgtcaaggattggagactctgtctgttggaccaatttgatgcctgtgcacgctcagggctctctgaaccccgctccttgactctcagggtcccctcttgcggaaagcccctcccgggaccaggagccaggctgggcagggaggtgacaccctgcctctcttttgcatttgcttggtgctggctgaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgtacgtaagttggcccagtggagcccgctgaacttggcttcacagggcgtgaggaggtgctgggatgaagaaggggtctatacagagctcacacccccaacttatgaatctgatccccaaagttttccactcatggctacaaagtgctggtgagtccatatccacgagcaaaataatgatgatgataataataataataatatcagatacattgttttgagcacttactaggtgagcactgtgcctagtgtgttggcggattgcctcatttaagcctcagagcagctctaagaggtaggtgcttttatcatccccattttacagatgagaaaactgacttgggctgggcgcagcggctcacgcctgtaatcccagcactttgggaggccgaggtaggtggatcacttgaggtcaggagtttgagaccaccctggccaacatggtgaaaccccatctctactaaaatacaaaaattagctaggcatggtggcgggtgcctgtaatcccagctactcaagaggctgaggcaggagaatcgcttgaacccaggaggcagaggttgcagtgagccaaggtcgcgccatggcactccagcctgggtgacagagtaagactccaactcaaaaaagaaagaaagaaagaaaactggagtgcagaggtcacatgctcgaggtaacagcttgttggtggtagaggtaggattcacacttggatagcctgactcaagagcctcttgtgctcctaatgacaactctgtatacgtggcactgtccggtagaactttctacagtgatggaaatattctaaattccgtgctgtccgatacagtagccactagccacatgtggctattgaccacttgaaatgtggctagtgcaactaaggaactgaattatggattttatgttattcttactcaaatttacatagccacatgtggctagcggctagtgaattggccagctttctacaagtagctaaatagttcaaagagaggagaggactaatgaggatgttatagaggtaaacatttgtaggttgcatttattgaatgccacatgctaaacactttaatatcttgtctcactgaatgcacactaaggccctgtgaggtgggtactggtattaacccattttacagatgaggagactgtggctcaaacagcagagtgacctgcctgaggaagtagatctgagcttcatactcaggtctgtctgcctctagagtccaagtgcgtctccccagccacatgtactggggagaaaggcgtgttcctgcaccccattccacctgaccctgagttgctgcacgtgatcttcctggcacattagtgggcatccctggctctactccagggcagagaacacacatagctactgctgtgcatggggtgtgtgatccaaggaccagccatcagtgctcagcagaccagctctggtggcgggcacactccgtgaaggggcacctggctttgctgcccccggggctttgggtgtacaggaggaacggaaggggctgccatggggtcagcaatgcctgttcctcccgagtcctgcagaactgggccttggagaagtgggaggctgcttaaggcctgatgcgtgggaaaggatttattgggtctcagtagctggtcctagggcgtgtgctctgcatgtatgtgtacacacgtgtgcttactcactcgctttcacagactgctggtatgacccattgcacaaaacatcctttttggtcacccaaaaacatctacgaacatatgggtttgtgttggaatggctgtgacctacccttaagccaggcaccatcaccagctttttttttttttttttttttttgagacagagtctcactctcttgtccaggtggaagtgcagtggtgcaatcttggatcactgcaatctctgcctcccaggctcaagtgattctcctgcctcagcctcccgagtagctgggactacaggcgtgaaccaccatgcttggctaactaaaacaaggttttttggtagagacgaggtctcactatatcgcccaggctggtctcgaactcctggcttcaagtgatcccctcgccttggcctcgtaaagtgctaggattacaggcgtggaccaccgtgcctggcccatagcgagctttttaggtgaacgtccatgcagtcatctcagagacacgcctccctatgggtgactcctacccccagcctggcggagctgggagcttgcagcctgctccctccaagctcacacacactctcaacgctgtcctgccacacagagctacctctgagctcttggtcctatgcacctggttgtcccatgagatgtgactcagcagcccttccctttctagatgatctgcagattttctggtgttgtcgtcttttgtcctggggccagtttggagtggctgtctctactcatcctggccccgttggctggaacggcctgcatgcacagtggaggtgccacacgctcactgtggcatgcctgcgtgtctgtgttcgtgggaggtatggccatacctgtgtgagcctcttcaggacgggcacacctgcctggtgtcctccctgcccaaaggcaaagagctgcaacatgcgggaggctggacgctgaaggccacttttggagtctactaaccaggtccagctgggcacctgtatccatttcatgccagtctatctccctcctgggcaggcccagggcaactggcagctcaccaacctgagcttcctccaggcctgctccttggagatgtctctgccatctgttctgacgcctagattcagggttgccttgattgcccaggagacctgggcactgcttgaggctggagacatgtgctttttggaccctggctccagccagaagcactggtggcccccggggtcctatgtggtgtcctgtgatcccatgacaggggaacgtacagggatgggggtcaaattggagaaggtggggcagtgcccgcgaagcagtcacagccccattctgttgccacgtctcctcctgactcctccctgtcctcctaccctcgcttcaggatggccctgccttccctcccctcctgcgcctcttctgttgtcttgcagcctctgtcgccctgctcttcctgtttcattgggtggtgctctcttttccctgttgtgacctccctggactctgttttatttgcaggtttttgccaccaggcaagctctgttctctgactcattctttttttgttttttttttttgagacagggtctcactctgttgtccagggtgacagagtgcaatggcaccatcatagctcactacagcctcaaactcctgctgacccattcttgtatctggaacaaggggctggaggcacagaggttctgtgcccaggctggtggggctggtggcttcttgggcatctcctgttaggggcccaggagcttctatgtctaagggagatgtggggctttcttctcccctcaaggacctgatccaggcacacctgtgctgcatcctcgtcacctcctacccagtgcctgctgccacgtggatggcccccaggttaggtattttgtgacttccaggtcccttgtcgcggctaataggacatgttcttttgtttcaggatagatcactgcgaccagaggaaattgaaggtaaaacttggccccttgggggaaaggactgcctagccctctaggaaggtgtgggaagggaggttgatgggaagagaggcccctggaaatggggcctggtgcaacgcggggtatcttctgtgaaaccagctgctgaaggtgtgcacaggaggcaagagaaatgccccagcatcctgggaagctcctgggcctctctttccatgccggtgggcctttgggctgcctttgcccacagaggctctgcgggtcctacccctgaccacatccacctttgctcacttccccagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaaccgtgagtccctctaccaggcatctgcgtcccttcggtcctcacccttgccgtcctctgcagtcagacaggactggcttcaaattctgcatccacctcttaccagctctgtgatctggggccaaccacttaccctctctgagcctcagtttcctcacctgtaaaatgagggccgaattggaggagtggagcccagaaagtagattagggaatatctgtaaaacagcccaataactggctcacaggaagaactgaacagagggctcttgttattattaagtttgtctctatctgatgagcaggtcaaggaggggttgtccattctgtcagttgtctagttggagacagggaatgggtatgtcggggatgacctagccctttcc

SEQ ID NO: 71888 - DNA, 1816 bp, Homo sapiens
ctcctgacctcaagtgatccacccgcctcggcctcccaaagtgctgggattacaggcgtgagccactgtgcctggccaccaggagggcttttatcctgttctttttttttttttttttgagacaaagtctcgctcttgtactccaggctggagtgcaatggcacgatctcagctcactgcaacctctgcctcctggattcaagcgattctcctgcctcagcctcccgaatagctgggattacaggcgcctaccaccacgtccagctagtttttgtattttcagtagagatggggtttcactatgttggccaggctggtctggaactcctgaactcaggtgatccacccgccttggcctcccaaagtgctgggattataggtgtgagccactgcatctggcctatcctgttttttacttgggctaagttctgttagcccaagggacattcttcatgactcgacagtgggactccttcttctagcacccttccctggttcctcaaactgaacttcctcttttctgggttttcacagcacgtcaggctcacctgttcttcacactgtcccctaactgctggttagagttgtcttcccagttgactctgaactttgaaagaagaaccctattttcttaatcactgcatttcttgcataacacagctagtgctcagtgaaaggttatttatttatttatttatttatttattttaagacagggtcttgctctgtcgcccaggctggagtgcagtggcgtaatctcggctcactgcaacctccgcctcccgggttcaagtgattcttgtggctcagcctcccgagtagctgggactataggggtgcaccaccatgcctggctaattttttgtatttttagtagagacagggtttcaccatgttggccaggctggtctcgaactcctggcctcaagtgatccacccgccttagcctcccaaagtgctgggattacagtcgtgagccaccgcgcccagcctcaaagactttctttttaaagaatcaatagtaatcataatagttataatttactgtacacttatgtgcagtcattgtactaagtagctttacacatattcttacatttaattctcagaatgactctatggattgcattattataacctcatgttacagatgaggaaactgaggctcagagaagtaatataactagctcaagattgcctgcctactaagaggcagagctggggcacagccccaggcctgaaatcacagcagaatgcagtcttgtgcatgacgccatgtgaggcactacgggatacagggaaagggtaaaatgttgactctgcacaccaggaacttgcattctgagcagaaagacaagataagcatgtgccagagaccgtgagtgtccagaacacaaaggctgggaggttttctctcaggagcagttggccttcaaggccagggagcgtggatagttggagagaaggctttgttatcaccagatctggaaatctcaggtctccctgtatccaggtagcgcccaccacagatgacagccttgctcttgaaagcctggcatcccccattcatcctacgaggatgcattgtacatctgctgtgtgctaagatctggtctctgcctcgaagagctcaaaaccagcaagaaaaccagagaaaacaatagcataatccatgtgtgctgggggaagcacagggggctgctatagagggggcgcctgtgccaagttgcagggagggattagggaagacttcctggaggaggttataaataattagagccccccaaaatgggaagagccaccaggtgagagggaa

SEQ ID NO: 71889 - DNA, 1068 bp, Homo sapiens
ttagcagcggtaacagcagccaaagccagactttatagcaggaggtcattactatctctatcctggacccttcctctttcttcacgagtgtgggcagggaggaaagagcccttgaggaaactagacagtttgtggactttgcctcttgagatagcggtggtgagggtgctgagcggatggtttctttcacttagcagataccaggccttacattggttacatcgtcctattcagtctgttgtgcagagaataaagccgagtaagaccacacaggtttagttcccagatactgcccttattcagaaattctggttttaatttgctgatgcaggtggtgtgtgtgtgtgtgtgtgtgtgtgtgtgtttctttggcttggtcagcagtcagccaagatctgtgtccttgggttattggctcatggttgcagttccttggaaggagtttattgtagcaggtaaaattacatgagacctaccaaagcttgtgtgtactggagtcctatttcggacactggcccttggggcattgtataaatgaaggttccctgctaaggttcccctctccattctaccaatctgggtaagaattggagcagtattaaggcatggatggggagtgggaggtggcgcttgtcagctgcagtttggaccagcttgttgcaacattgcgcttaccaggttcctgagaaaggcattttgctggctttaggtcgggctgagatgcgcataagcttgcactctcaggaggcagctctctactaaggagtcagtcctaccaagggaagtccagctgttcacactgcctttcttctgggcctgtttggataagggtgtgccaggtatttgaagacccttgcctcgtgcagctatttacactgattgcagtaggaactgtatgccttatttcttttcccgcctgcctgtgatattgtttccagcatgctgagaaaagttgattttatgttgaatgaattcaggtatttgttaccaagttagtccagataagggtttggccttcttttgaacttgctgtttctgtgtagtttctttgtagttcaacattcttgt

SEQ ID NO: 71890 - DNA, 1033 bp, Homo sapiens
ggtttttatttatttattgaaaatttttaattttttttttattgtagacacaggggtctcactatgttgcccaggctggtcttgaacttctgtcctcaagtgatcttcccaccttggcctcccaaactgctgggattacaggcatgaaccatcacgcctgaccatgttccagatttgtaacttggtcattttgagttcctcttcactctgactaggaaaagacctggttatttgacctgagggcacagaattttgcttgagtttagggaaggctatttcctcttcagagaaagatacctgctaaagtcgcaggtcctcgagaaacttgctttacgtctctgagccttgttttccttttcaaaaaatctctcatgctttagaaatttctgataagactgtaaactctcctgtccagagtagcttgaagtgtctctgtcactttttttttccttgatgaccttttacatggaattaaaaatagggcagaacatagctccagaggggaaaaaagttggttggggaccagagcctatcaggttgctaatgctgtaaccttaaggaataccctttcctgggctgccttcctttcacctggggaaggatttggctttggggaggtaagagcttgaaacatgggatgagagaggagtcactgctacctctgatttgctcaaagccatggcagttgtttagaattctctacctctactgtcacctaacaggcaggcttcatctgcaggccttccaaatagtggaagttcacaggtagaaaatttaggtccctgaatccgtgggttcgctgtctcagcccattcagaacaattctttaggtactggcctcactggagaaagaagtgatccagaagaacagtctagtgaccaggagatctgagggtagggtgggagtgacgctagagcaccaaggggggctttacagctgtgttctcatggaggacaggcttctgctcattctggctttcccactcttgtggttcccagttgcagttttccagttagttttattacttccttt

SEQ ID NO: 71891 - DNA, 1288 bp, Homo sapiens
aggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaaaaaaacacacaacaactaaagctggaattttattcgtaaggacaatgaagaatgactttccaaagcagatatcctgtttgttttagactctgggcttttctgaatgagagaaaacattctttgaacttcatcttgtatggagttcctggccatcccccttgttttaggaggtttctctgaagccctccctcttggggaaccaggcagctgcaacacagcactttcttctggtaatgagttagacttgttctccgtacagtcagggggaaaaagtcattttaatgtgcttttagaaagttccgctctgaggtttacaggggctgttggcctgattagtgtttagtttctttcattttactcttccatagtaatggctgtatgattcctgcctttgttggagctctgtttggagccaggtgcagagtgggtggccccttttatggagagggttattagcattgccctggaaatgcctctggctgttctggggtctttgcttttcttttgtgtcttgcctctgatgtgctttctctttgtcttttgtcctcagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtgaggcctagtcaggctgctgcttgaccagtaggacattgctgctcttggacaatccacgattatggggctagagagtgtgagagtctctccagaaaggcagaacagatgagctctagagaagcatgttccatagtgcacaaggctgcacttgccttgggggtgagtgacagaaagcaatgccagaatccttgttttgccaactaactgatcctgttaaggccctcctggctacttccctccatggtttgccgcaccttcttgtttttagccttatttttcctctgtcccttcctgtgaatttccttcttcctatgctaagctttttgtttgtattctttgttccttaaagccaatataagaactcctgggcagtgaaggaac

SEQ ID NO: 71892 - DNA, 7521 bp, Homo sapiens
ttgaacttcaagcccaaacacgtgcatgatgtccaactgcttgaaaggatgtaaagctgatggttttgacattgttttcttttcttatcctggaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggtaattcccctattctgcccattgctgaagagagtgggtacaggggaagttgtttgctgctgtgtggggttgaccactgtttcccttttcctaggggtactatgacaatcccaaggtctgtgcactctacatcatggctgggacagtggatggtaggttgtgttctgacctgcttttttgacttgagtggagggatatggttgaggaagcccttgggaggtaattgagctgatgactattttggaaacacttaaagctaaattgtaggggattcagaatcagttggataaggatgaagcataacatggtactagccacaagctttggagtcaggtctatgtatatcttgttgctgccatttaatcagatgtttgtcttggatggatgcttttaatttccctataaattgggattaataatggtacctattggtgtaccctgacctttgtagtcatttgggatcacctaaaacttgtccttattctgtttgtttgacatctctttcctaggggaaaaaaaggtaaaaggaggagtcctgtaggcttttggtatgctctgaaagattccagcattgctggactgcactgggacaaaacttcacttatttatgtctccttatccttgggatcaagtcttagagtatatttctttctcagggtttagattctcctggctgccagcatctcaggctgatttttgcagagaaagctgcgtctttgtgacatttctcccccattccacctctgtacctttccccaactcaatcttgaatgcactgaggatttcatcctgttgtcttgatgtcccccaaatgctgatattatgacatctaggaggatgaatgtcttaccaccaaacagacctgtgttcaagtccctgaggaggaggcaggacagagggatagtgtgtgctgggaacccagaactctctgggtcaacgtttcttcagttgttgtgtgaatcaaaagggaatgtgggcttgtgggaggaggagggatttgaaaaggctaaagtttaggcattggatcattgtccctgtccagtctggttatcttggggctctgtaaaagtagaacaggaaggtaagatagtgaacctccctatgagcacggctttttctactttctagttaaatctaaagcttttgcagcactctgctgttctgtagaccagaggctatttctgctacttctggtcttttctctggacccgggttcaatcacagcaatctctttattgtggcttatttgctgcttttaagggtctctcttacttaaatgctgtgggtcttaacagtgttttcttccttgtgttagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacacggaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctgtgttgggactgagttcgaacttgatctcaaagcgctgaagtgatggggtgggaaaaaggagacccaggggttcacttggctccaaagagttctcctgtgacgaggctgggaactgttgtccatttagctgtgtgtcttttgcttttcttctctctgggatgtttgcttaggggaatcattctgtaaaacccttcctggtcatttcaactagcagcgcatttaaggacaaaaaatttgttttcactttcactggaacaactaggcacagactgtcccactcttaaggcacactgggcctattgctgcctctcctcaccattcccttagcctctgtgatagcccacggacaagctaagctaacctaagccataggagatttttctc

SEQ ID NO: 71893 - DNA, 1002 bp, Homo sapiens
gatgttccttcctttcgttcacaaccagagaggaaagcgcccatccctaaccctgagctcaggggaaaagggtgggcttggaaacagaggcagaagcaaagctgcttggcttacagtaccattaggaaatggccccaggagtcagggtttccttctgagactctgagtcactgaagggatgtgttgaggtggaaggcgggaccccctccttcctcagacagacccaggcaaactaacaaacaaggcaaaatggaggcagccagtcctcctccttcatcttgactaacccaatggcagtggcccagggctttggggaatttcgatgggataggaaccaaagctactgccagaagcctgtttagttaggatgtccactgccccaggcaggtggtccccaggaccaaggctacagtaccttatcctttagaagcaggggagctgtgtgaagcactatgggaagtatacctctgactgcagcctcgggccacaaccctccagctgcctgactcaataccctagcactgagacccaagtcacagcgaaaacaacaggctacaattctcaaacgactaaatgctggcctggagtaatcattaaagagccaaaacccaggacatgagcccaagagctacctattttgtcacataaggagcagttcaaatatacagagctcttaaaaaacatatctaataaagcaaactcaaaattaaacacattctagaaaagcgggcctggcctgagatcctatattgactgctccagcccaagctgaagctaatcctgctgtctcccatccacaaaattccttctagcttggctgggtcctccttcattgttgccctaactgggaaatggatgacaatggccagaaaggaggggaccagggaagcttcatttcctatagaaattttttcagggaattcaagatcgacacttagatgctaaggttagcttcagagctgccaaggctctggctgactggaattctttcagtcccatcac

SEQ ID NO: 71894 - DNA, 1332 bp, Homo sapiens
atcccaaggctgtaggtcaatgtcttctatttaaataacaaaattatttttagtggtttatctttgcagcctgtcagaaatttttatattcattgaaataactttctgataagtgtcaacttttgtagcctcattcttttaggttggtgctagcgcttcaacttggttaactgcagacctagtctgaatagaatagaccatgtcagaggcccagttcccagcttgtgtttcaggtttcacccttaggatatggcataagctctcaaactattaaaaaaggctaatagcttagtgttgaagaacaggccttgagtcagatggacctggattcaaatccctgttccctcctcttactgtttgagggactttggacatgttacctgacttctctgaacttgagcttcctgatctgtaaaatagagacagtaacacctcgaagggttgttgtaaggagtctggactatggcaagtgtcctgctatatagcaagtgcgcagtaaacactggccattcttcttgttggtgtggttactgggattggttgccattgtgctgttgggactggtgatagaactcttggattgagaatgtcgagatggtgcactgaagattctgtgtgctctttcagaccaggaggaggatgaggaggagggaggtggagacgtggacatcagcgcaggacgttttgtccgctatcagttcacaccggcatttctccgcctccggacagtcggggctacgtgagtaccattactacctgaggggagaacattctgtttgttcacagagaagagtgttttcggttgggttttgggttggctttagaggagggaggaggcaaagtcgggcttacagagatttattttccagggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcagtatgtatcccctgacccttacagcactctagattctgagggctacaaggaacaaaccttgaaacccatctggtccagcgccctggcattgtctcgtggcagtgctgacatgatgcgtatctagtcatttgacctcaggcttctcatttcctattgctcctggctcctgttctaaactctgactcggcccgtatgggagcaatgaagggtttgtttgtttttgtttttgtttttttcccctgagacagagtcttgctctgtctgttgcccaggctggagtgcagcagcgc

SEQ ID NO: 71895 - DNA, 1048 bp, Homo sapiens
tctttctttcgcactccgaggagcggaatactattcgcctccacttgttatagaaacggaggctcactgacgtttaaaacccttgcctaaggtcacagagctgaggtcttattactgttggtattatactgaggactgaaggatgtagtgtatggaaatgtctagtgagtgtactaagcattcagttagtatggggttttcagtggccgccatggacattttgggctgacagttctttgttgtgggggctgtcctctgccttgttggatgttcagcagggatcccggacccctatccactgggtaccaatagtattcccctgctctagttgtgacaactagaactggctccagacattgccagatgtcccttggagggcaaaatcctccctggtgagttagtgggtcactaggattcttggagacctcctgcctcctccttccactcacttctgcccttgccggcagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgagagtgcaacctcagcagcccacgatagtggtctgccctctgctactggatgaatggtggcagtgacagtcagcggcactcggactctggtagaggaaccccaaagcagggcctggaacccagaaaatgctctggaagtttcccttgtccagcctgtggccagtagccaggacttaacttctgggacaacagtaatatgtggtggatggtcagttgcttactgtgccagccactgtgctcattctaaatagtgcctttagggtgtttggcatgcactaggcactgttcttgagatgggttatctcatctgttcctcacaacggtcctgtgaggtgaaggtactattcttatttatttttttgagacggagtttcactcttgtggctcaggctggagtgcaatggtgcgacctcg

SEQ ID NO: 71896 - DNA, 1049 bp, Homo sapiens
agtctcaccctgtcgcccagacttgagtgcagtggcgcaatctctgctcactgcaacctccgccttccaggttcaagcgattcttctgcctcagcctcccaaatagctgggattacaggcgcctgccaccatgcccagctaatttttgtgtttttagtagagacggggtttcaccatgttggccaggctggtctcgagctcccaaccttgtgatccacctgcctcggcctcccaaagtgctgggattacaggcatgaaggataacgttatttctacccatcactggcacttgcccttaatccgagtcattttggagcccccctctctgtctctgggcctgcttaattagctatatgcatcctcgagggctgagaaggaaggaagggagagtccgcaagtggatttttagtcttcacccaatgcagaggcagttttgagttctgtggacagcagaagcttcagttctttgatgtatctatgactgggccagagctgcagatgaccaggtctggggacagacagagtcttcccatcagtcttccagaacagggaggagatggctgggagctctgtttggtaccaacaaccaaagtgaagattatgtgacaaaggctacaaaggagtcatttattaaaaacaaaaccccagaaacccctcagcaggaattgatgacaacaacagaggaatccaacaccctgactgcttcagactctgttgacaacaggatgggtgccccctgtgagctcgatccacagtgacttcaagccacagtgacacagcacactaattcattacacaggtcaagacagaggcagccactggggcggggacccttggggagaggctggaactcagggcccttctccagcctttgttgtcaggcatcctcatgccaaccgcaggcttctctttgcctctgaacaatgggcaccttcttaccaggcaggggctgcttaggtaaaggtcagcagacctaacactagttactcccagaaatctgggcttgcagcagagaccacagcacagggccaggctctcaggacacagca

SEQ ID NO: 71897 - DNA, 2282 bp, Homo sapiens
gctcacgcctgtaacccccgcaccttgggaggctgaggcaggcgggttaagagttcaggaccagcctggccaatatggtgaaaccctgtctctactaaaaacacaaaaatgaactgggcatggtggtgagtgcctgtaatcccagctactcaggaagctgaggcaagagaatcgcttgaacccaggagtcggaggttgcagtgagctgagatctcgccactgcactcactccagcctaggtgacagagtgagaacccatctcaaaaaaaaaaaatatcagaaaggggccaagcgcagcagctcatgcctgtaatcctagcactttggaaggtcgaggcaggagaattgcccgagcccaggagtttgagaccagcctggccaatatataggaagacttcatacctggaaaaaaaattttttttttttaaagaatcagacagctgtgtgtgcctcatgtttaaatctgtaacttagaaagtcccttgtttcccagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctataggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaatt

SEQ ID NO: 71898 - DNA, 1052 bp, Homo sapiens
cagcgagactccatctccaaaaagaaaaacaaaattctaggaagatattgaacagtggtaatctctgaaaagtgggaatgtaatttttttattttgctttactgtattctctagttttctataacgcagttaatgaattgctgggatgatgcctccagtgaatgaaagggggtgctatctagggtgtgagttcactttaaagcagggagcaaggacaacacatccacaacattggagggaaggcaggaaaagagagcttggaggtcttggactggtttcctgggtctccaacagccgagcactatgtctaggaggaggaaagcaatcaccccaaattccacaagtccaaacaggctgaagaagcgggtgttttgcaccagttgcatgtaagtttctgaagctggagcttagggctgcctgatttttgagggaattgcaaactctgtgaagggccatagcttgtggaaagaggatgagcctggagtccacactgactgctgtctgctgtaccctgtctcctccccagcactggccatgggcctctgtgtcgccatgatcgcctttgtccgcctgccgagcctcaaggtctcctgcctgcttctctcagggcttctcatctatgatgtcttttgggtaagcgtttatgtccttggagctcctccccttctttgtgttgaagtgaagcattcatgcctgaaaactattaactagaagtatccaaagtcgggcttgcccagctgctgatcactctctctccagtccttaactgtatcatgggtgtgcagtccgatccttttgtttgctgaaaagtcgtacagtaggtagtgtgtgtgtgtgactcctaggatagaagaggtaacaggctgacaagattcgctgcagtgggggccaccccgtcagggagtaatctctgggtgtggagagtgcagaaattggcaagtacacaggaagagcaaagattttctcaaatcatacagtcaacgaaagcattgcagtcacagcattctgagactctgctcttaagagcaaggagggctgatgctgaaagcagg

SEQ ID NO: 71899 - DNA, 1927 bp, Homo sapiens
atggatagctaatcaaagtgattggactgtcagctctttgatgtgttttcaagctaagtattgatggaaatgtaaaaaaaaatcggcaaaatgctacaagacttgttaggaggtcatcccctggcctgctgtttatcttttaggaaacttacctatgctttcccctacttcaaatcaggtacttttttttaataatgaagagattttttgtgcagtattaaaggaagacatttttcttctctagtcaattaaccgtatccacttgtctagtgtttggcggaatgaagtttctataagtcatgccatttttcttataattgttttaaaaaattataccttttctttctctagttcttgcaacgatagcttttgcttttcttctcctcccgatgtgccagtatttaacaagaccctgctcacctcagaacaagtaaggacttgggactttcctcttaaattataaacttgtatatatttttctgtcatatttgatagcattattaggattctcaatttctgttattggctggagcacagaaatgccaaaagaccaggaagtgacacatttgatctttaaagccagaagctagtacttccttttgtaccttctcatgtcagaggaaatacaaacaaaacttaggaagtctgagtcattgtaatgtgcttcctacttagatcattgaaagatgagcagttttcttttgaaacggtgctttcattcctttactgtgagttgatgaaatatgagaatagtggttgaactcaaacgttcttctttgcctttggtcttcggtggcctagatatgctacctacttgcgtttaatcctagtgttcacaccttaactctgaaagtcattgctgcacggaaacaaaattctgtgctaatggagatgctgaacgcacttaggaaaccagtcattggtggcagctgatgctcgcaggaattagtgataaccaaaagatttacaatcttctaaatagagtgataccatctttggtaaatgagttgaattgttggcatttcttcattttgttttcctcataagaatagaatttcctccatacttattagcttttccagaggttaatattatcacttcaaacttctaaatgcccatgttgataattggtcccaaaaagacattatcagttggtgcagaagtatattcctgtgagctttccataggtttctccaaaaaaggattgggtattttggatttccagctatcttggtattatctgctattctaatccagccatcacgaaataccaaaggagaatttggttactgaataaagtgtgcccactgtccaataagtgttgtgtgttttccaggatttcctttggttgctgtggacgtttcactgctgctgagttgctgtcattctctctgtctgtcatgctcgtcctcatctgggttctcactggccattggcttctcatggatggtgagtgactaatttgtgacaaattgtaattttactttatagagttttatagatactttaggatattcacagagctgtacaaccatcactacaataaacttttagagcattttcacacccacccccgccaaaacaaatgagcggtcattccccttacccacctccccagccccaggtatccactagtctctactttctgtttctatggatttctccattctggacattttccataaatggaatcatacattatgtggccttttgtgtctgacttgtttcacttagcatgttttcaaggttcatctgtgttgtaacctgtatcagcacttcctttttatggctgaatactgttccattgtatggatacactaattttatttattcgtttaccggttgtttccactttttaggctattatgaatgatgcttctttgaatattaatgtacaagtttttgtgcagactatgcttttttatat

SEQ ID NO: 71900 - DNA, 1031 bp, Homo sapiens
cctagaacagttccagatatagaagacactcaaattttttttgttgttgaatcacagctgacagggtatagggaaatgagtgctctcatacactgctgagagagtgaactgatgcagcctttttgcgaacagttgtgtggtatgtaaaagtctcaaaatgtgcttgccctttgacatttctccttctaggcttttatcataaggaagtaattaaggatatgatatgctcagagataggagtggaagattcagctgcattgggatgctttcatctgcagtcaggaaaactcttgaactgacacattggaaggactgaagattgttttttaaaatgttacaagagctatttttcagagttgttcaaaagagaccttctttcctaattccttggcatttaaaaatattgtcatatgacttttctgaccttcttttgtaagcaaaactacaacttaactacaaaatttttttccacaggtcccttaatatggactttgaaaatcaagataaggagaaagacagtaatagttcttctgggtctttcaatggcaacagcaccaataatagtaagatattttatgtcaattaacttctgtacatatagttttcttaatttggctgtttctatacctccagttaataatttactgggttcaaggatttatgattggtataaaaaaacattgaattatacttaaaatgagtgaattttacggtatgtaattgtacctcaataacgttaataaaaatgtttgatgcttatagaaagatttgaatttgaagtgacttgatttgataatattaatacatttatattgagatctgccatgtactcaacattctgttagatcttttgaaagatgcaaaagtacaagagaaatttttgccaagatgttctttaaaaagtgccaagatatccaggcgcagtgtctcccacctgtaattccagcactttgggaggccaaggtaggcagatcacttgaggttgggagttcaagatcagcttgaccaacatggagaaaccctatctacta

SEQ ID NO: 71901 - DNA, 1035 bp, Homo sapiens
ataatatgctataatttagatggattttttttctgtgatggtaaatggttgtctgtgatgaaaaagccatagctcaagtccttctgttgatcatttaaacattgatttctttttcttgttttgttttttgtttttttgttttgagactgagtttcattcttttgcccagggtggagtgaagtggtgtgatctcagttcactgcaacctccacctcccgggttcaagcagttttcttacctcagccccctgagtagctgggattacaggtgtgcgccaccaggcccagctagcttttgtatttttagtagagacggggtttcaccatgttgtccaggctggtctcgaacttctaacctcaggtgatccaccagcctcagcctcctgaagtgctaggattacaagcatgaaccaccgcacctgacctaaacattgatttcagtacctagacttgcaaatagccaggatacaatttggatggaatgtatatttataacgttatattaacatcatattatgttactgtatagcaataacaagattgtgaaggcaggtcaagatggaagagaatgaagagtagtcttctgtgaagatgcagcgaactgttctaggtccaacctagcaatctgatgtctatgcacttaataaattaccaaataagctaagttaaaggcctataattgaaaatagtcctggatagctttggaggcagagtcttttgcaaaggctttatttaaacagcttaagtttgctgtcagctgtgcagtgtgagtaactttaccggaccccagtcatagtggcatgggatctgctaagcccaggccctttaagcttgttgtataaagctggaagatatgaatcttcccagcttgagctaataggtaaggccctactaactcactgtgccccatttctgttttgtgcagcggtgacccatggtctgcttctaacaaccaaacaaggcttgattttagctaagcttgtttgaggcagtgagaagttcaaagtcttctaattacacagagaactagaagaat

SEQ ID NO: 71902 - DNA, 1973 bp, Homo sapiens
ggttttttttggtgtttttttttttgagacggagtctcactctgttgcccaggctggagtgcagtagcatgatgtcagctcactgcaagctccacctcctgggtccacgccattcttctgtctcggcctcctgaatagctgggactacaggcgcccgccaccacgcctggctaattttttgtatttttagtagagatggggtttcaccgtgttagccaggatggtctctatctcctgaccttgtgatccaccggccttggcctgccaaagtgctgggattacaggcgtgagccactgcgcccagccaaaagtgttaatcactgagatgtctactgagaactccagattcataaccactctcagaagcattaatcaaaccagaggaacttagaaccttatcagtgtaatcttgatattttgcatctctaccctgtggacaagtattttatttttttccctttgagtatataatgcattaatatttcaaaggactttgcaattaaacacagaagaagccatctttagactcaaccctaatactactttcagtagtgcagactaccttccatttggcatatgtttgtatactgtatacattttcatagttgaaatcatttatattctgattctttgcaccagacaaatactttctacaaattatcttcatatcattttagtaatttgacatttcgttgtgttactcatcttattccactcttgttggacaagtggactgttacagtgatgatagctttatggagtatttgcttttattgaattatatcaccaagataaatatccagaagtggaaatacttcgacagagagtatgaaatggctcttactacatattactgtattgtttttctgaagggctatatcattttaggattgagcaagttttaaaccaaattttatgtaataagtgtatcatagaattatatagatggaaaggatttctctggtgaacctccctgtttacaaatgaggaaactggccaggcatggtccctctcacctgtaatcccagcactttgggaggctgaagcaggcagatgccctgagcccaggagttcaagaccaggctggacaacatggtgaaaccccatctaccaaatatgcaaaaattagctgggcatggcggcgctacctgggaggctgggaggaatgtttgagcccaggaggcggaggttgcagtgagcagtgatcataccattgcactccagcctgggtatcagagtgagaccctggttcaagaaaacaaaaaacaaaaaaaaaaaaaaaagaaaagaaactaagaaactgaagcccaaaatgaaaatgttgatgtaacttgacaaagattatgcaaccacttggtaacaaagtctggattgaaacagttttcaggacctccagctcagaaccttttatcttttataatttaataaggcatttctgcaaaaagtaaatcatgatgcctttaattatacatttaaattgaactcactgaataagttggtgttttttcctcttctgttttatggaagagatttatgtaattttgtctttaaatgtttgataggattcaccagtgaagccacctacagttgggcttctctttgtgggaagatatttttggtttttgtttttttcctgctgagtttaccacctttcccttgttctttttctttctctttttttctttttttttttttgagtcggagtttcgctcttgttgcccaggctggagtgcagtggcgcaatctctgctcaccacaacctccgcctcccaggctcaagcgattctcctgcctcagcctcccgagtagttgggattacaggcatatgccaccatgcccggctgatttttgtatttttagtagagatggtgtttctgcatgttggtcaggctggtctcgaactcctgacctcgtgatctgcccgcctcggcctcccaaagtgctgggattacaggcatgagccaccgagccca

SEQ ID NO: 71903 - DNA, 1504 bp, Homo sapiens
gctgaatggaaattaaacaacaacaacaacaaaaagcctgctaagatttgttttaggaaaatccctgacaaataagaatgggcaatgtggagggtgaactcatggagacagcctttaaaacaatatttccaatagccgagccatagaagggagctaacaaattggcagtgggattaggagaaatagggtagttcgggatgtggaagtaagagaaagaaagggctgtcaagaatgcagcagatttttagctttggcagctgaggggatggtgacaccattccttgagaggatcagctaagatggagagagtatttgtggtggacttgttgactttgaagaacctcctgtaggccatctagatggagaaaatcaataggcagttagaaaaatggaaacggggaattcaggagatgcaggctttacctcatcaccgagcaaaaccagtaaaatactattagagattgaaatgtaactggataaaagtctgattattgagacttttgccattggcacagatctggtagatattttgatactttttaaattgggggtggatgttgtaaacatatacagagatgggatttttacattgatgtcattttacatgccgtaaatatttactaataatagctgtaaacctaccaatttattcttcatgttaaactagcaaatctcattttaattgtgttattttgttaatgctaatttataccttttttccttcttaaagataaaaacaaagctcagtggggtttatagaactccattagactgtaagctccattaggactcactgcatgtgatttaaatttttttcctcttatttctctagggcctattccctggtggattccagtcaagtgtctacatttctgatttccattcttcttatagtctatggtagtttcaggtaagatattctcaaatggggttgatacaagttggaggtggaagaaggaagcattgctctgaaagtgctggtaccaaaacttactctgtgaagaaaaacaggacttcggcaggatttgactcagaatagagagttctgctatttgttctttaattggctgctgttaaacacttcttcattgtgcttatgagtttagcatgttaatgcttacatgtaaaaactaattgcttaaaatgctggttctgaaattaatcacctaatgcactctttattaagaaggttaaggagagagtctttgacaatgattctagagtctcaaagggaacaaagagtttaaatggaaggacaatttgaaatatgaaaaaaaaactactaaatatccatgtaataaaatgacaaagagaacatttcattttttttttctaaccaaaaatgaaagtgtagtcacaaaactttagtaggcttacgaagaccagggaaaccaaagtaaaactgtacccaggatgctaataaagttcttaatctttggccgggcacagtgccatatgcctataatcccagcactttgggaggctgagacaggaggattgcttg

SEQ ID NO: 71904 - DNA, 1071 bp, Homo sapiens
agttttatgagcacatatcctgagagggtatttagatatccagtagcatttttcttatgaaatagtaatttcaaccagcatgttaacatagatttttgcaagtttttaaggagatttattttgtacaagttctaaagcagtcttggatcatgatacaaagataccttcaaaagctgtattataattttttttttctgtaaataagtcccttggccaaataaaaatgcaaaactgctttatccagcttgtacctattggctttgtccgaggaaaccagttgcctaatttctttcccttgccttatgtttgctgcagccagcccagggctgtttccggctgcagtgttgaacacaggaaccacagtgtgttgctggttgtgtgcgcaagtcacaatcaaaagcgcatgctttggaaactatgatgtgaggacctgtcttagaggataattcataggaaaaagttgaagcatattgccatcgaagcctttaatgtggggtcttctttctgtttcaatccctctccccgcccccggcaataaatcctttcttatctatcctaggcaataagatgtatttgaaaacaaaattactccagatcatctttactgccttgaagactaatacctttctttcatatgaatttgctcagtcagcagattttgtatctctgatggaagtaatcattttttcattgtattagtcttggtaaaatataaaatattaacatatagtatatttcatatatgtctttccatgaaatattttgtgataatgcagggataatattttgatatttttgtggaggtgggatctccatatgtttttcaggttggtcttgaactactaggctcaagcaatcctcctgcctcagcctcccagagtgttgggattacaggcgtgagccactgcgcccagccttaagtaactattttatttactacttgtaccttgcacgtaaatggttaaatttaatgtattaaatttttatttcataacatacctattctgttattaagcttgcaatacatatttggttttttcctttaaaatatggggaaatgtggaaaacaat

SEQ ID NO: 71905 - DNA, 1308 bp, Homo sapiens
ttattcagatacccctggttacttgcactcgtatatgcacgtatgcacacacacatgtgcatgttaaggcgtgtacagttttaccacctgcctgtgtttctgtatgcaccaccacagtcaggatagtgaatggaactaacactgaaagtatcccttgggttgcccttttgtaagcatatcccacaccttcccggtgctaaccctccattctcactccggtccctaactcctggcagccactaatctgtttgccattttaaagttttgtccttccagaaatgctatatttgctcatgattcttcagatctgcatttgggcaggggctcagttgggatggttttgtctttgtcccgtgtggtgtctgccggactctaccagcactgaaggatcaggatggtctcattcacatgcatagagccttggtactggctttttgttgaggtgtctaagtgctcctccccacaacctttctcatgtagttgtcttctgctaggcttctttctctgtgtggcctctttccaacaggagagcctggacttccttgcatgccagcttcaggtgccaagaaagcaaaagtggagcctgctagatctcttttcaatctaggcctaaaactggcacagcctgctttctgtagccgtcttttggttggagaaagttgcaaggatagcccagattcaaggggaggggaaatagactccccttcttggtgggaagagtagcagatatatgcagagatgagaggcattcttggtggccagctttacagacaatgtggtgcacactccaaagttacagaaatgatggcacatgggtctgcttggatttgttgtaaatgctaccttacttcaattttgaaatgtgaactcatttgaatttcataaaaagtacaaaggagaatgtgatatggttacatagttttctgttgctaatgcccatttcagatagaacagttctgttgcaagggaagttgccagaatttaagttaccaaccaaatctaaggattctcaaggggcctgtggtatttgcagaacaagtggttgcttgaagtggctgttaagatgttaggaatggttcacctctctctcattttcccaggctagctgtttcttgtgatcctaaaatagcaggggcttgtatatgtagtgccagaattctgtaataccgacttggagagaccacacagatttctgtctttacattaagctttttacatgaaggcataaggatattgtttttcaagatactatcaacatagaagagatcttttaagagggagaagagtttttcaatcaaggaaatgaaa

SEQ ID NO: 71906 - DNA, 2244 bp, Homo sapiens
ttttaaggcatttttgtccttactattttcttacacattaggtataatgagctatggtaaaagagcagtaatttaaagcatctgtgagaaatctaacctttccttttgtaaccttttggatttaattgtgatttttgagaaatggaacaatcagtagtagttatgaaaattgtcaatttggcttatgttaaatatatagattaatttataagtccatcgaaaatatgcagatgactaaaataatacagcaattctaaaataatacttgttagatagactagcactttctggggtgtggcgggggcaagtaagttaaagtaaatccttgccattctgttaatgataccactattctcagtcattagattggacaagaaatagcagttttggtattccacccttcttgggctccctgccatgttcaagcactttaacttgaggtcttaattctgtgattgtgagaataactctagacccatggtgtccctgtagtcctcagtgcgatcttatggctgtggtttggcctttcttctgactccttgagatatatcctgatcctgtacattagaaagtggctgttggagaacaacactgcaaatacaactttgcttatagttgtatttagttgcttatagagcaaccttgagattctgtcagggcagtgctagtgaatttcctctccctttaatagattcggctgctgagttcatcagaagctggtaagtagtgcaggtcagaatctgctcttacttgtgcacatgcaccaccaccaccttatctcacaccagtgtgatgaacaagactagattttgttttaagttttacataatgccttacttccctttttctgtcaccagacattcagccacttataaaaatcactctctccccaaacttgtgattatctcctttctctcggtagttaaaatgagcacggttcagattcaatgtggcattttgaaagccaggggacacacccagggtgattatggtactcaggtacaggagaacagaaagacagttctctgctatggaatattaattataaatattagctccctttttactagattcaaaggcagttcagtggttactttaaaccaaggccaggtgtggtggctcacacctgtaatcctagcactttcggaagccaaggtgggagggtcacttgagctcaggagtttcaaaccgtcctgggcaagagagtgagacctgcctctacttaaaaaaataaaaaataaggccagacttggtgactcacgcctgtaatcccagcacctcgggaggccaaggcaggcagattgctttgagctcaggagttctagaccagcctgggcaacatgttgaaaccttgtctctacaaaggatacaaaaattagccaggtgtggtggcacacacctgtggtcccagctacttgggaggctgaggctggagaattgcttgaacccaggaggcagaggttgcagtaagccaagatcacaccactgcactccagcctgggtgacagagtgagaccctgtcttaaaaaataaataaataaataaataaaaataaactgaattcatgtttccaccttccccaaagagacgctaaattcttctttttccctctctaattagtgttgaaattgatgttacatctccctttcttctggtttattttgtttgaatttattttttctcttttccttacgtttggttttatgcataatgaagtttgaggctattggtgcaggtattcagtaacataaaacttcatttatctgggtttataagtcagaatcctatttcacttctccctgagcctgaggggaaatcttagaaaagtctattgagatttagttataataaacatactacttaattactgcacaagcttaaccacagagtttgctgtcacaatataaacacccagatgagggcctgaaagaaacctccacactcccacccacatgaactctgttgggtgttttcttcctgccctctatctggcaaacaaaaatatggaatctgttccaagaatttctgtgaaaccagtttagaactttataaatggctcaactaaatgctcaaaacatgactacttctattccattttgccagctttccacaagccatttttttttattttaaaaaagtgatttttcttgagagctttgttattcttaaaaaattttatctaatttgttgcaagtttttaaaactccaattttgagacttctctttccactcttaaatagcata

SEQ ID NO: 71907 - DNA, 1282 bp, Homo sapiens
ttagtagagacggggtttcaccgtgttagccaggatggtctcgatctcctgaccttgtgatgcacccgccttggtctcccaaagtgctgggattacaggcgtgagccaccgcgcctggcctctaattttgggttgtatcgtattttaatagcctttgtgttttttattgttggaatataaaatctaccctctacaatctgactttcaaaacaatctggtcttataaccctgcttccctatatttcctttaaatattacgtgttacttcagccacactgggttacttctgtttcctcttttatgtacggtgactcttctgcctcgtttgcccttcttccaagtctctaaacatgttgactcctacccatttttcaaggtctgactgcaatgttttccccttgctgtggagccttctttctgattggcgcaggagaaatgttcttctgatgtctacagctctttatctgttcctgtcatgtgggcagcactcaggattttctgaccttgtattgaatgtatttaatatgaccatcttcccgttttgacaatgcactttgtaagggtaggttcaaagccattaatttcatggtgcaaggacctacagatagtaggtgctcagattttctttgtaaaagaatgaatattttaggggtgaaatttgttagatgctggattttagaatagaatgtctccctaaaaatatggtgacaaggcacatggaagagaggagagaacatcttactgctctttgaaggaagtacagaaataaaatggttactgttaagttggttcaagtgttatgtccaaatttgcctaactttctaatatcctgacaacacctagagaaagaaagggactcagctaagggagacatttacaaagggccacaagccctttagagcgctcttcttcattcagcttagtcttcttgaacatgaccactgactcacttataaaagtataagtaaaatacaagtttatttatactttatatttcccaaacagccatttattaaatatgtggcatatattacttgtttcctaaagtggagacactcagctgcttttttttttttttttttttagaatttgcaaaacagtcttagggaaaaaaatttcagtaacatgctcatgtgaaaatattttgcaggaaacatctcgagatatgagtataagctgtatgtaaactagcttttgaacaatgtaatatttctctctcactactatttcaggaattcatagtctttgtattacgcttttgtttaaaaagctaaaaaaattt

SEQ ID NO: 71908 - DNA, 1607 bp, Homo sapiens
tgtgtgactgctgtcatggcagttcgccataagtataatttgatttttaaaattctataatctatttttgatgtttctagagtttaatggttccttcttaggaattaaaatactgattgtatgtgatgtatgtataaattaagaagtgtttgcaactttcactttcttttttttttttgaaacggagtctcaccctgtcacccagtctagagtgtagtggtgcgatctcagctcactgctacctccacctcccaggttcaagcaattctcttgcctcagcctcccaagtatctgggattacaggtgcacaccaccatgcccggctaatttgttttctgtatctttagtagagacaggatttcaccatgttggtcaggctggtctcaaactcctgaccttgtgatccacctgcctcagcctcctaaaatgttgggattacaggcatgaggcaccatgcctggccaactttcactttctatcatgtattttcttatccttacttaaagagttagaggcagaatacttgtcttctggaattttaacgtctgaggtgctcagaggggctctaaatgatcaaattcagttttacagggaaaaatctagttagtcccaatgatcctctcaatgaattgttacccctcagattttattaataagtcaaactagggccacagcttgaaatgaaacagctccacctcattgttgtggaacgactaggttgagctcctaagaaaaagtttttgtaggtatctttaaggtattagactaaggagtatgccttagcctaatagagaccttatggaaaatcccatttcttggtttgtagggtattccctaacctggtaggaaaacttagttatctctcttttggagttccagcatggatagtgaagaaccaccaaaggatttttttttttaagtgctctgaagtggagatgtatcctagttgtttctacatattttgaattgtatcgaatataagtgattattcaaaaagtattcagttgtgttatgccactcattaaattttcatttgaaatcttgagatatgagcacctcattctgttacggtttcttcgaatcaggaaatctttagcgtgagggtggttttcatctctagttgactgtgacctagccatgtcttagtcctagtgttgtatttggtacaatagttatgcctgttgtactccacagggtcgttgtgaggatttagtgagataatgcacataaaaatgcttcatgcattgcaaagtgctccgtgaaagcacgctgtttgttctgtacattatttgttagagccagataggttccagatagagttcctcactatagaaatgacttctcttgtttcacaatttagccagcgcttaaactttgagatgtcctttatattgaggatgccacataatgctatataaaaagaaataatagtctccaaattgtcactgatttctaagtttcatagtccatggctacattccacaagaagaaagatgatgaataaagctatgtttcttttttttttttttgagatggagtttcgctcttgtcacccaggctggagtacagtggcgcgatcttggctcactgcaacctctacctcctgg

SEQ ID NO: 71909 - DNA, 1016 bp, Homo sapiens
ccaaagtgctgggattacaggcgtgagccaccacacccggcaattgatctctcttttttttttttttttccttgagacagggtctcactttatcatgcaggctggagtgcagtggcaagatcacagcagtgcctccagggcttaagcgatcctcccacctcagcctcctgagtagctggaactacaggtgtgccccaccacgcccggctgattattgcattttttgtattgtgtttcgccatgttgccggtgctggtcttgaactcagcccaagtgatctgcctgctttggcctcccgaagtgctgggattataggcgtgagcaacagtgcctggtcctgctgtttttttttttaaacagatttgcactttgtttgtatgtgacctttggaaaaaccaaactgtggagactgttgtgccactaaagatttgtctgaggatggactcggtgaagaatataaaggcatatgcagatgggctcccttaggattttcgtataataagatgtaaattattggcaatgagttgatcattactggagctgggtgatgagtacatggaggtttattattctgttgacttttacatgtttaaatttttcagaataaaaagttttttcaacaaggccctttatatgtaagttcacgtgtgcttgctctcttcctagcaaattctatcaaaatcctgtactcaagggttcaactcaaattctgcttagctgtgaagcattttctgaccaccccatatgaaaatgatcttttttttttttttttttttttgagacagggtcttgctctgtcgcccaagagtgcaatggcatgatctccgctcacagcaacctccgcctcctgggttcaagcgattcttgtgcctcagcctcccgagtagctgggattacaggcgtgtaccaccatgcccggctaatttttttgtatttttagtagagatgggatttcaccatgttagccaggatggtcttgatctcctgacctcaggtgatcctcccgcctcagcctc

SEQ ID NO: 71910 - DNA, 1045 bp, Homo sapiens
tgagtcttcacataagagaaagggagttggggattgaagatgataattcttaagagaacttcattgatgtatgtgcaatctcaagaagaaggtaactgagagacaaagtaaccctaaaggaagaattaaaatcttggtgaacacgtgctctaaaaagaggtttaagctaatttcatagttttgcgtgacagctgcctttcagtagcaggtcgtagggaacacaagattacaatttcagcttccttctggacagagtaagaaatgaaggtaaaggtgtttctgtcatgccttgtggttactcatcttgagcttctcatactctggccctaatggctgtggccctgagagtcctaatggctgctttgctgtttttactgtgctgtacagaggccctggatggttgaaagaatagaaaactcagtggtcaagaaatggggaaaatgaaaatgttttactaggtaggttggacacacacgacctctctctgacattagttggctctattaaggagggattactttgtgaagtttgacaatttacaaatttattctactaaaatacttccttcaatgtcagctctgtttgctttacaggcaaagaaactccttgaaatcggggagcttagcccctcaacctttggcaggttttgagatgaagaaaatttttacattatctggagagagggtggcatataaggggagactggggaaagtgggcagtttcctttttttttttttttttttttaggacggagtctcgctctgtcacccaggctgcagtgcagtggcgccatctcggctcactgcagcctccgcttcccgggtgcaagcaattcttatgcctcagcctcccgagtagctgggactacagccacatgccaccatgcccggcttttttttgtatttttagtagagatggggtttcaccatgttggccaggctggtctcaaactcctgacccagtgatctgcccacctcggcttcccaaagtgctgggattgcaggcatgaaccaccgtgcccggccacagcttcctatttaatagt

SEQ ID NO: 71911 - DNA, 1153 bp, Homo sapiens
cggatgtcatctggctatgggcggagcaggtgatggagaaggggagcatgaccccgggggtgggaatcccacggatgggaagttgaatccgacaggcaccccggaactgactcgtgggggtgtttcctgggcaggaggactcgaaggggtggagagaggcaggccagggcaaaggtgggccgctgggctgagaggaagctctagtgagaacaggtgatagaggcagaacttctaagttgggagagtggagcggccgccgcttggctctgggacagggagcgcagggagagttggtgaggtgggcagaggcccgggagtgaggggaggaaaactgcgggggtagagtccacgaaccttggaggggagtcactggtgaagaggttggaagaggagcctgaagaacctgtttccttttccttctggaaaaggaattcgttggtgacagtggggcatgggcagagtctttgtaagggttggtactattattttcagaggaatggcgcccagggccaagtgtggaggtggaggacctgcaagttaagttcatttctgtggggcttttaaagttagtaagtagctcgttaagggccgagaagcgagaagctactgtgtagtttatggggtgacaacctacatatccggagaagggagtgccagggtttgggggaaggaacatgaggggtctccctttagcatgtagaggtgggatatttgcaggacgggttgaaggaatgatggcagtatccatgaagagtggaaatcgggtagtgagaaggaagtcatagctggagagtgaggaagcaagaaatggcatgatcgtaggagtgggggacctgattgcaatttagagaaatggtttgaagatggtttactcttgaagcaaatgtggtttgggacagaactgtagacattcccttcttagaaaagagcataatagaatgggacgagcatgccgtgtggagttggaagacctatttcggaggtccggtttgccaccaacttgctttgttgatacgacatggtagtgagttcttcggtcctttttccttacctataaaatagagggaattaccttttccacagcctgtaaggattaagtgagtacatttagaaagcacttggcaaactgtgaagtgccacagatcttactaca

SEQ ID NO: 71912 - DNA, 1006 bp, Homo sapiens
tttattacctattctgcgccaggcactctgtgggacgggagtagacttggtcctgaacatccaaagatgaatgaaatgggtccctgctttctttttctttttttagatagagttttgctcttattgcccaggctggagttcagtggtgcgacctcagctcactgtgacctcctcctcccaggttcaagcaattctcctgcctcagcctccggaatagctgggatcacaggtgcccaccaccatgcctggctaattttttgtagttttagtagagacgggggtttcaccatgttggccaggctggtctcgaactcctgacctcaggtgatccacccacctcagcctcccaaagtgctgggattacaggcgtgagccaccatacccggcctgggtccctgctttctcagagcccatggttaagtgggaaagtgggagaaaagctcattatgatccagcgagtcatgtattagaatgggacaacagcagccacaacaacaacaataatggccactatttatcatgcatttttggggtgcctggtccagtgcagagtattacacaaagcatttcagggtgctgagctgactgtcgactggggagtaacctgttcttcctcaggaaggcagaggtatcaggaagcctcacattgcaaatatgacctttagaatatgacctttagactaggtcttaaagtgggagttgaattttgacccatggagacgcagggaagggtgtttcaggcagaaggaacagcatcagtaaaggctcagaggcaaggtctacggtcaggaaatcctccactgcaaactcaggaagctctgggagccctattactcagggaatggtgggttttcttctccaggcctcataccccaccaaatcccaagggcactgtcaccttccaacctccatctatgtgtgacattttttgacatttcttttattaattatccaggttaatttttttttattatttttttatttttttgagacagagtctcactct

SEQ ID NO: 71913 - DNA, 1014 bp, Homo sapiens
gatggaatagagtatggagtggatggagtagagttgaatgtagtagatggagtggagtggatggagccaggtatggagtggatggagtggagttgaatgtagtggatgggatgaagttggatggaatggatggagtggaatgaatggagtggagttgaatgtagtagatgggatgaagttggatggaatggatggaggggagtggatggagtagagttgaatgtagtagatggagtacagtggatggagtggagttgaatgtactggatgggatgaagttggagggaatggatggagtggagtggatggagtggagttgaatgtagtagatgggatgaagttggatgcaatggatggagtggagtggatggagtagagttgaatgtagtagatgggatgaagttggatggaatggatggagtggagtggatggatggggtagagttgaaggtagtagatggagtagagtggatggagtggagttgaatgtagtggatgggatgaagttggacggagtggagtggatggagtggagttgagtggagtgaatggagtagagtggatggagtggagtcgaaggtagtggatggagtggatggaatggggttaattgtggtggatggagtgaatagagtggaaaggagtagagtgaatggaatgagatagagtggaatggatgaatgaacagagtgaagtagagtgataaggagtggcatgaatggaatggaaccaaactgaagtgcaaagaggtttaggtgactgctgtcactgggacagtcctccccaaccctcccaccttcccacgtgtcccttgtccccacataccacttaccgtggaccttactgggggagagggcaggtggaggcaggccaggggagctgtgagcgggcagcgcaggtcccgggcctggccctggggggggcccgctgtacgtgtccatggccagcttgtgccggaaggcttcttctttgcgccggttggcaaaccagttgtagacacgcacctccgtgacg

SEQ ID NO: 71914 - DNA, 1817 bp, Homo sapiens
tccgcctcccaggttcaagcgattctgcctcagcctcccaagtagctgggactacaggcacgtgcctccacgcctggctaatttttgtacttttagtagagacggggtttcaccgtgttggccaggctggtcttgaactcctgacctcaagtgatctgcccacctcggccttccaaagtgctgggattacaggcatgagccaccacgcctggccccagattacctttctaaaatctgaatagattttagaaattcatatggccctaagagtttcagagaaacacaggcatgcacacaaatgcatgcacaaccgatacacacccagacacgcactagggatctgctcacacaagcagtcgtgcacacacacagatacgtgcattcacatgggaacacactggcctgcagacaccctcaatcacggaaacacacttgtcccagagacacatgcagactgcaatgcctgccaggcacccctttcccctgcatccattgacagccaacctctatcatcatctcctgctgtgtggggcacagggcgctcaccgtgggggctctgcagctgagccatggtggccatgaaggggctctgggtcacatggctctgcacaggtggcatgagcggctgctggtaggaggggtgcagcggctgggagaactggacgggctgcagggtggtcaggctgctgcccatgctgttgatgaccggcacactctgtgcctgcgtggaggccaggcctggagtggaaggggagggaatcagctgggccccccagttatatcccacccctgcccaagacctcccaagggcaccacctctccttcccagagcccgtggtttggaggagggggcagggtggtcaggaaacagccctccactgggacctgccactaatttaagtggctctggcaagtcattccccctctctgagcctttagctctttgtctaggctagtgggagaggcaggcggtgacttgttcaaaagttgtcaaactgcggttccctggagccctggggttccacagcagtgcaaaggccatggggtcagttctctgctcccctctcctagcagctccttatctatcttatgtactgggcttctgcataattgtacctgcaaataagggctttctgggcttaatttttcttcataaaacaaaaacttagaaaacatcagtcccccttaccctgctgtaatttgcccatagacccttcaccttctgaggtaccacagaattgatgtattatgcttagtgcctgcctccctgcttgagttgctgagattttggtctgtttggttcacccaggtatcactgatgtagcacagtgactggtccagagtaggcactggataaatacatgttgtatgaatgaatgaatgagtcccagtggctcttccagctcctggattctgcggttgccccatgagcctcccacccaggtgcccacccatccccaccagcttaccgatgaccagggtggaggcacctgtgttggtgaacgtaggacccagggaggcaggctcaccaggcccgatggtcatgaccccaggaagtgaggccatgatgaggttctggggctgctggttgaggcctggggatgtctgctccaagctgtgcagtgctgtcagggtgctgacaggggggagggggcccccagctgctgagacctacgaggggaagccaagctgtgtccggggggccggggtccccacagggcctccctagggactgctccagaatctccctgccaaggaaagatgaggttgggttttccttacaagcaaggacactcaccagcttggcttctgtactc

SEQ ID NO: 71915 - DNA, 2192 bp, Homo sapiens
gcctcccaggttcacgccattctcctgcctcagcctcccgagtagctgggactacaggcgcccgccaccatgcccggctaattttttgtatttttagtagagatggggtttcaccgtgttagccagaatggtctcgatctcctggcctcatgatctgcctgccttggcctcccaaagtgctaggattacaggcgtgagccaccatgcctggcctcatcttgttttactatgtctttaaaacttcttcaacacttactggaataaagtgggctttaaagaaatgaagcactgcagttcgcgtggcagaggctggtcagcatgttataaccagaccatcagccctcttactaggccagcacgctttcgcttttgcatttacaatcacataccccatcccctccacttgaaaaagaattttgtttttgtcgttatccaaaaatctcatcttaaatcaaccgtctcgtctccctgtagcttcattaccatctcagaagcagcaaaggagccagcaaaagctaaggtacagaaagtcgctttggaggatgatggtgagtggttatacttaatagaagctatcatttattaagcacctaatgtgtgtctggaggtgggcgaaacagttttggtatattcttttttttttttctttttttgagataggaactctctctgccacctaggctggagtgcagtggagcaattatagctcaatgcagcctcaacctcccggacccaagcagtcctcccacctcagcttcctgagtagctgggaccacagacacacaccaccacccctggctaattatttatgttttttagagacaggatctcgctatgttgcccaggctggtcttgaactcctggcctcaagccatctgcccaccttagccttccaaagttctgggactacaggcgtgcaccaccacacctggctaatttttgtatttttttttagagacagggttctgtcatgttgcccaggctggtcttaaactcctggcctcaagctatcctcccgcctcagactaccaaagtactggggttacaggcatgggccacctcaccattctttcatctgctcagcccctgtggtgaggcaggtattatgattgaaccccatgtacagacaaggagactgaggccctgagaaacgaagtcatttgcctgaggcggcctcgtctgtgtcaccctgagcaggagcactttactgctgccctccacagcctcgcccatctgcgtctgtcctgtaccaacacatttgccactttgaaggctgccttaggtcaggagctcaagtgctgacttccagaagcctctgagggcttgctgagctgatgtggctgctggctcctgctccagcgcgccctccactggctccatcaggcatcagcatgacccttggcagatgcagaatcactttgtagttagacgactgattcctgggtctttgcctctggaccaggagctcctgagggcagaggcggggcagcttcagcacctggcacctgggaggaggggctggcatctgggggtgctgactctgctcctttgttttttttgtttgtttgcttggttgggtttttttgttattgtttcttttttaaatttttttattttgtgtcttcttaaaattttttttttgtttctctttatcttttctttctttcgttttcctttttaaaatttttttcttttttgtttctttattttttatttttttatgtttctttttgttttgttttgtttttgtttgactctgccccattgaatcttaggtttccgccttttcttcacatctgtccctggaggccgtgagaaggaagagtctccccaaccccgccgaaagcgacagccctccagctccaggtgagaactcacacctctcctcacgtcccctccttttttctcctcttctgtcttggtgggttccctggaatagccaagcagactccagtcaggaccaggccaaggcagtggccctgtcaggcagctggagaaatcatgagctcagcgggagggaaagccctcttggcggcagctttggatgtttactgcttttgagcacctgtcttgggccagacacctcacttgatcatagttgcctcctgggacatccctgggaggcctggactctgttaagatccccgttttagagatgatacagtcagagaggttaagtcacttaaggaggt

SEQ ID NO: 71916 - DNA, 1036 bp, Homo sapiens
tgcacagtgtctttgacaccgcagactacaccttccctttgcaggtgagcacctcgtagcattctcccaggctcgtcgctggtcaccgtcgccagggcctagctcccttcccctaggatctacagcctcactccagaaaaaacgctggtcctattttaaaagctctgtgaacatcccaactgagaaaacctaaaaattgcaaaactgggtgagatccaggagatgattctttgctttatcaagtcctacagggtttctcaaaatagcctcatgtcctggtgcattgaaaacaggatttgattcactcgcgcttgatttacccgcagctttttagacgcacagccaccaagccagcaaggtctgccgagattcagaaggacagagaactttctaccaaagagcaccagcccttctagattgtgtagcatttcatcaacaaaaatgactccaggagaccattcttgggtacatttttccacaaagaaaggatgtaaatgacaaaaagaagaaaggcatcggtcactgagagaaggcgtgtgacttctagatttgcaagcagggaaaatgaaagcagaattgccaaaaaagagaaattaaagtagggttgaggagtccaaaaaacagataagggggcgagagggacaaaggggcacgtttgcggcttggggagctaaaatgctttgcaaagacccatgaagcccaagctgctgtttgtttctaacagtgggtcattaaaatcctgtgattgctcaggtggtgggatgccctagtgccctttcattaaagtctgggaaaatctgaacagtgttgtgatgaaggctgctcccctaccctcgcctccccaggtctcctgagtttcaatttaatgagatttttactgcgtaaaaaaaaaacaaaaacaaaaacaaaaacatgaaaaggctgcttttgagactgcattggtaaatgactcttcaacccattcaaacgctccttcactctccctcagctcagcagggctgctcgtccagctttgatattaagcccttggcatatt

SEQ ID NO: 71917 - DNA, 1016 bp, Homo sapiens
ggcatttgcctcctctctgcccatcaacacccctctatctcgggttgtctcggtaaatatgaccaagttccagttacacaccaacatgaatagatatttgctccatttatctgtggctgcaaaacaaactaccctgatcatggtgggcttaacacaagcattttattaactctcacagttcagtggttgactgagttcagctggttggttcttctgctggtctcactagggatctctcaaggagctgcagtcagatggcagctggggttggcatcccttggagcctcaattggcacccagggatagctagacatctcttcctctctgggaacccctaagagttaccctctcttcaaggtctgtccgcattgtctctccagcagggtagtcaaactttctaatagtggctcaggttcctcaaaacaaaacaaaaaaatagaagcttccaggccttcttaaggcttaggcctggaactggcaacagcattccttctgctgcttctattggctttgcagtcacagcacaggctcagcttcagaaagtaggggaaacactccacctctcaatggagaaagtgaccaagaatttgtggccatctttaatccatgcaacaatcacaaaagagaagattaaaacaaaactaatgtgctgttttttaaaaaaaaaattagaattccttttggagagcaaaataaaactgatttctcttctttcctgagattcatctccagttgataatgaaaatgtaactttccatgagccacaatgaatgatcacacattcattccttccatgactatcaagacctactatttgccaggcacttgggctgcaaagatatgaccttggctctgtattcaaagggttcataatctaatctggggagtcacaaggggaggagaccaacggcatgccatgtgacaaggcagcctgggaaataaagagatcatgagagagtttgaaaactacaagaaacattcattgagcatgtactatgtgctaaaccctttctttt

SEQ ID NO: 71918 - DNA, 1100 bp, Homo sapiens
tgtgtatgaatgtaccacattttatttgtccattcatccgtcagtggccacttgcgtggtttccacttttttggcgattctgagtagtgctgctataagcattcgtgtgcacattctggtggatatcgaatcacttctccacgtcttagtaacacacgtcacttactccccactctgtcatccttctatctgcagtatcccacccgcaggacgctctgttcctctgaccgaggttgtaaaaagggatggatggacccgcagagcaaaggtaccttctgtttcttttcccgagaccctaggggtggatggtctggcatcttggtgacatttgtgatgcccaggtcaggtcttcagcctctgctctcagctgccctcttccaccatcaccaagccataggcgagtctgcccatgcttcggctctgtccccagcagaccagctgctgactgtaaacatgactccagttttccagtgagagaagaagctcctaaaaacctagcaggttcaggattctaatcggtagaaaattcacatggcctatagcatcatctgagtattctaaactttccccctgaatttcctcaaaggttgaggaccatgaacttttacccccagggaacctggcagcaatacccatattaacctgcagaattttttttgttttttattttattttattttttaaacattttttgcactgttttattttgattttgattttgattttatttatatctaagtgcagtgctattgcgatacctgcagaatttctttatctcacattttaacttaaaaaggcacagggcagcgagcgcagaggctggtgcctgtaatcccagcactttgggagggtgaggcagatggatgcttgaggtcaggggttcgagaacagcctggaaaacatggtgaaaccccgtctctactaaaaatacaaaaatcagccagacatggtggcacacgcttataatcccagctacttgggaggctgagacgtgagaatcacttgaacctggaaggcagaggttgcagtgagccaagatcatgccactgcactccagcatgggtgacagagcgagacccctttaaaaaaaaaaaaaaagg

SEQ ID NO: 71919 - DNA, 1034 bp, Homo sapiens
ccaatgccgggatggggggtgcgctcagcagcatcaccccttatgattctcaatcgctaatagctccactcaggttcatttctcggtcaggggcatttctttgtcacagaaggaatcacccagctctgggagatacagcagcctccactcaggtagtccttgttcaagacaagcggcccttgactgactgcagtttcagttccagctctgctatcaactcactcattaaataaactgcatctccagtgtgcctgcctctgggctggattttgacgtgacctgggcaagcaactccctgaacttcagtttctcatatattatatgaattagctaagatggttcgtttaatcattcattcaacacatccatcaccacgtagtaggtgttagatatttatttcatacgtaactacgcataagagactttgctaagttttaggtaaaatacaagtcccagatacggagcaagtctcaaccactgtacatacctgaatgtgtaattacatcactgtgagaggtgccacagtaaatgccactgggtcttgtgttagtccattctcacacaaagaactacctagccaggtgcggtggctcacgcctgtaatcccaacactttggcaggctgaggcaggcggatcacttgaggtcaggagttcgataccagcctggcaaacatggtgaaaccccatctctactaaaaaatgcataaattagccaggtgtggtggcacacgcctgtaatcccggctactcgggaggctgaggcaggagagtcgcttgaacccgggaggtggaggttgcagtgacccaagatcgcgccactgcactccagcctgggtgacagagtgagactccatctcagaaaaaaataaaaataaaaataaagaactacctgagaccaaatactttacgaaaaaaaagaggtttaattgactcacagctccacaggcttaacaggaagcctcaggagacttacaatcatggcagaaggcgaaggggaagcaaacacatcttaccatgatggagcaggaggcgg

SEQ ID NO: 71920 - DNA, 1050 bp, Homo sapiens
gtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccccaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcggg

SEQ ID NO: 71921 - DNA, 1048 bp, Homo sapiens
actctgtcagttgcaaataactgacaggaaacagttctcagtgccttaagcacatgtgcacaaacacatacacacatacacatgcgtgcacagcgggggggcagtgtattgtccggctgaccaaaaagatccagcgtggccaggagaatctcgtgccaggctgaggcagaagaatctcttgaacctgggaggaggaggttgctgagctgagatggtgccactgcactccctcctgggcgacagaggccactgcactcctgcctgggcgacagagtgagagacaaaggacaacaccctagtctcccttcctggctctgcatcccgccgtgccagcttcactcgcaggacccacagcatagcccgggaggcagcgctgcacttacagccccccaagtctgagtctccctttccagctgtccctggagattctagacctgtccatcatcgtatcaatggccatatctctcaacccatctctgtggctggggaatgggttttgcttatcagcttgggcctgggtcacatgcccacctctgcagctggggctagagtcagacccacccaagtgacataggcaagcattggggagatatggcttccaaaggacatttggggttctgttaccagaaaagctgggagcagatgctgggaagaaaacaacggatgtttgctacagtgtattttaaactaaactagacaggttcatcctggcgcggtggctcatgctgtaatcctaacactttgggaggctgaggcagtcggatcatctgaggccaggagttcaagaccagcctggccaacatggagaaaccccgtctccactaaaaatacaaaaattagggttagggtggcgcttgtctgtaatcccagctacttgggaggctgaggtaggagaattgcttgaacccgggaagtggaggttgcagtgagctgagatcgctcttctgcactctagcttgggcgacagagagagactctgtctcaaaaaataaaaatttaaaaaaataaataaataaaaatttaaaaatcaactaaactagccaggttc

SEQ ID NO: 71922 - DNA, 1049 bp, Homo sapiens
tgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgct

SEQ ID NO: 71923 - DNA, 1059 bp, Homo sapiens
aacagagggagactccatctcaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaa

SEQ ID NO: 71924 - DNA, 1150 bp, Homo sapiens
gaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgtt

SEQ ID NO: 71925 - DNA, 1338 bp, Homo sapiens
gatgaaacccacctggtgcactgggacagtcagcaccccaacctgggctcagcccacctccttttgctgacagctaatccacctgaagtttacctttctcgggaacttgcactgtagctggggggctcttggtcagtcagaagaaaagcacttttgtggcccgggaccgtgagtgcctgatggggaggtttgaggctctgtgctgggcgagcagtgtggtctcactcaggaccctgtgtgtccatgcagagaggtgtccactcatctgctgtcaacgccaccctggctccagctctatgaagctggtgtttggggtctgagtgtctcagggtgggggaacgggcatcccgtggatcccaagggtcccttctcacttcccttttccctccctctggtgattccagcaaaaaaccaaccagggaatgtgagtccctgtctgagctcaaggtaacgcccgcctgcctgtgccgtagcctctgctggggcctgaggggggcgggtgggcagctgcagagcacgggggcatccccacccgggcagatgctccttccagcctgggctgctgtggcccggctcaccgcgggcctccagacccagtattagaatgaggggcctcgggggcttggacccaatggtgggtcatgcatgtgggctggggctgcgggtgcatggcgctccagctggaatgcctgagaatgcacccaggtctgaagatcctgtgtggcacccatgtcttctcagtgcacgtcaatggtgttgaagctctgtcacagggcccatgggtgcccccccgagtccgcatggtcagcacataggtcaggcatgctgcactgtgtggctcttcgctaggggctctccagcctccacttctctttctttgatgtgtttagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttag

SEQ ID NO: 71926 - DNA, 1038 bp, Homo sapiens
gtaggtgacgagcagtgtttgctttggtgtaagtaggtaaactgaggcccagctacagagggagcctgcagtgtgcttgggaaaggctctagcccttcgagagggccattcctggctctgccctgcgtcggccaggccccacacccctgtgtcttggccattctcggggagaatgggaactgcttgccccctagcctgggccgcaattgttgatttctctgctgtatcctatgtggagtggcacagcacaggtggccctcgaagggcagatgtggccgccattgactgccactctgtccctggcctctttgcagtgcccattcatggacgagcggatcatgtgtttacacagtaagatcaagagtcaggccctggaatttccagaccagtgagtatctcccgccgtcccgcatctctcctgtccgagttcttggcggtcccgtgtctgccaccctgacgcctctccatccccaggcccgacatagctgaggacttgaaggacctgatcacccgtatgctggacaagaaccccgagtcgaggatcgtggtgccggaaatcaaggtacccttggctcagcctgtgccccgtgctcggaattgtttggctcagccatgcctcagccagaccccacacccttgtgtccacagcaccacaccctccttggcaccgctgttctcctatgccccagggcctctgagctgctgggggctgttgagggctgggtaggaagatttgggcattgtgtgcactgtgactgtgggagtgggatctatgacccgccagcctgcacttgctctgattggcgtgggctgatgggatccaccctctgcagaccggcatggggcctccgtgctccacaccctattcccagagctcaggtcctttccaaaggcccgtccctttgagaaactgcagtgaggatgggaggaaattaatgagcaattcgacctccccagcctgctgaatcccaccctcttgcagaaagcacttttaggaaagtgtattcccctacacatctccactaatgccacacacat

SEQ ID NO: 71927 - DNA, 1110 bp, Homo sapiens
caacaccacgcctggctaatttttgtatttttagtagagatggggtttcaccatattggccgggcttatctggaactcctaacctcaagtgatctgcctgccttggcctcccaaggtgttgggattacaggtgcgaaccactgcatctggcctgaatttgactattctagatacttcatgtaactgaaatcttacaacacttgtcctttagtatctggcttgcttcacttagcgtatgtcttcacggttcgtctgtgttgtagtgtgagtcagagtttccttcttttttgtggctgtatagtattctgttgtatggctctgccacattttgtttattcattcgtctgttgatggacacttggttataccttttggctattgtgaatgatgttgctatgaacattagtgtacaagtatccgtttgaatccctaccttcaattcttttgggtctatacctaggagaggaattgctggttatatggcaactctacgtttaactttttggggagccaccaggctgcctgattgtagtttgaatttgcagttctcttactgtgaggttgaacatcttgccgcatgattggactctttggcgttctcttaccacacactctgtgtgcatgagtcaggcccgtgtcagggctggggcgttgggttttcccttttgcctttcctgttgggctttccctgccacgtgcctggcgtagtagctatttcatcagttcttctggaaggaccgttccgagagcgctgagggccattttctgcctctcagccagatcctccagggagctctggctttccgctgtctgtaccttcctctcttttaccccactacctcccaatgtcatcggagataccattttattcattcataaaatctctgctgagccctcactgttttcctgggacatctagagagaccccccccccaccccgccctttttttttgagatggagtctccctctgttggcaggctggtgtgcagtggtgcaacctcagctcactgcaacctccgcctcccaggttcaagcaattctcctgcctcagcctctccagtagctaggattataggcatgagccactacacctggcttattgttgtatt

SEQ ID NO: 71928 - DNA, 1010 bp, Homo sapiens
gtttccctcatcctggcccgggtcccgggtccatctgctccaggaaggctctggtggctcgtgatgagctgccctgtgagagggaacagggtagaggcaaggccttgggggatggcctctgcctggatttcatggggaaggatgcagggccagggctgacattttgtcaaatccaagcaactttgcaaaaaagtcctcctctcacgctccgccctctggaatcgaatgcttcactgtccttccctggcagagggcctggtcctgtgagggttacatggccaggcggttatctccgtgctgggtgcctgatgagagctcagttgaatgttagccgttgctgtttccaggctaaactattgtctttttgcatgatttcttctgcacagagtgttggtagctttcatcagatctttgtagggtctgtgacccccaaaccgttcaggacactggcctagactctaggtgtctgtgaggccagaagcccctggatgcatctcttcctgtcagggcctgcgtccctggggctcctctctgctgagctctggggtttcacgcttgccctgccagcgccgacgtccctgcccggggtctgagctgtctctcctctccatcctccaacagaccgcagaggccgagactccgtcagagctgtgagggaggcccgggccagatgccagcttgccaaggaggccgattaaaagcagccttgctgggggcggatggctcagtgcccttggcctggtgtagagttcgataagcaattgttttcctgttggtgagaaaaaaacaaatctccattgactttcccaggcactgctcagcctcattttcttctcaggaactcttgcagccctatcagaggcagctctaggataggggagagactgactgcctgccctgggggacgcaggccacacagccagggctgagggacacacttaagagcaggccagctcgcttggacattggtcctcgtgggaacattccagagcataggctacctaccagag

SEQ ID NO: 71929 - DNA, 1034 bp, Homo sapiens
ccactgcgcccggcctcatatctattcttgagttacccacttgaccagagcaattgatagccagctggccaggcttgagtcacatgcaaatctctgaagctgatggtggggtcagccctgtagggccacctctcatatggagggatggcttcccagacataaattgggctgctgttatcagactaaagaaacttcaactctaggccagctaaagaaagcttctgaccttctgagtggccttgggacagaagaaataaacaacaacttctagtcagtatttactgagtgcgagcagtgtcctagaaagttctaggcccgggaattcagctgtaaacaaggaggccaaagccacagctctcatgagttagtcatgtccatgtccctgtgcccaaatcctgtgcatttctcctccaagcactttgagaccctgtgctttcgctctcatctctctcaaacacaggtcgaggtcccagcaaggcagaggaatgggctgcctgcccaaatcccttgttagagattttggtccagcctggactttattcaggacgcaatatgtggacatggcagggctatgcctgtaattgttggccccttcctgaaaaactcagcccggccgggtgcggtgactcatgcctgtaatcccagcactttgggaggccaaggcaggtggatcacttgaagtcagaagttcgagaccagcctgggcaacatggtgaaaccctgtctccaccaaaaaacacaaaaattagctgggcatggtggcgtgcctgtaatccccagctacttgggaagctgaagcaggagaattgcttaaacctgggaggcagaggttgcgctgagccgagatcacaccactgcattctagcctgggcaacagagcgagactccatctcaaaaataagtaaataaataaaaataaaaataaacaagaacaacaaaactcagcccaattgtcgccctgcctagaaccactgcgtgactttgggcaaatcagtaaatccttctgaaccttcattttcctcattggtggaatg

SEQ ID NO: 71930 - DNA, 1069 bp, Homo sapiens
tcccaactttggctccttgtactggcaaattatgctcgttttctgatggagtggagtccaccttccctggcaggttatgggatggaaagcatttccgaatagttttgggctctgagaaataagatttagaattattatttgttttcttccctgattggacccctttctcaacaaaaccaagataataataataaaaaagacatctttaaaatgatgtgagttctgttagattttgtagggaagacccctggctgctgctttccccgttggggacgttagtgatccaaatgggaaagggattattttagctgccagtgtttcggtttcagtcatgtttgtagtattgccactgaagtttttttttttcaattatgaaacattttaagcatagagaaaagccaaagttttgctttgtttttttaaactggctcgctttttggaaagctggaaggaggcccaggaggtgacggaaacggggcagagtggggcgccctggctctgcaggctcgacccttcacccagcccgctcttttggttggggtggggtggggggattggtgctggtgacaggctataccctggggaactgagaaatactgggacttggttcctgtcccaggtgagtggtctcagagccttttggaaaagatgaacaattctgacatcctttcccttttgaaaaggaatgaaagaaaatgagaagattctgtagtgcccccacccccaccccaccccatcctgaaagctgctgagcaactatttttatgttgcctctttttatcctggtggcttctgtaaatagttgagagatggcagttgcagagataaaaatgctaatcccaacctggaaaagagagggatggtggtcctcggaggaaaggggggtgggagtcagtggggaggccaaggtgttgcccctctgcccacgtggcttaggcatgaggcaggaacccagcgggtggggtaggagcattgtgggtggtgcctgagagaagcttctgttagagaagtttaaatggggaaccagtgttttgcgggggccagggtgcagaagggagagcacactccc

SEQ ID NO: 71931 - DNA, 1010 bp, Homo sapiens
gtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtaagtgccaaaaaggggagaatgggaagaatatgctgtatttcacaaaaagcatctaagtagccatctggaaaagccagaatgaacttcaatggtgcatccaggtgggctggggatgggagaggaacgccttcccccagcctttagggccggccctgagcaagtggtcagtcggcaggcagctgcggaagggggctcccccgagtcggtggtggcccaaagtccaggccgcatccaccgcccggcgcctagcgcaggggcagcagccgggtcgcca

SEQ ID NO: 71932 - DNA, 1030 bp, Homo sapiens
ggaccagaatcaggattcagccccagaagtgatgggctccacagcctaggctctttctcacatcaccaggctgcctttgtattcacctccatactctgaatatttctacttgttcaaagtgttttaaatttggtcctaatatttttgggtggttacactggcttttttttttcctgtttctttttctttctttcttttttttttttttgagaccgagttttgctcttgttggccaggctggagtgcagtggcgtgatcttggttcactgcaacctctgcctcccgggttcaagcgattctcctgcctcagtctccctgcctcagcctaggattacaggcatgcaccaccatgcctggctaattttgtagttttagtagagacggggtttttccatgttggtcaggctggtctagaactcctgacctcaggtgatctgcccgccttggcctcccaaagtgctgggattacaggtgtgagccaccgcgcccggccagtttttttcctcgaagatgtatgctgagacaaatgaaaagcctcctcatctgtgcccccatcacttcttctatgatgttgtttatgtttgggactagtaatctcactgcctgttgaagtgaaacttctcaagatcttctttctgacagcatttttcttttcttttttagagatagtttcactatgttgcccaggctggccttgaaatctgaggctcaagtgatcctcttgcctcagcctcccaagtagctgggactgcatgcgcgtgcctctgagcctgacttgacagcatttttttccttttctttctttctttttttttttttctgagacggagtctcgctctgttgcccaggctggagtgcagtgacacgatctcagctcactgcaacctcctcctcccaggtccaagcgattctcgtgcctcagcttcctgagtagctgggataacaggcacgtgctaacatacctggctaatttttgaattttttagcagagacagggtttcaccatgttggccaggctggtctcggactc

SEQ ID NO: 71933 - DNA, 1040 bp, Homo sapiens
atggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaacaagttagtgcaagcatctcagattatgttctctctgggcaaaattgccaatatcttgattagaaattgtacacactccatcattatgtaaattcatttagcacctattctcagacaagagctcttcctggaattggtagatctctccagggtggtcagtgcaggtctgtatgaggcttggactttcttctgaggcctccctgccttgttggactgaaccagcgcttgtggttcctgtggctgctcacgaggacttgttggtccctgactggagattaagaaggaaaagattttttcataatttttggaccaatgaccaggagcatttttcagtccctttctagatgttggctttcttatatattctgcatgggcactttttttttctatatttaactctataaatgagggatgatgataaattacgtccaggaattcatcatgagtaaggtgattataaattaagggggccggctgcggtggctcacgcctgtaatcccagcagtttgggaggctgaggcgggtggatcatgaggtcaggagatggagaccagcctggccaacatggtgaaaccccatctctactaaaaaaaaaaatacaaaaattagctgggcatagtggtgcatgcctgtaatcccagctactcgggaggctggggcaggagaatcacttgaacccgggaggtggaggttgcagtgagccaagatcgcactactgcactccagcctggcgacagagcaagactctgtctcagaaacataataataaaaataaataa

SEQ ID NO: 71934 - DNA, 1142 bp, Homo sapiens
acaacaaaaacattttttttttttgaggcagagtctcactctgtcgcccaggctggagtgcagtggcacgatctcagctcactgcaatctctgcctcctgggttcaagcgattctcctgcctcagccttctgagtagctgggattacaggtgcccaccactacgcccagctaattttttgtatttttagtagaggcagggtttccccatgttggccaggctggtctcgagctcctaaccttgtgattcgcccgcctcggcctcccaaagtgctgggattacaggtgtgagccaccgcgctcagcctctttcaacaaaaattaaatcaggcacagttttttcccttgggaggtttatagcgcaattgaataaattgagattcttaccctcaaagtgactagttaaaacacttgtgttcattttgattctgtttcaggaaagcggttgtattacaagctcagaaccaaatgtcagaggcacataagcttttacaaaaattgttggttcattgtcagaaactgaagaacacagaaatggtgatcaggtaaggggtctcttgtacatctcacggagatgtggtggtggatcttctcatcctgtgttttcctctttacggtcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcaggtaagccgatctctgtttttatagcacatatttgtgctcaagagctggtgagtctgtgactacgtttgagtattgaaaggataataatgagttttcatttgttcatattgacgtctggaaaggtagtcttcctgtgcaagccctccaaggaggcctgtggaggtgtgaacctggtgacaaactgacactttccagtggcactggctttcctgagctgtgtattcagtaaggaggactcgcctcttcagtgagaacacctgcatcatattaatgattagctgacacagagtgatgcttgatttagcaacaaggggatgtgaataaagaaatgaggaacacagatgttcattgaaagcttttggaaatcaaattgta

SEQ ID NO: 71935 - DNA, 1032 bp, Homo sapiens
acaggcgttagccaccatgcctggtcttaaaatatttttaaaataaattgtattagcctttaaataatggcccttagaaatttgagtctctggccaggcatggtggctcacgcctgtaattccagcactttgggaggctgaggcgggcagatcacgaggtcaggagatcgagaccatcctggctaacacagtgaaaccccgtctctactaaaaatacaaaaaaattagccggacatggtggcaggcacctgtggtcccagctactcaggaggctgaggcaggagaatggcgtgaacccgggaagcggagcttgcaatgagccgagatcgcgccactgcactccagcagggctacagagcgagactctgtcccaaaaaaaaaaaagaaagaaaagaaatttgagtctctgaccagtatctctcaggttgctgcatcaagaacgggaacaggtgaatctgtcaccatctgtgcatggtacagcaggtgtggattcaacacaggttatgctgatcaaattgtgtgtttctactttagggctgttttgctgcagcttctgaagtgttaaagcacttgaaggaacgatttccgcctaatagtcagcacgcccaggtaatctgccttttgcatggcaatagatttatttctgataaaaatagcttttattataatataaagtgggacataatctcccctcagaaaaataatattgagctaaaaaggaacttgtcaaaggatgcttacaagtatgatattatttatataaagtttaaaaacacaggctcatactctatgttgtttagagacaagggtatatgttgtaaaagtataaaaaacctgaatgagaatgataaataccaaattgagtgcctactttgaaaaaagagaaagagacgtagaatttgcaaaggacttcattggtatctaatagtatatgaagcagataaagcaaaatgtgagttgacaaagttgatgattggcacacatgtatctgctattttattctctgtgctttttcacatacttgagatattt

SEQ ID NO: 71936 - DNA, 1026 bp, Homo sapiens
gaatttgaggtctttttttggcatcaatgaagggaattctaagaggtcagccagtttcatgtaactaaggaaataaataggattctttgacatttaaggtagcagaggtttgtgtgttttaggagagaggagagtataatagaagtatatctgaaatcataataactaatgttggttgtaaatttgttctgtgccagtccctgtgcctattttatgggtactgtctcatagaatccacttcatgggctcaggtttgttgttatccctatttcacagaactaaagactgaggtcctgggagctaaatcctgtatccaacacctgtaaatgtcagaggcaggtctccaaccgaaacctggttgactccaaagaagagcagtgggaatgggacataatcttgatgacttacagctcaagtaatttgacgagattctctttataagggatcaattaaagtatctcttctgctactgtaggctttatcttccctttattcaaaatatcttctttcatgggaaagagtcagggaaaactattttatctaaagccctccatctcagtaaacactgctgtggcaatccagatgtttccttgatcatatttttctcttcctctttgtgatacctgttactgttagattgcatcataacactcaacattccctaattgcagcctaaagatttttgggtggtttccactcctttcagaagtctagacatacttccctatagcaaacatgttagcattttacagtctcttacatggctgtgtaaactgaggggtggatgggccctgactgatgggttccacggcgcctttgccagctggtttcttcccatgtctgggaagcactgcccatgttttctgaggtcgaaagggctagctggttgcttcccctgggaatgttgcaagtctgtctctcgcttgtttcttccctcttcgtggcactggcacctccttaacatcacttctcttcctttcctggtgccttggataagagaagcatctggtaatgaatgagtcggtg

SEQ ID NO: 71937 - DNA, 2563 bp, Homo sapiens
accataggcagtgggattgcttaagcattctgtcttatgaagtttgtgacagacttcagtaaaatggaaagtaattacaggtagtaatttaatgtatacactttaaaatcggcctggcgtggtggctcacacctataatcccagcactttgggaggccaaggcgggtggatcgtgaggtcaggagtttgagaccagcctgaccgttatggtaaaagctcgtctctactaaaaatacaaacattagccgggcgtggtggtgggcgcctgtagtcccagctactctggaggctgaggcagaagaattgcttgaacctgggaggcggagtttgcagtgagccgagattgctgcactgcactccagcctgggcgacagagcaagactccgtctcaaaaacaaccctaaaaccaaaaaacaaatctgtagcttgtccattgattcacacctgggaaagaaactcatacgtacagaattgattataatgacaaaagtggctccttgaagtaagcgcaggcttaactacaatttttgccatgaatttaagctggcattttttagttgagctttcatccttgaagatgacaccaaaagctaatgacaagataattttgttgctcatgataggcatccttttttgatctcctattacatatgtgcgcagcactgtttgacatctattatttcattgtaatccttacgataattctttatgataggtttgatgcccattttacagatgaggaagctgaggcttagctaagaagctaagtgactggccctaagtcacacagtaagtagcagaggcagtgtttaagtccaggtccatctaatgctaaagccctgctggctctttcccgtgtaccctctgcctctctcccagacccagtttttcaggaacacatctcgtatggctcagggttaaggccaggttataggtactttccttttaaatagtgctgtcactgtgcatgtgctgaaatgtgaaatccaccacatttctgaagagcaaaacaaattctgtcatgtaatctctatcttgggtcgtgggtatatctgtccccttagtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcaggtaggtctcccaaggccctgggggtgtgaattctttagagagaagcaggagctagcaagctggttctgtgaaaggccatacatacaagatttacctgccttggatagatgttgttcctgcaggggactatgttttagactataaaacattttgtattttgcacagactgaaaacttttttcccatgcatgttccttcttactcctcccaaccactttgtgaggtaatgggtgggtgatctccatgctgggagagtaaaccagggttcacacatctgatctacccgcgatcgcaaacgcagttaacaagtgacagagaaaggactcaaacccacgtcatctgactccaagcaccgggctcctctgctctgtgacaggaaccttcctgtttataggaggcatgatccatggttgctctagttgagtgtcacctgaaccccaaaactattgtgtaaaagaaagttgcttttctgttaactgaggtgttttctgtggaatattttcatcttattgtgtactttcacatttagccacttttagcctggaagtaaactttgttgccgcattttaatcctggagttctgtcgctacctcacccctcacttagacagtctgtttctaggaattcagtaatgaaaggaagtgccttttttaccagtcttgtttttgtatttcagataattttttggcacggtgtgctctgaaacagctgcagacactggccactgcttacattgccagagcagtctgtgccaggatggcatcgggtctgaattcacccgtgaaaactaattaacatactatgactgcagggaacatggggtgggggcggggggatctgggagcgtgtactcccagctgtgccctaaccactacgtgtctcctcgcgctgcacatccaggatgcttttctgcctttcttatcctgagggcaaggttgctggcactgggaggcatctgctcccaagaaagccagagcctgtgaggtgtatgactttacgcctccactcaagatagctgacgggcatggccaaagcgcagccaggtctgctgctgaaaggaaatcctgttccctctccccacccagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcaggtaggcaggtggccgggcccacgtgcttctggagcaatggaggctctaccatttctttcctctaatgcttgaggaaagcactggacacgtgttggac

SEQ ID NO: 71938 - DNA, 1660 bp, Homo sapiens
aagcccagaaatagttacagcttccaacccagagacctgcatttggatgactgtgtacagatgacttcctgctatggttgcttatgcatgtttgtgattattaatgggatattaatgtttagtctgtcattagtcaacaggcagagctcgccctgcaggaggcaattaggattgcccaggagtccaacgatcacgtgtgtctccagcactgtttggtgaggccatcctctggtcttgggagttttgttcacgggttgaattggccttcacaaggccccgttgaattgggttgttttgcagttggagcagagatcttcagcagcaaaaggaaacaagttaggtggtcatgggaattcagaaagggcaacttatctttacttacctttcttaattcatgacatctgttttgcttttggcatatatctgctctacaaagtttaatgcaacttgccatgaaagaagagaaacctttatcacatttagcactggcattaacaaaagatgtatactacacttagtaactgggtgagatgttgtcctgtaatagcaaaatcaccagggcagtggaacacagaagctacttgacaagcacctgagaatcttatttctcaattgaaggccatatgggagcttcatgctttttttctgaaacacctgccactcagtggctgtcaggtgaagcagaacaatgactcatttatttcagcctggttttaatgatgttgatatgtttgacaggtctcattgagattcttgatatttcttgaaagagtatttgagaggattcattttgtcccttttaaattctttcttatgaccacattgatatttcactagaacatcagccattgccactgttatgatatattttgatgatttctcttgccagagctggctttatgtgctggggcagaagagatccgatagctatgttctgctggagcattctgtgaagaaggcagtacattttgggttaccggtaaggctcatctttctgtgagattgtttccataaatggtcgagcctttgtctctttttctgcccacctctgtcattaaccagcgatagatttagaatgggtttcaaagtgtggttttattcttggcagtttcatatgactttaattattaatcagaccactaaattctgtgtggtaggtttctctctgttccctgtatcctaataacatctgtggaaattccctttaccaatttgataagagatcattgtttagtttattgagcaacattaatttagcacatagtcacttagaaaaattttagcaaaggcttatttttaaaccagggattggtgaactttcccgcccttgggccaaatctggctttctgcctacttaggggcttcaggctgagtggattttacatttttaagtgattgcagaaaaaaaaaatcaacaacagagaagaaatacgtgacagaaaccaagtgtggcctgaaaaatcgaaattatttactctctggccctttacacaacaagtttgctgatccttgttttaaacaataaacaaagccaggaaccagtaaacctgacaggcagatttgtcctttctcgttttgagtgatagggaaggccgtgaattatagtcctcaatgacatacacagaggggcattgaaaaggcttatctggctgggcgtggt

SEQ ID NO: 71939 - DNA, 1055 bp, Homo sapiens
tctactaaaaatacaaaaattagccaggtgtggtggcaggcacctgtagtcccagctactcaggagactgaggcaggagaatcgcttgaacccgggaggtggaggttgcagtgagccgagagcacgccattgcactccagcctgggcaacaagagtgaaactccgtctcaaaaaaaaagaaaaaataaataaagatttgctattttgggagaaaagaaaagggaaaagaaatggaagaaatgaattctcaaatgttaattgtgatgcatttttaaaaaatgtattttttaaaaagaagataggaaagcagctcatcaacctggactagtcagtaacttccatagagggaaccttattggcactggaacagtttatgaaaaccttctgcctaaatagtctgccccctagtgtcactatgtaacattgccgtcttagtgcctagcctctttcattacttctaagaacaacaggccgttcagtgaaaaagaaattaggtcattaggccagagagtccctaaaggattttttggaggtaaaaatggggatgcagaagctatttttagtatttcaaaaagccagaaggcagttgtacctttactggatgaaagactacataggcttactgaaagtcaggtttgctttcaggtagaattcaggctgctcagtcaggtgacactggtttatactgttgcctcagtgtgcctctgtttttaatgaatagaaataggaaaatcgatcaattatgttttagtaaatagaattaagtagataaaacaactttcaaaacatggaggctatcttggaaataatgaaataatgtaaataatggtgaaaggtgggaaattactaattcaaagatcccttcacccccccacctgccctgtggctttttaccagttgagagaagtgtggtctttgctacaggcatccttctatacagactatagcgtgtattaatgggagcatagtgttcacagttcaataatggagacatctatccctttctctgtgtcaggcagcacctagggaattctttttatctctggttgtcaggt

SEQ ID NO: 71940 - DNA, 1042 bp, Homo sapiens
cggcctcccaaagtgctgggattacaggcatgagccatcacgcccagcctaaatgacagttttgaggctgaaaaactcttttcctttctcttcttttgtcagtgtttatttttaaagttctaataattccattccttaatggattttttactcggaaaattttcttaaatagtatttggattttccatctgactttgggtgcagaaatatatctattttgcttcctagtaactgagatctgcctgttagggaagtttcagtgattaaaaaaaaaatgaaaataattaacttagtaaactagtaagtctcagtgtgttttaacttgtacattaataaaacttaattttataatttgtatatgaattcaggttttaggatctttaattctgaacactcagttttcctcaatatttgaactaggtaaggcccagtattctcatctatcactcatgtaaccagtggcatagtggagtatatttgagataaaactgacacaaatactaatggaactcccatttttaatttgtggactccctctagggggaatgtgtcttgaagctgttttattctgcctctagggagaagattaagctaaactatgaccatcttattagaagggtatgggatacactagtgtttgtagacagtggaactctctgcagttgtcttacaccagagatatttacagcgtttaaaatacattgattatttcttgttttagcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactagtaagtttatagacctttgtccttgcgcaaattgaaggaaccgatgacaataaaaagtctgctgtttggcctggtgcggtggctcacgcctatagtcccagcactttgggaggccaaggcgggtggatca

SEQ ID NO: 71941 - DNA, 1079 bp, Homo sapiens
gcaaacacattacctgcctggaaggagcttacagtctggggtggggtcagattggcaattttactatagtttgatagtgccacagggggggtaagtgcagagggcttatgggagcatggaggggcttataggatctcaccttcatctagaaggtgacagaagcaggtggcccagaggatgagctaggcatgggcgtcggtttgctcagctttgggtagtatatggctggggagcgatgggtgggaggcttggtgtttctggaagaggaaacagtgttgtagatggtcaagaggagagcatgtggcagggtccaccttcagtgttacctagagtgagggaaggccagccaaggctggcgagatgaggggccagagcctgaagggacccctgtagaaaagaaaataatcaggtgatgctagttagtatatcttttcatatgtttattgaccctttctttctactgagttaccatttttaaatttcaggcttctttgctaaagaatgatgagactaaggccctcactccagcttccttgcagaaggaattaaacaatttgttgaaatttaatcctgattttgctgaagcggtaagtctttcccagaatttgttgctgtgttggaaaggaatgacaaggcaactttttttgtttgtttgtttttggaaacagagtcttactctgttgccaggctggagtgcagtggcacgaccttggctcactgcaacctccgactccctggttcaagtgattctcctgcctcagcctcccaggtagctgggattacaggcacgtgccaccacgcccagctaatttttgtatttttagtagagatggggtttcaccatgttggccaggatggtcttgatctcctgacctcatgatctgcccgcgtcggcctcccaaagtgttgggattacaggcgtgagccactgcgcctggccaaggctactttttatattgagtagctgtgcaaatgagaatcagcccattggcccaggttcttgaaggaaatcgtgttcttggtaggcaaacaactcggtataggttgcaaagctcctccctccctcctcgggccatagg

SEQ ID NO: 71942 - DNA, 1080 bp, Homo sapiens
tgagctatttctctctctcttcctatgtgccaggctctggacgtgtaagatagacatggaatttcctcttatggagattacctctggttgggggagccagttggtaaaagtaaacacataaatatcatttcagatagtgtaacagccatgaagaaagtaaaatggaagccttcaggtggaggtggggtgggtagattgtgccctgtataagaagaaaccagctttgtaaaggactggggaagaacattccaggaggagggaatggcaactgcaagtgtctctttcttactcttctgaaggaagaattccagcagacagtcattgccattgtggagttgccattgcgtagcctggatgtcagttaatgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaaggtaatttggcttttctgacagggatccttttcctgtgaaatagtataatttcaagtgcaataagtccttgttcatttagaattcacgtgctggcttatgccctttttacccttccagatctgggaagttaactgataagggctgcaccagtgggtcccttgccctctgacttgtgattggccaatgggaggcactggcaggaaatcccaagggccagggagaatgacgtggagtgtggattcattggctccctttcttgggggtcctggggggctggctgtagggtcacagcttctgtcaggtcgctctttctgcactccttcagggggttcggtgactaggagcaagtgtttgcaggccccaggtgaaaggtaccccactgttatcagtcctggggactgtattgtgtcttatgacttctctgtcctttcccctacttttgtcaattgatcctttgttaaactcttctcagactactcaatttgaatg

SEQ ID NO: 71943 - DNA, 1095 bp, Homo sapiens
atatcgtctcaaacaacaacaacgacaaccaccaccaccaccaccaacaacaacaaccaacaacaaaaaaaccactttgggagctcctcagtcccttcagccccgaccccaagcatcgacttcccctcccatccggtccctgtccacgtagcctgggaacctgctcccactcggcaaaagtttctgtagggagtcagtcttttggtgcacccctccccgcactcttgtacattctgactggctgtcgctctcccatgtgctctgacagactgctctgattggttaacaaatgccgcgagcacgcggatgtctgtttcctgggatattgtgagggcgggcggagatgtagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcaggtgagaggcgcccgctggctcctgctcgtgcagcaaacttttactgagcatctgctctgtgcggaaccctgggcttggggacactcgtgtccatcagatactctccctgcctggaggaacgtgaagaaataaagatagctactaccggtagctaacacgtactgagcgtttacggtgggccaggcgctttacatgcattttttttttttgcaagttcatgtctggctccagtatttattagctgagagttagagtctcagatcctgtatcttctttaaaatggggctatacaatagagcgttggagacacagggataagtcatacaggctccctatcctagaggaccgtaataaacagtaaaaatgccataaaaccgggccgggcgcagtggctcacgcctataatctccgcactttgggagggtaaggcgggtggatcacgaggtcaggagttcgagaccagc

SEQ ID NO: 71944 - DNA, 1687 bp, Homo sapiens
aattttcaaatatgctgcatggggctggcgtggtggctcatgcctgtaatcccagctctttgggaggctgaggcaggcggattacgaggtcaggagttcgagaccagcctggacaacatggtgaaaccccgtctctactaaaaatacaaaaattagccgggtgtggtggtgggtgcctgtaatcccggctacttgggaggctgaagcaggagaattgcttgaacccgggaggcagaggttgcagtgagccgagattgcgccactgcattccatcctgggcaacagagcaagattctgtctcaaaaccaccaaaaaaaaaaaaatgctggatgggaaaaaaaaaaatacttcaaatatactagtgacaggggcttcccctgcttcaaatttctgaactttccagaaggctggagtgttgcaaatgctcctctcagagatgataactataagtggatttgcccttcaatatgatgctaaggttattctctcactgggagatcatgttctcattggaagattttgcccaaatttaagttcagagattctaatgaggctgcaacctaaatttttcaggattgcttctttaccttctattcctgtagtatttggctgacagtagttaatatgtgtctgagttgtactgaatattgggttatagcaacatttttgcctgggacactttggaggttggcttgggcttttttgttgtttgtttttgagacagggtctcactccgtcacccaggctggagtgcggtggcgtaagcatagctcaccatagtctcaacctcccaggctcaagagatccttttgcctcagcctccgagtagctgggagcacaggcacatgccaccacacctggctaattttattttttgtagagatagagtctccctatgttgcccaggctggtcttgacctggcctcaaacaatcctcccaccttggccacctaaagtgctgggattacaggtgtgagccaccattcctggcctgtttttaattttttattttataatgagggctaaattaagtgtttttcttcattttctttctggggaacaaagaggaaattcccttccttgtatagaaacgtgaggaatgggacaaaattgtccccctccaaaattggtatctacacagagaatccatctgttttcccaaaataagtccttctattccctttaccagagctgtgtagttgaaaaaaaaattttcagcctagaattttaatgctcatactcattaacatggtttgaaaaattgtattcttccctaattcattgtaaaactatccctgatacaaaggtcataatctctgacagtgctgcttttaaaaaggggtgtcatttgagatttttggttttctttaccaagaaaacatattttgaactttctaaatagcatgtaaaattttataatgttacattgtctgtgaagagataataggaattttttacacagttacttgtcagtcataccatggtggaaagaggagcaggagaaaaagaagtttttgtccatgaggaactttcactgtagtccaggaggcaacatcagacatgaattagaagggggataaaagctaagagagctgttggtttagtagctacattagtaggaagctaaacttgtaaaactgcacttctgttaaccctggaatgaagagaagtttatcctgggagtact

SEQ ID NO: 71945 - DNA, 1524 bp, Homo sapiens
tctagaaagccttcgttggaattagattgtctaagtacgctgtggtaggactgagatctttcaaatcagatgcccctgatgcttgggctgacccatcagagctttagcttttttctgtctgcatcttacaggctccagttaaactagccatttgcaggtactttgataatgacacagtgctgtcccatatccttaatggctttggcattccattatgggaccttcctgagagagttaatactctggttagattttataactttacacacacacaggaatttgtgttttgagctaactttatggaaggtaggttcttcatgcaattttgtagggcccaactttttggaagggtcagcagcattctgaatccaaagatgtgcattatgctggctttctggtcatcatggggagcatcaatgacaaggttttctctagtgataaatacagattgattcctgacctaatcagatacgttgtataagtgtaggtacaaagtgaaatcacttcagcaaacacagaagatgatgatgacgacgatgatgaggatgatgatgatgaagaagaaaacgcagaggatcgggtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttactataattaactatttgttacaaccctaattaaattcctcgtctctgtaaaaatgcttattttctcactaatgcctttggccggccagtaccttggttctctcaacttttaaatctaacagtagggggaaaattccctatagcccagatgttacatagttcttagcatcaactatctgtagatttctgtgtaagtcacaaaaagctgaggttaagaacttctgaactaggctgggcttggtggctcacaact

SEQ ID NO: 71946 - DNA, 1048 bp, Homo sapiens
agttgatgctaagaactatgtaacatctgggctatagggaattttccccctactgttagatttaaaagttgagagaaccaaggtactggccggccaaaggcattagtgagaaaataagcatttttacagagacgaggaatttaattagggttgtaacaaatagttaattatagtaagaaaaaccaaattgaataattttctaactcacttggcagtggtggtctcgcagccataatgaacatcacataatgaagttactcctttccagatctataaacaggctcatgtaactaactgatactcagtaaaatggtacacagctttctcaaaaataaatttgacttaattgtgacaaaaacaacccagtttttaaaagcctaaggaaaaatactacagggaaaaaatgaaaagataaacctacaggacttttggttttcttcattctctttgtataaccggtttactttctctaccagttcccatttttcacaacagccagaatagttgacaaaattccgagccagaatttccttcagctggcgcacgctcattccttccacatcatcaaggcttgacaagtcagacagtgaagctctcactctctccttggagagcccggggttctgaaaccacagagcatccattagccctggtcccataagtccagaccctccccactctaaactcatcactggccctgaatattctcccagccatctcagcagtcctagaagtgtttcagtatactgtcctacattcaaaccagaagaaacatcctgtactaatctagcgaatgtccacagggcactgtcccttcctgtcaggctgacatgtcagggaaaccaaattttataggtggcctcacccgatcctctgcgttttcttcttcatcatcatcatcctcatcatcgtcgtcatcatcatcttctgtgtttgctgaagtgatttcactttgtacctacacttatacaacgtatctgattaggtcaggaatcaatctgtatttatcactagagaaaaccttgtcattgatgctccccatgatgac

SEQ ID NO: 71947 - DNA, 1045 bp, Homo sapiens
aggatgcacaattattcctaactttcctaagggggaactaaggctccttttcctactgagatgaggctccagagactgtggtgttcccagggctacaaagctggggcaactgagttaaattccaatagcatcctgactccaaagcccatctacagaagaccagctgagggtttctttttctagttacagaagtaatatatccctatcacagatgtcttgaattagacaaagatataaaatagaaatacatagctaacatttgttgggtacgtcaagcattttattctttacaaaaccctgaggtatagcttttatcattgccatttctagtggagagaaccaaagtgcagagaagttgggattatttcttgtacaacactggggtggcattgggcctgcaggggtcattcagcaggtggctgctcagcttcggactgggagggtggctggctgactggccatgcctgaagccgaggccttagctctctgttgcctttcagatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactg

SEQ ID NO: 71948 - DNA, 1026 bp, Homo sapiens
ttctacgtcttgactcactgtataaattagatctatgtaagtacaagagctcatgctggagcagaacctcctgagtgcaaaggctgaagtcgaaattttaaaatttgagaaaagtgaattctctacagaggaaacttggcagagtatcttactttgactataatttacatttatccacaacatgctcatgtaactcttgaggtacaaagcagactctcaacttccagttaaacatgcttttaagtggaaggtcttagcctactttgttagatctgggcacatttgtagatgggttgtgtcgatgaagtacacgttaaattctctcctaccttaaggaaatcaggaaaattggcaatctcaaaacaataaaaacactggtatgcattcaaaccttgcataaataacttttaaacaatttgtacaaaaatagttctgcataatgtaagatgtaacaaaaccaaccaaacaaaaaaaagtgtcaagacggcagcagatgtggtgtgtggtccactttatgtcaacacccaaaacctcggtgttgcaaggaatgaagtgtccaaaacaccactaccactaacagaaactcctaagctcatgcttcagtatgagaatttctccgaagtccaccctcctctccgacaggaatgtcttcttgtaaaggccgccttagaaatggtccagaaagcagtgcagttacgattcagaaagaccaaaggaaagtgtcggctcactcatcccccaaacgggtggttgaacagcttctcccttggaaagacttgcaaaatggaattgcgttgtggtctgttgtcccacgttccaaatggaaaataaaagccctcatttttgtaaagtctctcccctcccagagcccgccccgtatttacatacttatccttggactaactcagtttttgcaggagtttttcttctacttgcccaaactggacactcacagacatctcggctatgaactgctcacagccttccttggtgacttgcttgcagtacctcaggtcaatatgacag

SEQ ID NO: 71949 - DNA, 3168 bp, Homo sapiens
gcacacctgtaatcccagctactcgggaggctgaggcaggagaatagcttgaacctgggagacggaggttgtggtgagcagagattgcaccactacacaccagcctgggaacagagcgagactccgtcttaatacatacatacatacttgatggagagtggaggccatggctgttagagcaggtgggaggtgcccgcgtgggggcaggataggtgctacatagagaagggtccagagcgctgagttaaggagcctcccagaggttgttaggtggggacagttaagagctgtgtgtgggctccctagaggagccccacctctgacgatgtgtccccacggggccggtccccaggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctggtgagccctgggccagtggccccgagtgtgtctgctgcagtgagggctggggacacatcccctgaccttcacccttttctatgtccccccagggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtgagttgccaggctgggggtttctgtgggggtggggtgagcgagctagactgttggatctgcttttaccctcagaccccagctgttccccaaaggacatagggatgagtctctgctgccatgttctcagtttgcttcaggcacagaggggatctgggaggaggcaggggctcctgtgcacacgtgagactcgctcctggggctccgcgtgcgtctctctgctttcctgttgactcgctcatggggctctgcgtgtgtctcactgctttcttattgactcgctcatggggctctgcgtgcatctcacttcttttctgttgacttgcccctcgttggtttcaagcctccactgccatcgggatcagtgtggttgtgcaaaggcttccaggatggcacctccccctggactgggctggactgcctaggtccgtgcttctcgccaagccatggggatcggagatgctgcgcagcctctgcactggttggctgatgactactgggtggaatgtgggcatagtgtttctaggtcttttagtttttcaagagaatctgaaaatctaagttttgatgtggagtctgatttttcactgttggaattatgattttgggaggaagcagtttataactaaatgaaatctgagtgttctgtctggctggtgggccttttagagtgtcatgtcagcatgaccaggcctcctcggtcagattgacgggttgccccctccttcctgccccaccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctggtgagtcaggggcccccatcgggtctgcctaacactccgtgggagaaccaggaggttcacatttgtggaaaacgattcgtgtgtctacagctatgtggtcacagtgctaggtgtctcgtttactgagacagacagcccagtccaggggggaaacacagtaaacaaagagttactgttggccgggtgcggtagctcacgcccgtaatcccagcacgttgggaggccgaggcaggtggatcataaggacaggagttcgagactagcctggccaacatggtgaaaccccgtctctacaaaaaaatacaaaaattagccgggggttggtggccggcgcctgtaatcccagctactcgggaggctgaggcaggagaatcgcttgaaactggcagtggaggtcgccgtgagccaagatggcgccactgcactccagcctatgtgacaagaccaaaactgtctcaaaaaaaaaaaaaaaaaaagttaccattggagttgtagtaattgctaccccaaaatagtgccagttagcagcagccacaagcacatagcagtggttcctgacccaaaatacggacaagggacagcttcccgagggggtgcagaagagccggtgcctgacaaccagggtgttgagacagtgggggccgggaggcaagggccctggtgggcaggagggagcttggtttctgcctttgctgtcgttgcttacatgcaccccttgtgaccctgctatcaaggggcctgttgttggagagaaaaaaacccacagtgagttccattattgttctctgtctgtcgctgtggtgcaggatcttcgctcgctgcacttgccgttggggcggcagttggttctgaaggacttggggctccagtatgcagcgaggtacacagagcaatgctgcctgctcttcgcccaactaacccaattttggtctggtagcttaggatggtctggattggggggtgttgggtttgcgtgagagcaaaaaaagaaagagaaaaagaaactacaggtttttttttttttttacccttagaaattaccaagtactaaggacatccccatctcatcaaattacatttttcacacagcgcagtggtgacatacacgttgttttctcctctgcatcccacatttatgcctgataaactgtctggcaaccatgcctcatagcaggggcatgggagctttggatgggatgagatcattcgggacctaggaagccattccttctcctcatgaagttttggtggcagggattgttccacctcgtggacgcaaagaaccagagtgaattgaggcttctccagctcaagggccaggtcatggccttgaatgggtgatggagctgccctttggagagggcctgggagtcgtcttactctaagtgctggcattttattacatctcttcattatatcctggtttagttattatggat

SEQ ID NO: 71950 - DNA, 1734 bp, Homo sapiens
tccacccccctttaggcctcatcgcttcaaacgtcccccggttcctcctctcacctctcgccgaggccccctctaggcagcagcctcagcccctggtggagatccagtctcacttacttccagcagcaggtgctcccacgacgcacgccctcctgaggccccggggactggcgagtcctgggctgtcccccaccccaccccgctggtcctccaccccactgctgcctctcctgaggcttcccaggtctcggccccagatctctggctcgtggttctggcttggggcctgggaagctgtctgtgcctagagcctctgttggttgggatggaagctgtgagtccagggaacctctgaggagcctggtggccctgctccacccacgggccgtgctgtcaccagccacaaggtggcgccaggagtctctcccagctctagccattcctgctgggccggggattcccacagggctgtgctccagaactggctcccagagccgaggatgatttgaatgggcggctgcacatctccaggtctgtggggtgggaggtcagttgggtgggaacagttcaactgtactcctacttccagcttcttccttgaaagctgcaggcagggctcgcccgtctgtcggtcagacgtggagatggcatttgtggggaaggcctccctccagcccctcctctggagactgtggactcgtggtggggtggggtgtcgaggagaccaaatcccacgagcccggggagcaagctctgcgtcctttctttttcgtgacagctcaaacctggcaaagaagataagcttttcaggaaaaaggtaccatcttcccctccctcctgtgccccaggcctgagcggttagagctgcaccgcagctccctgggccacagtcccgtggcaggggggcgggaggccttgggcgggcgcagccctgagccccagaggctgacgcgtctccgctctcgccctcagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgagcggcggcctgtgtagggctctaggttaaggctcaggcggcaccagggatggcccgtggtgtgtggagtcgctggcga

SEQ ID NO: 71951 - DNA, 1086 bp, Homo sapiens
ggggtggagtgggaagaggagtgactcgctggttttcccctcctttctttggggcagggctctcaggacttaggtgacctgctcagggcagcaagaggccgggattatcccaagctctacctgctgcccaccccctgccccatccctccaacccagcacccgggaccagccagaccaacccctttgcctcccagcccctcctggtccgtacccgcttgcgtccactcagctcctggggcttctcgtatttccgcttcttcctcaggtgcacgtcgtcagactttctgcgcagaaggccgtccggcggcaccttcttcgagtgctcatccgacctgcgccggggcgcctcctcacactcactcctccgcttggcaggttcctgcccttccttgttgtcccggttcatcttctgctccttgagcagggagccgggcaggttggaggcgtacttaaagccagggccacgcttttgcttgtaggccaaaaagagagaatgaacagaccaactgtatacctttggacttgcccttcctcctccccaggccgacggcaacccacctgcctgaaactcctgggacaggctggtcccggccaggcccaggcccgcccctctcccgactgaccctgggacttggagcccggcactcactttcccggtcttgccggcgtggttacacttcggacactcccagcagtttggaagctcgtcgttgaccacaccctctgactccttaatctgcggggaacaccaggactcagaagagggacgggcggagaagatggcccacgggcacaaggctctgtgacgccacgtcttccagaagcagcagcaccccctccccaacgtcacatctatcccgtttccaggcaaaagaaaacacagctgcagaggctggcagagacgggcagctgtggatccaggccagggttcagaggctgagcccctttgcttctctgggaccctgggcaagacactccgtctctgtgggctggtgccctcggccataaaagttagtgtgcccatctcactgggggggtatgacccaggtaaagccatgagctcagcgcctggcatgcagaaaggac

SEQ ID NO: 71952 - DNA, 1403 bp, Homo sapiens
gtagctcatttgctcaggcatgatgttgtaacaccatgtattggtcatctggaaaatattggctccctgagttaggcggattttccaaatattggcacataatattattttagaaatcacgtttgttaatatgattactgatctcattggaaaagtctctcagtattgggaagctgtgcgggttatggtggttcataaaagttttccaaaagtctaattttcattcagaaacttgaattttgtcatttgcaacaaatgctgtcagttatttttctggaaatgacaagctcacttctttgatcttcacaaaaatacaccagtgtccagggggtttctatcagtcattccttcaagtaaaaataatctgtggagaaagtggccatttcacctcccagctcagtcacgagtgcttttcctttggtacgcgtcacctgtgtgccgaggcactttacgcatacttcttattgtcacaaagcacatgaaaaggatgtgtactctagggtaaggttttcataaagtaatttttactgtttcatcagagatattcttagatgaaactggtgatcttttttttgacggagtctcgctctgtcgcccaggctggagtgcagtggcatggtctcggctcactgcaacctctgtcttccgggttcacgccattctcctgcctcagtctcccgagtagctgggactacaggcgcccgccaccacgcccggctaatttctttttgtatttttagtagagacggggtttcaccgtggtagccgggatggtctcgatctcctgaccttgtgatccgcccgccttggcctcccaaagtgctgggattacaggcgtgagccaccgcgcccggcctggtgatctttttaataagcgtatggcatgagtcaccccatggctgctggtgagctgggggccttgccttgcctggtgctgaggggccaggagtttcacccgccagtacaaatatcaatactgtgcaaaaggcaaataacgtctgttattctgaagacagttctgacctcctaacctttctgtaaaggtcttgggagcccgcagtccatggtctgtgccttgaatacccactggtgagatgcagcttcatctcatccgcatggatctgggctgcgctcacgcccctgctcctttggggcttttctgaatgtgaggccttccctgacctccatatttaaaatcagccccccttctgcccctcactccagccctctaatttttccccatgtctctgtctctaacatgctctgtccattttgtctgcctccctccactaaaatgtaagctctggatggcagagattttgagctgtcttgttccttgctgtatccccagcaattaagagtagtatctggcatgtggaggtagtagcctgatacgtatttca

SEQ ID NO: 71953 - DNA, 1759 bp, Homo sapiens
taaaacaaccggcctttcttctctcccggttctggaggccaggagtctgaagtcaaggtgtgggctggcgggccgggctggctctgcgggctctaggggagggtccttccccgcgcctccagctcctggtatgtgctgccatccttggcacttcttggcttgtagacagggctccagtctgtggaaggcctgtgtcttcacacacgttctctacgtgcgtgtctgtctctgtgtccaaaagttcccctttcgtaaggacaccagtcatactggattagcgttcacctgaattacctcgtttaacctgacggtctctgcaaagcccccatctccaaataaagatcacactctgaggaatggggtttagagcccccatcgtgtctttctgggggtacacagtttgctccctaacaccctttccgggggtctggccgtgcctgcagtctccccatctgaccagtcgtgtctgttcccctgcagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcggtgagtgcggcccccgcccagccctgcgctcgattcaggcccctgcgtgccggcccgcgtgtctgaccgctgctcgctctggccgcccctccgcacacagagaagccggggctgtggactccccgagagctcttcctgtggacgggaaggcgctggccgcttcgcaggctcaggcctcctgctccttccctcccagggtgctcaggtactttgaagttgctgccattaaagatgacaggcagcctgtcctgtctgtgaccccgttgccaacattacggttctgggtgacggttctgggcccttccttccttccttccggccctgccttcagagtcagaagtctgggtggaaggtcagcgccccatctcagggggctgcccccaacaaggagtgatttatggtactgaggagccgcgcccgggagagcctggcccgcccctccacaccgcctggcctcagctccggcagtggccccgcgccgctggtctcgtccccagacagggcagtggacatggacttcgcaacggggcgaggtcgcggggtttgcccttgaattcccttgtacacacccacatgctctgccttcctcagggcgctgctccccgggggccggcggtcctccctgtggaggagtcatctcccagtccccgtggaaaagcaggctcggctggagggacgggattcctcggccctggtgcgctcatctgcaggcccagcctggcatagggtgagcccttcctccttggctgtcgatgccccgcaggcccagacacctcagccatctccttccacgcatatttcttgtgttttgttttttgaaattgtggtaaaaaaaatacattaatcatttttaagtatgcagtacagtagtattaccatatgcacgtttttgggaagctgatccctagaactttttcattttgcaaaactgaaactccatacccactgaagctctactcccctttcccctccctcagcccgggcaaccaccattccactttcagtttctaagagcttgactcctctcgggacctcatagaagtggaattatgca

SEQ ID NO: 71954 - DNA, 1087 bp, Homo sapiens
aagaattgcttgaacccgggagccagaggttatagtgagccaagatgacgccactgcactccggcctgggtgacacagtgagactctatctcaaaaaaaaagaaaagaaaagaaaagaaaagaattggcgtttgaaactttgggtagcacccaaaagatatcaggacagagaaagctgtgtgctgaaaggagagagctctggcagactcaccttcctttttattccatttgtccctttttgtgtcactgttttctgtattctgccatcacgtttcctggttgggtcttcagagtcccagttggactttttaatggaggcctccgaggtctgtcttacctgtgggtttttcagtgggcttcattaggatcctgcgttgctctgttgttgaaccaactcttgatgagccaggcgggggccactgccggcagcagaaaccttcctggcctgatttggcagcggctagacagggcctcatcaaggtctcgagagactgcagcttctcacacctcttctttcaggatgttgtctggtatgtgctctgtgattttcccagatgtctcaactgctgttgaggtccaggcaggttgttttccataggctggatgagaaggtgctttggttggtgcaggcaaatgggcttgttttgcagtgacataggagcttcgagactcagactggattggcccaacgtttttacttgcccagacactgtcctcggggcagggaggccagaggcactcagtggctattgatacctggcgttcctttgaactcctggaattttttcagttttttaccagagaagctcgtctttagactctccagctccggggatctggttttgtcctgggaggtggcccacacgctggccacttcacacctgactggaggccttagacgccgcccatagcattgcctgtgttccaggtatttgaagagtgagctggtaacagggcacctgtcgtttggaggggtagaatcagaaagtgctattgtaggctgtgatgacagggagaaacgtttttggatttccgcttctctggaagtagccgtgcttctctgcacctcttgttggcacccttcgca

SEQ ID NO: 71955 - DNA, 1030 bp, Homo sapiens
gaacttctggcctcaatgatcctcctgtcttggctttccaaagtgttgggattacaggcatgagccactgcgcctggccagtttttttttttctcttgatgtgaaaacagcttctattattttttctataaaaatgactacaggctgggtacagtggctcatgccggttatcccagcacttatgggaggctgaggcaggtggatggcttgagctcgggtgtttgggaccagcctgggcaacatggtgaaatcccatctacaaaaaagtacaaaaattagccaggtatggtgtcatgcacctgtagtcccagctactcggaggctgaggtgggagaattgcttgagcgcaggagttcgaagctgcagtgagtagtgatggccccattgcattccagcttgggtgacagagtaagaccctttctcaaaaaaatttttttaaataaaaataaaaatggctacagcttgttgaaaaaatcaggaaattatggagaagaaaatctctcagaaatttatgtggtcatagaaccattgttaccaattatagctattttattttactttaagttctcggatacatgtgcagaacgtgcaggcttgttatataggtatacatgtggcatggtggtttgctgtacctatcaacccatcatctaggttttaagccccacatgcattaggtatttgtcttagtgctttttttttttttgagacggagtctcgctctgttgtccaggctggagtgcagtgacgcgatctcagctcactgcaatctctgcttcctgggttcaagcgatttttcctgcctcagcctcctgagtggctaggactacaggtgtgcgccaccatggctggctaatttttgtatttttagtagagacggggtttcaccatgttggtcaggctggtctcgaactcctgaccttgtgatccacccgccttggcctcccaaagtgctgggattataggcgtgagccaccacgcctggcctcttttttttttttttttgctgaggcagggtctcactttgttg

SEQ ID NO: 71956 - DNA, 1030 bp, Homo sapiens
gaccccgcgggcgccggcacctcctgcctctgcgttcgcaaagttgtgccaggaccctcggcttcggggctggagcgctcccggggcccgtgggcccgacggcccgagcttttgtctgggcgccgcgcgcccgccgcccgccgtgggcagacggagacaggaaggggtgcgagccgcgggccggcgcgggccacccggaacccgggcgaatccgcacggcggcagcggcggcggcggcggaggaagccgcgaccccagatggcaggagttggcctcggtggattcagaaggaaaagcaacctctctcgggaccagggggagaaatctgtgtgtaaaacaaagccctgggtgtgtttacggcgtgaatttactccgggaaggttcgtgtttaggaagaaggcgaaaaaagttgaggttttacgaagtataatctgcaaaataatacttggaacaggacgcaggccaggtagacctgtccgaggaattaagaatgggatggattgagttagcatgtggcattggacggacttgggtgcataaaacgcttatttataatcctggtgggataaaggtgttgtggaatgacccagccaaaatgtggtaactttttttttttttcatcattaggtgcaattgaggaagtgctctataggctgcgcttaaatcgtattatacgtagtattaagtggttttacctaacaggcagttgatttttattttctcagctttgttggagaattttcaggcacgtgtgcgttttgaggtgttaggaatctcacggctctttcggattggattaacccagggacgattcaagtgcttttggcttgaacttttattaagtcagtagccctacgtgtgaatggctctcaaagtcttgttccatagatcacacttcaattcctgctttgaacattttcatttcagtttggagtctacttaatcctgcgacagtttgccatttctggggcatttggtcattcattcgtaggatgtcagtattctgtgtcagctgggctttgatgtctcc

SEQ ID NO: 71957 - DNA, 1021 bp, Homo sapiens
cggtgcagttgagagcccaggctccagttgcctacagagtcagatccaggtcctttcccttcctcgcggcaatgcgcctcagtctcctcatctgtcaagtacccaccttatggggctgtttaaaggaataagtgagatcatgtctacagcagacttaccactggtctggccctttgaacatgcttaaagctgctgttattgcctgggcccttggagggaggtctttctctggatggtattatataagagactctggtcttgaaagccactccctaattttctttgggccttcatttcctcacctgtgaagtgaaggggtcaggagagacccccttctatctctgaaatgatataaagggaggaagggagtttgtgttagcggcaacttttttgtttgtccgcacttttcctttccgctctttgagccatgatagttgagaattgtgtttttttacttccttaaattcagaagtgagcttttgagagtcctcaaaggaaatcaacctcaagataattcttttgctcctgattggtaatgggaaaaacctttgagaagaattcctgcttacagacatctctctctctctcctttttttttttttttgagacagaatatcactctgttgcccaggctggagggcagtggcacgatctccgcccactgcaacctctgcctgctgggttcaagtgattcttgtgcctcagcctcctgagcagctgggatcacaggtgtgtgctaccatgacctgttaatttttgtatttttagtagagacggggcttcactctgttggccaggctagtcttgaactcctaacctcaagcaatccaccctcctcagtctcccaaagtgctgggattacaggtgtgagccaccgtgcctggcctagacatttctcttgatgtattatgttatttgggtgactctatacccctgtaggcttgaccaatcacaatgaagtggaagcatgattggcatgttatgagcccctcctctttctttagaggctcctactgagtag

SEQ ID NO: 71958 - DNA, 1049 bp, Homo sapiens
ataacctgtaattaaagtcagtggccaaggatttcttttttggtgtgataacctgctcagctggctgagttaataatgcctaagataggctgggtgtggtggctcatgcctgtaatccctgcactttgggaggccgaggcgggtggatcacctgaggtcaggagttctagaccagcctggccaacatgatgaaaccccatctctactaaaaatactaaaaaattagctggatgtggtgccgggtgcccgtaatcccagctacttgggaggctgaggcaggaaaatcgcttgaacctgggtggcagaggttgcagtgagccgagattgcaccactgcactccagcctgggcaacaagagcaaaactctgtctcaaaacaaacaaacaaacaaacaaacaaacaaaaaaaaccctaagataagttcttgaaaagcaattgagatcttgagggctctggcctttggagtaattagaaagccacgcaggtactataaccgattgcttggcattaccatggttttatttctggaataatggcttatcctttagactttgtgtatttcccacattaaaggaggacatttgatcattgacattaggaataagttgtcattccccgcccccacccccccgacttctttctcgaatttggctttgttaggaagatggatgtatgctcaaccaaacgatgttgtcagataatctgtccctcaaatttaggtgacctattgaaaaagggacaaggttgggtttagacaggtgaaatattttcatcacttatttttgcttcatgttacaaagttgggaaggatgaaggggggagtcttaattacacaaaaagaaagtaggtgcaaacctgctctaaatcactgacctcttccaccaacgaacagaaacatctcatcaggaaagcaggatgaagagaatcagaaatactctcatcggctgggcccggtggctcacaccacccaacaatttgggaggctgaggcgggtggatcatttgaggtctggaattggagaccagcctgaccaacatggtgaaaccctg

SEQ ID NO: 71959 - DNA, 1050 bp, Homo sapiens
gctaaattttgttttttttgtagagatggggtcttactctgttgctcagattggtcttgacctcctgggcccaagtgatcctcccaccttgacctcccaaagtgctaggactacaggcgtgagccaccatgtccggcctccatcttcgttaaaagcctctcccggcttgtcagcctggccttgagtgcccaagtcgccatctgtcgctgtgccgtagactctcctgacttcctctcatcttcctttcattgctggggaaccaaattcctccatgatttccttggaccagtccacctctgtctttgcttacactccttccttctcggagtgcccttttccccatttctcccatgtagaaatcctctccatgccagccccaacccagttccctcctcaccagggagcctcctgagctgacgcgttccagttgcacctcagcccctccccagccgcctcaccctccttatggactgctgcaaggggcttctttgcctctctggcctctggttgggctcagcctgtgggaagcacctgcaggagaggggaaggtgggaggagagggaggcggggtattgatttctccagcttcctccctgtgggatcattgcaggttgagtgtttccatccatggcagaccacatctctattgtgtggccttcttcaacttttctgtttctggtcactgttccctccccttgcccattggccaaggggaggaaacagctcttcactgtccctgggcttggctgcatcgaggcctggctgttttcccttagccctgtttacgttttgtcaatcaaacctctgctaaactctccattatgcctcagtgtgagggggccttggtgccatccgattcctgccaagatcctggctgacgcgcttccacacttctctccccactgcacttctgcattctactctgcattttgtgtttgtgtgtgtgtgtgtgtgtgttgttgttgtttgttttttttgttgtttttgttttttttctgagatagggtctcactctgtcacccaggctggagtgcggtggtgcaatctcgg

SEQ ID NO: 71960 - DNA, 1052 bp, Homo sapiens
gagcaagactccatcttgggaaacaaaaaccaatacataaatacaaatgaataaataaaagcttcccaggtcattctctgcactactcggatgcatttttggggtcagatgcacctgtgggtggactccttccttcaccactgactagctgtgttgtcttgggcaagtctcagcctcagtttactcatctgtgaaaggtgctaacagcgcctttcttgcgggcctgtggtgagatgctgtctgtaaaatgcctttagagtgggccatcaatcagtgtttgctagtctagtttttcgtaattatggtttaaaagtaaccctgaatctgcccacccagaaggcttttgatgttcttgatagaaatcgaggacacgagaggaggagcagggagcagcggaaggggctgaatggtttagaggcatttcccatcccaaaattatcatttgcttgtgcaaaacttaatctcaagcaaggacctgaatgacttaatttctttgcaatagttatggctgtgctgaaatgggctggcacttcctgggggtttgggagtggggactgatttaagaagctgctttagctaggtaggatggctcacgcctataatcccagcactttgggaggctgaggcgggcgggtcagttgaggtcaggagttcgagactagcctggccaacatggtgaaaccctgcctgtactgaaaatacaaaaaattagccgggcatggtggcgcatacctgtaataccagctactcaggaggctgacgcagtacaatcacttgaacctgggaggcggagcttgcagtgagccgagatcgcgacaccgtgccacagggcaagaccctgtctcaaaaaaaaaaaaaaaaaagaagctgcttctcctttatctcttcctcctcctagacgggaggagtcctaggctctttggaggggagtgatggtttgcctgagaatgtgcccctgggggtttgaggccactgagaccatggggttctctactgggtcagggtaggaggagagggtgtcaaaggccaagggtgtcagatgtccagtgctg

SEQ ID NO: 71961 - DNA, 1068 bp, Homo sapiens
gttgaatgaatgaggagatgaatggggactggtaattggcaagctgtgcaggtggtttacaactgaattccagggggcccagctgctacaaagggggctggcagcttgggagaactgcaggtatccaagctgtgaaggagcagagaggaagcctctaactgggggagggcagaggtggggcaaaggtagaaacccaccccgttaggaacctgtaaagtggtctgtgggttgccacttctcgcaagaacctgaaaacaagtgtatcactcccagcctctggggtaggtaggcgaccagtgcttgagatttgtcacctgatcacaggggcttcccccgtggggaactccgattacatttggatttttaaagaagaaaaaaagaaaattccccagcgtcagcgtttataaaagggcaccagttcaggacctctgaagtcctttgcttacgtcttgtgatttagatcttgacttgtgttctgtctccctgcctctgtgttgcaggtactgtctgatgagcgtgaaaggttgtttcaccgacttccacatcgactttggaggcacttccgtttggtaccatgttttccggggtgggaaggtgagtttcagttgcctttaactttctatgcatctctagctgtttgtgtggggaggggctcacttacctttccctctcctcccacctccctcctccaaccagccctgccccaggagtactttaaggattactctttttttttttttttgagatggagtctcgctctgtcgcccaggctggagtgcagtggtgcaatctcggctcactgcaagctctgcctcctgggttcatgccattctcctgcctcagcctcctgagtagctgggactacaagtgcctgctaccacgccctgctaattttttgtatttttagtagagacggggtttcaccgtgttagccaggatggtctcgatctcctgacctcgtgatccgcccgccttggcctcccaaagtgctgggattagaggcgtgagccactgtgcccggctttttttttaaaaaattattattttttaagagatagggtcttgctc

SEQ ID NO: 71962 - DNA, 1032 bp, Homo sapiens
cccggtccacctgaaagcgaggtgcaaaaggcagccagagggagggggcaccaggagccctccgccttctaaccagctcagccccactccccgcattatctccactcgtgccggcgcgctgctggctcctccctgtccgtccccgccccattccttccctcttccccaaaccatggaaaggcaaagtgcagcggggaaaagaggtcagtggggtaagcatgtgttgcgggctccggaggtgccaaggtgcatgggcgtgagcggtggggaggctgcccatccgtgccacctggggctctagtgggaaggggcaagtggcagggaggggtccctggcaccgtcatgtgccaggcctggacttggaagccttctctgtgccccctcctccttcagctctgccccactcctaagagggcagcagttgagggaggaggggagccctgggtgtttctgcaaggaagggtgggctctccagccctccatagcactgagaaggggatggctgctggccagttcctgcttcccctggattcactccccggccccagcctccaaggtccaagttcttcctcctccttctcttcctctgtgcatggccaccacccccaatttaatttctcttaaattctttacttgtttataacagccttactgagacataattcacagaccgttcacccatgtaaaagtgtacaattcaacgggttttagtatgttcacagagttttgcaaccacagttaattttagaacattttcatcaccccagaatgaaaccctgtacccattagcagtcattccccattgtcctgccccccagcccctgacacccactaatctgctttctgtctctatagatttgtctactctgcacattttgtatacgtgggaccagacaccgcttggtcttttggggctggaacccccccttacttttctagctgcattgcttacttggcaatcaattgcagttttgtttttttgttttttgtgtgtgtgggtttttttttttttggtcatttaacttttcctgt

SEQ ID NO: 71963 - DNA, 1019 bp, Homo sapiens
gccaccgggggagttacgccaagttggagggaaaaaggtggggcggggccgccccgcctccgcagcccccaggcagcgccccaaagttggtgctgcaggtgcagcaaccctcctgccgccctcctccccggctggcccggccgtggcaggcgggaacccccaagggctcggttcgggggctcccgatgatctgccgccaacttggagggtgccttgctgcacagaagccacctgagctgggggcggccgggggcggccgaggcccaggcggaagccgggctagccggctggccgtggggagagcttagcggccgtggcaccgagccggggtgcccatgtgactgcggtgtgcttgggaagaggaagctgcagaggtcagtgcaaaggcgtcacgccagagcgagcgagcaaaccagccaggggggagccccggagccagcgcggggcgggagcgggggtggcctgtcgctgcaggggccggacaaagccgcgctgtcccagccaccctggctcccctaatgcctgcgatcgcggggtgggaggggcggccaggcttggcggccaggaaatgagggacaccgggaggaggggcctctccgggagaggcaggtctggaagaggcggccccagccccccgaggggcctctggatgctggagggtgacccagagggcagatcagacacagactcaacttggagaactttccctgcacactgcagccagcttgcagcgattcttttctgcacgtgctggggaggtcggggttgcggggagctggaggatggcaggatgggggtgacctggttagccaggcagccctggggcccgcagcccaagaggcgagctcctgtcctctcctctctgctgtgggtacccgcgggcttccagctgtcgacaagagaagcacgttctctgggctccgccccgcacatacttagattgttttccctagactgtgttcagctgaggcctggagggggtggaaaccaaggttagattaaaaaaagaaaaaaaaaaa

SEQ ID NO: 71964 - DNA, 1010 bp, Homo sapiens
aggcatttgtgactaaaaatacaattctcttatgtggatagcctggtccggccatcaggactgtctcctctcctagctcatttaatgccacatccttttctttctttttttttttttttttttttttttttttgggagagggtctcctatgtcacccgggctggagtgcagtggcgcagtcgtgattcacccttgacctcgtgaggtgaagcagtcctcccaccccagcctccctggtagctgggactacaggcgcgcaccattatgttggttgtcttaggggtgaaacgagatcacgcatgtaaacagctattattattattagcactggtaattagaacctgttaattaatattgctcagtagtcctggtggctggggtttggagaaagaatggagaggctggaatctgcccctgcagtggctatgggaccatttccagcccccttgtggtttgggagaagggtgtgggacagggtgggaggagggcggggactctggtgaccttgagtgtgggacttctgatttgagcgggatcaccacctgcagctggaggttagtggtgaggtttggctgtaacctctggactcctcctggagttgaggtgtgtcaggtagaccaatgggggcaaagctgagggactgggagacaggctgcctgggtgagcactgcctctgataggctggtgacccgaactggaggctggacccgaactcgaggcttgagtcacaagcctccctgtgcttatctgaaaacaggaagaatcctgggaatgactttttagggttgttgtgaagtttggattaagtaatccaggtaccacagtttggatgatgcggtgaatatgtatttatctcaaaggagtctctcaaccatgctatgatgtagggtacacagtcactaagccaccaggcaggggaaggggtggtaaaagaacatcttagaatgcagaattgaacttcagtgccgagcagtgaggatgctgttcagagaggggaagtgagttgttta

SEQ ID NO: 71965 - DNA, 1048 bp, Homo sapiens
atggtgtggaattgggagtgacgggcagggagagcggaggggctgagggtccagctggacatagatttaggaatgcaaaagagactgcgctgggtgacacagatttcagtttcataattaatgcctaccttgccttcctgagatactcagcatattctgcactttattgaaagattcctttaaatagtaagctctattaatatattgaggatcctatctaattaccaaaaaaaaaagtgaggctcacacactcatttttttttctttttttaaaaccgttgtctgtcactgtgcacacactgccagttttctaggaccatttgtcttggggtcgaattgtgtggcgaatagagctacggaccccgtcagtggtcatgggaactggttagaggattcgaacctcgttaggaaggaaattgtcatcttggaaatagtccatttgttttgctgaaaagaataccgatttcagttaataagcaaggtaaaaaaaatcccaccctgatgaagtcctccgggatcgtagaacagttctgtagaatttaattaagatgacattgtttctagaaatcatggagctttcatgctggaggccctggagggtagagatggctgtcagcacacctgagggaaggactgcagtagggaagagagaagtgacacagacacacgactgcttcccccacccggctccaggacttttggtgatgggcttaggaatttttaaaaattttttaatttttatttttttagagagggtctcactctgttgcccaggctggagtgcaatggcacgatctcggctcactgcaacctccgcctcccaggttcaaacgattctcctgcctcagcctcccaagtagctgggattacaggcacccaccaccacacccagctaatttttgtatttttagtagagacagggtttcaccatgttggccaggccggtctcgaactcctgacctcaggtgatctgcccgccttggcctcccaaagtactgggattacaggcgtgagccaccacacctggctgattttttctttttttggg

SEQ ID NO: 71966 - DNA, 1049 bp, Homo sapiens
aatgagagcatgtctcaaaaaaaaaaaaagacaaagaggctgggcgcggaggctcacacctgtaatcccagcactttgggaggccgaggtgggcagatcacgaggtcaggagatcgagaccatcctggctaacatggtgaaaccccgtctctactaaacaaacaaacaaaaaaaaaaaaccaaaaaaaaattagccgggcatggtggcgggcgcctgtagtcccagctactcgggaggctgaggcaggagaatgatgtgaacccaggaggtggagcttgcagtgagccgagatcgcgccactgcactccagcctgggtgacagagcgagactccgtctcaaaaaaaaaaaaaaaaaaaaaggcaaaaaaaaaagacagaggagatgggagagaagtgaaaagggccccgaaaaaaggctgtgggactcagagattattagttagaggcagatgatggctcattgattgattgagatgatggttcattgattggttgattgattcattcattcattcagcgcctatgtcttgagcccttgattggtgctgagtactggggtttacagtggggaggaaaccagaagaggttcctgctctcctggagcatacacagtgtatgggggagacagatgtaaatccagtaatcacagaaatagatgggaacttgcagctgcgatgaggcccacagtgccccagagctggtactaggggaggagattcgcccagtcaaggtggtcggggaaggtgttctgagctggagtctgaaggctgagcagggttacttaggtgaagaagactgggagggctttcctggctgtgtgtagtcgacttgggatggtggggaggggcaggggacctgtggaaggaaggccagtggggctggaacagaggcagtgaatgcagggtgggtgtggggtgggccaggcagaacagagggtctgcatttcctgtaagaacagctggaatcctctccaagattttgagcagagagaaatgtgttcaggtttgcattctgcaggtcctcttgttgctatggggattggatggcg

SEQ ID NO: 71967 - DNA, 1027 bp, Homo sapiens
cccctgccacctgggttgtgccttgcaaaaaggctcatgtgggtgtggctggctgggcttggcaggcataggggtgactaaggttggtaacgtggtttgtagagacagggatcttgctatgttgcccaggctggccttgaactcctgggttcaagtgaccctctcaccttagcctcccaaagcacttagattagaggtataagctaccgtgcccgacccccagcgactgtttcatctccttcccttctacaaagtgtgggtcctgtcatccctgcccttccttcctcccatgttgggactattgagcccacagtagattgggggagcgggggggcccaaggactctccggggaaaggggtatttgtgtctggctcggcagtggagaaatgcagtgctcacactggtctggctttcaggtagacctggtggactgggtggacaacatgtggccccagcatctgaaggagaagcagacagaagccacgaacgccattgcagagatgaagtacccgaaagtgaaaaagtaagactgcctggctggtggccagagctggcagggttgacccccaggcttggggaggtggggaggtgggaaggaggctcctggccatcagtgaaggcttgagcgtcacaaccgctcccgttcagaactgaaggactgtgcctgtgggggcacagctgggacaggagggacggggtccttcgcgtgtgcaggttggctgcaggggctctgatgtctgctctgggaccagctcccctggggatctgtgatctgaggaggagtgatggcagacgcctctgcatcggtgtgtgtgtctgtacgcaagggcacaactgtgcatacttttgtgcactccctccatgagacattgtgtcctgggagtgggcattttcgggggacctgcccacattggatgctttggttttggtgagcaatggggaaatacctacctggcattcttttgttccttggtgttgagaccttgaagctcatacccaaaataacctttcccaaacatagtccag

SEQ ID NO: 71968 - DNA, 1083 bp, Homo sapiens
gttttgccacgttggccaggctggtctcaaactcctggcctcaggtgatctgttcgccttggcctcccaaagagctgggattacaggcgtgaactactgtgctggccaggcctttttaaagttttttttttccccaagacagagtcatggaaaaaaagtcacccatgttggagtgcagtggcttgatctcggctcgctgcaacctctgccgcccaggttcaagcttctcctgcctcagcctcctgagtagctgggattataggctcgcaccaccacgcccggctaatttttgtatttttagtagagacagggtttcgccatgttggccaggctggtctcgaactcctgacctcaggtgatccgcctacctcagcctcccaaagtgttgggattacaggcatgagccaccgctcccggcctaaagttggtttaaaatcatagactttttccattttaagctcgggaaggagtcttagagttcttccagtcctgcttccccatttcacaaatgggaaaaactgaggcctgtagacaaattatttttgagttgctcagatagtgcttggcacatcagagtcacatgtaggtttgactttcagtgattgggagaacacaatgcttccaatagacccccagaagaaaagcaacttggggctggacatagatgggtgtggttccgggcacattgagttggatctcatgagagaggtcaaggccagagcggcaggtaggggaggcatccaattgccaggacagatagaaatgcagggagaggggccaggcgccatggtgcacccctgtaaccccagcactttgggaggctgaggcgggcgtatcactcgaactcaggcctcactgctatttcaaaacagtagagcagagtcggatttgaacctgtgaccagtgctcttgctaatcagtgctacctgtgtgacacggatgaggaacaaaatacaaaaccagtccagaaatgtgaggatgctggagaaggttccagaactgtgatgtggaagagttctgtgagctctcggaagagccgggctctggggagtttggggtcgcgcccgtgtatgtttcacatta

SEQ ID NO: 71969 - DNA, 1031 bp, Homo sapiens
gtcgggtgtttgggacgatgcccccttaggcctggggtccgcagagccgcattcccccatgggctctgccagattggatcagggaccccatgagccctgaagctgttgacctgaacccctacctgggccggagctgtctagcgctacagccttgataggttgaagccaagaattggggtcagggggtgacttcccttcaggcttctgggggagatccctgtcccctggcagtttgaagtgaggaaatgggtctcctcccaggcctgagacttggagagctctgttccttgtgggcccacccaattgagagcggaatctggggacgcctccagggttttggagaccttcacggcctgagtttctccctggctctcctactaggagggtggtgggggtcaccctccagatgttaaggtgacgccctgggttgcctctgaggcctccagagccctggccttcccagcctgcagccagtgtggctcctggttgaggaacctagtattgcctgcgggattggggttttgaacatgccctacctagccttcccaggcccttcactccttttccctttcagatatttcaatttcctttaagttacaaagtttctattttgttccccccacgccccttggaaaacccttccatccctcagtgagctgataacctggagtgcctccttccctcctccaggttctggttgagtggctgtggctgtggggttagctctgagaagagactcccagctttgcagttttgcgatttctcttttgtgcccattgcctcctggagcgctgggctccggtggtgaggggtgtttgttgggggagggaagaataaatttctcccagcctgcctggtcctagagcagggtgctagtcccagctgatttaaattttctctacataagtggaattttaattcctctcctttcttcccccatttttactgagttgagtcatttggtggatcctatgtgcaaacaatatgcaaactcttcctagtcatttgggaggaattctcagcccaggatt

SEQ ID NO: 71970 - DNA, 1054 bp, Homo sapiens
ccccgccccatacctcctcgggccgccgcccccacccccccaagcccgggccgagagcccccccaaatagcccggccgcgggctccgagcgcgatcggcaacaatgtttacgttccggggattatgacgtcgacgcctccccccccccacaactgctgaaaatggtttcctaggactttgcaaacggatctgcctaagtgttggtgcaaaactttgtagatctcggctctggcttgctttatttatttattttttggtttgttttctttggtcttccctccttcccccctcggccaaaatgcagggggcaggagtgttgacaattaattggtgaactctcctaaaaaaatggaggcagagaaagactctggaagaagattggtgtgtagctttttttttttttttttttttccaaatctgtatctggcatatgatagatctttttttttttttttttggttgtttctcgctgccttttctttccttttctgtattttgcaagaggaccgggaaaaaaatataataaattgcatgcaaaaggaagcaagctgcttactcctccagccccttgtgaggcttagagtctcagacacttaagtggggaggtggtatcggggaaaggcgtggaggggggctgagcgggctcggggttcgcccggaatctggggggctgaggggccgggcgctgggcggtggagggaggaggcagggggatgcggggagtggtgggggagtctccttaggaagtgagtgtgcgcgcgcgcttgtggggagatgaggcagctgctggtgcgttttggggtctccgatccgagctttgtggcgggccgtctgcctctcccccttccaagccccgattctcctccccccacctcctcttcttgcactggcgggcgggcggcgggggcggctggggtctcagcccttccatttcagctttccagcttccccggtagctcgggggcggctccagctttagaaatgccgccggcccccggttccggcttcccggctctgccgccgcggccgctggggctgctgttaccgccgagcc

SEQ ID NO: 71971 - DNA, 1155 bp, Homo sapiens
tactcagaaggctgaggcagaatagcgtgaacccaggaggcagaggttgcagtgagctgagatcgcaccattgcactccagcccagggacaatgcaggactctgtctcaaaaaaaaaaaaaaaagaggtgacccattgttctgccttcagttaagtcttgatccaagtgctctccgtctctcacttctgccttctgtgttgtgtttatctcaggctgctattggggcacccagcaactccaggctcatgtcactatttatagcattcccagcaaacggagcacattcctctcttccaagactctcactgggtcgcactggctatgtccaggtgcagaatggatcatgtacctatccctgaaccagtcactgttgccagggattgcagtgctgtgactggccaggctggagcctcacacccaccctgatagccgtcactgggagcggagaagctgagtgtcaggagaggaatggttcctcagaggaaaactgggagaccgttactaggaggatggacgggttttggtgacaagagtgggtgggtggtcttctacggggagatagaggggagagtggacaggtgaagaggatattaggccaaacctgccccaccagagagatgatgctggggaggacagaggccgggctaggagtgtggactcctgggttccggtcccagtgcagtcactgagcagccctgtgaccctgggcaagccatgtatcctctttggactgtttcagagtcccacgggggagtgggtgtgtcacagtggtgctgagtgagtccaggcaagactgggggttcccttggcccccatctctgaagggctctgagtgcgagaagccctgttgttttctctcagtctctttcctgccctgcctgcctctaagctgagtcttgagacccagttaaaacccatgacttgccacctggaggacctattttccaaaggtctaattccttttgggggtggccattggaacctcggcatgcctttttttttttttttttttttttgagacgaagtcttgctctgtcgcccaggctggagtgcagtggcgcaatctcggctcactgcaacctccgcctcccgggttcacgccattctcctgcctcagcctcttgagtagctgggactacaggcgcccgccacca

SEQ ID NO: 71972 - DNA, 1023 bp, Homo sapiens
gtttttttttttgccttttttttttttttttgagacagtcttgctctattgcccaggctggagtgcaatggcacattcttggctcactacaacctccgcctcctgggttcaggcaattctcctgcctcagtctcccgagtagctgcgactacaggcgcctgccaccacacctggctaatttttgtatttttagtagagacaggatttcaacaggttggccaggctggtctcgaactcctgacctcaggggatccacctgcctcggcctcccaaagtgctgggattacaggcatgagtcactgcacccggcccagctgggggctcctgatccacagttgggtagagcctggttgtcaccccccacccccagcatcaggggcagcctaggaaaaaaggagttggacccctcaaccctgtaaccttcaacatcccagagtgtgtctcaggccttggctggcctccccaggctcctctagtccaaacacatggcagcaacttgccaaatgcacccaggagcagccaactccctcctccccaggactgggaggtggaggctggggatgctcgtgggaacagtcattaaccttcatccctccagaactctcttgggactgggcagggaaatgggtccacacacacgcccacgtgctttctcttttttttccaggcagggtctcgcatacgcacatcgtaagaacgagactggatctaaaccatcactcttcccttgacggcccatgcaacagttctgggcataaattggcttttcaagcaacagcctgtgtgttccccaggagttatgctgaggggcaaggttttatgcagctctgtgttcacagcactaacagcaccaggtaaacaacaggcactcaataaatgttgacatgaatgatgcctgggaggtgtggctggtgaaagcagcagctaatctggatgccaccagcgcagaggtgacaggagattgttgcaggtgccacgtgcggtcatggggacagggtgagatgtccatctacttctttgtcc

SEQ ID NO: 71973 - DNA, 1059 bp, Homo sapiens
accaggctctacccaactgtggatcaggagcccccagctgggccgggtgcagtgactcatgcctgtaatcccagcactttgggaggccgaggcaggtggatcccctgaggtcaggagttcgagaccagcctggccaacctgttgaaatcctgtctctactaaaaatacaaaaattagccaggtgtggtggcaggcgcctgtagtcgcagctactcgggagactgaggcaggagaattgcctgaacccaggaggcggaggttgtagtgagccaagaatgtgccattgcactccagcctgggcaatagagcaagactgtctcaaaaaaaaaaaaaaaaggcaaaaaaaaaaaccccaaaaaacccagctgggggagtgctgagttctggaaacagagttcccatagcctctggactggatagatgaagtccagggctgggcaagggcctcctgtcactgagatgacaggagatgggcctggggcatgtagctcctggggagaagctgcctcggagatggtgtgaggtgccgcgtgtggcatccatcagcctctgcttctgtacagggcaatgtcatagctgcagtcctgtgtaagaatgtctggccaggcacagtgggtcacgactataatcctagcactttggaaggccaaggcaagaggattgcttgagcccaggaatttgagaccagtcggggcaacatagcaagaccctgtctctaaaaaaaaaaaaatttagctgggcgtggtggcgcacgcctgtgatcccagctactcaggaggctgaggtgggagaattgcttgacctgggaggtcagggctgcagtgagccatgattgcaccactgcactccagacagggtgacagagtgagaccctgcctggaaaagagaaaacgtgtgtgtgtgtgtgtgtgtgtacatgcatgcttattcaacacatttattgagcagctgcttggaacccagggtcacagatagactggtgaacaatagagacaagacccctgctcaatctagaggtgacataggggtgggagagggggcagatcacaggaagaaagg

SEQ ID NO: 71974 - DNA, 1043 bp, Homo sapiens
aaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggtggagatgggaggggtgggtgccaggctgcagcctgtgtcctcctgataggcccagccccctcggtggcctccgtgttcctgggggaaggaaggaaggagctggaggatacagtggtgcctatctcgggagcccagggaggcagggacacaggagtggcaggcttggggcgcccgcgtggaacagtgccaggtctacgtttacccactaccagatagactttttcatttcaagcataacttgagtctgcactggggagacactcgtggtgggggtggctgtgatgagggcacttgcgagtcccgacaacagacactggctcctgcacccacatcaccaccatgtcccaggggcagcctggaggggagtttgtggtcagagccccagccaggaaaggagagagttccagaatgttccaagagtctagccgcaggccccagacaccatgagctggagggtcgggatggggcagcctccctggtgcaatcggcacctgggcccccgggccctgtcagtgctgtcgtgaggtctgtctgccctgggtcagagcagcaggcagagccggcgcttcttctgccgttgcgccttcttcagagcgctgagagccaccttggcggcctcccggaagacgtcctccacattctcccgaaacttggcggaacattccaggtagagagcagctcggatctgttcgcag

SEQ ID NO: 71975 - DNA, 1081 bp, Homo sapiens
cctactttcaaacaaggcagacaggacacgacaggacggcggctcatagcacagactttggattgcagtggatgggaccagatcctggctccacttctcgctagctgtgtggccctgggcaagctgcttaacctctctgggcctcagtttctccccctgtaaactgggggatgtgaacagcgcctgcctccgagtcctaaggattgggagtagtcgtgtaaagtgctcaggtccacaggccatcaatactaatagttaaaaattattcttagaatcttgcttccctcagctccctgaaaggccactaaggcaccccagttgcagaggccaaaggtccgggaggcttcacagccacggctgtgccccagggtcttggccccggcccacctgcatgtaggtgatgggctccagctgggcggcccggagcttccgcagctgctccttgtccttcctcaggtctgtcttgcagccgatgagcaccatggggatcccgcggcagaaatgcgtgacctcagggaaccactgtggagggaggaggcgggatcaggggtgcggccgggcccagatgtggggccaccacccaggaggccggcctcaccttgatgaggacgttgtcgtagctggtgggattcatgacgtcatagcagatgagcacgaggtgggtgttctggtaggacaggggccgcagccggtcatagtcttcttgccctgaaagcacagagcagcgggggtcaggggacgtcccctccctgtctggactctgacgggtgaaggggaaggggccaggcaagtgaccctgccttagggcctcaatttcctcatctatacaatgggcagcaagccaggagtgctggcacaggcctgtggtcgcagctactcgggaggctgaggccggaggatcgcttgagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctg

SEQ ID NO: 71976 - DNA, 1128 bp, Homo sapiens
gacctcttggctccgctagtgcccggcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgaggtgaggcccgcagcggggctggggtgggggcgagggacgccccttaccctgagcccagagccccgaccctcagtccccagcgtcccgagcacggacaggcggccgccaccccggggcgccccctcgggaattccagagcccagcggggtgagggggggctgatccgggacgagtgaggggggtggacagtggattcagctggaactttggcccccgccggccccactaaggaccaacccgaccccctctcccgcagcactacgccccatcggtgttcgagaagtacacggccagcgtgaccgttggcagcaaggaggtgaccctgaacctctacgacacggccggtgagtgcgcctgcgcgccggggggcccgagggtccgcccgcccgaagggtttcccctcccgggcgtcccccactgggtgtccccgccctgcagccttggcagggccttggccggctcttcactcctggaggccgctcaggggcgctggctgcggggccctagaggccaagccctatacgtaagtggaaggtgtttggaggaggaggtgaactctggggccaccctcccagctctgtgctgagagcccacagctcgttcctctcctgtggttctagaaagcagtgggctgctcttgggcctcccatggttccaggattgctgcgctacctgctgtggtctctgcagactctgtgagctgcagatttgagtcccttggtgctcggattgcctgggctgtgtgtctgggtcctgtggttctgggatgctcccggctgcagatcagcctgtggctccagggctctgtggcctgcgctctgcagcctgaggctctggggtcctgtggatgcgagttctgtgtctgcagctcccaggattccacggcttgcagttggtggttctggaattgcgtggctacaattacttctgtg

SEQ ID NO: 71977 - DNA, 1856 bp, Homo sapiens
ccccccccccagctgcgagcgcgtagggccgcctgctgggccgccggggccatccatccccgtctgtcagcttctgttgtcaggcatttggggcgtgtaagtctctgccgaatatagcagcatacgagaggatccacttgcaagtatttcccagttgtgtgttcttcggcggggggagggccctgggtgccgcctacttctgaaagacacaggtcactgtcagaaagcccaactgtgctgtggccttccctccagccgcccccgtggggcatgtggggtgacagtgtgagccgtcctctgatgtctggctgctagagaggcaaagaacagagacccgaggttccggccacctttctctatgaaagggccttccttgacgcttctccaccttcctgggattgttttcttctccagtccccgaatgggcaggcctgtatataagccttgtttctagaaccagacaaagctggatttgaaacctggcgagccattgaacagctatggccttgcgtaagcggtatagcctccaagcctatttctccatctccgaaaacagggctagatcagtggttcttagtctggaaccggcatcagaatcacaccggaaggggggctcactgaaaatggaccaccgggcctggtgcccaagtgtctgattcagtgggttggtccttaggactggcatttctaacaagttcccaggtgaggtgaggctgatgctgtggtctgggaacacattttgagactccagcccctagcctggtaacacctggggttttgacgcagaagtgccacgttccacgcttggcacatagtaattgatttcattctaacgctagccgacttcatgtattgaatagtttcccatctcagtgtctaagaagctccacagctggagatggcggcccttggtctcggagcccccctccttgtgatttctgctttgtgattgctttgatgaaccatttgggtccaggtgctcctgatcacaccacctcccctatttgggacttgtgccccactcccgctgtgagggctacaccgagctctgggggcctgttcggattaacaaggagatcttgctaaaggtatcttggtgctaagttaagggagatagttcgccatgggctaggatctctcagtgctggtgaccttgggtgagtgtctccctgtaaagtgataaggatgcctgctggaaagggtggtgggaggattaagtgcgttaaagaggccctcctcccaagcttttagttggcctccattgtgatcgtggttattgctgggagtggctgcagggggtgggggctgggctgcctcagagcttccccccgcaccagcccacctgctgaagcacgtgtccctgcctcagggcaaaggggaatctggcgctccctgggaaggcggccaacgcggttctcctctggagtggttgagtccagctgcaggcctttccccatccacaggggctgttccatgatggggtcaagatttgggtcacccacccatggtccggggagaagtgactccccaaggtcacaaggccaccaccaatagagccaggatggggttccaggtggcttgacttggcagccagcgcctgtgcccatggcaccccctcaccccagctgtctgggttattttgggcttcctcccgtgccagctgtctgctggcatccctgcccgggactgtctggttggaagtaactggcgtggtgctgttggctcctcctgtgagggccagggctgggtcttcaatccccgatgagccgtgctgggtccagctcctttgctgggagggaagagtgttcctgcccagactccccgctgcccaagtacagcaagagggcgaaagcacc

SEQ ID NO: 71978 - DNA, 1040 bp, Homo sapiens
gcaaaaaggcggcttcgctgaggactgtttactgctctggatatagcaatggtgtgatcgtcattaagagacaaaaggcgaaaatacagtcaaatcaaacaaaaggcacaagacgcaccagccgcccaaccaccatagaaaataccccccacttaacgttggtgtttgctggaaccagctaggacttgttttccagttttaatctagtttcctgtgacggctttagtctctctacacaaagaaaaggtcttcctttccctcacccaccagctccccccaacccccaacaccaaagacgagaaaaacagggctgtttttcttcaaatagatcgattttcaaagaaagtgtacaagctacggggaagaaagctgactagcatttagtgctgtaaacattttcaaaagcataaagctagaaccttagctttataaagcaagatcgtctcaagcatcttaactggcttatattagacaagagagacaaagacatacatgcagatgaaggttcggaaaattaaggacatctcagcaacattaacatcaaaactgtactgcgtcaggacagaatggattgggtacttacaatgtaaaaggttttttaaaaactaaaagagtaacaactgctcacaattttttgttgctgccatttcgctagtcctaaagctatatacatttaaaacattaccttgttaaaaagagagaaggagttaataagatggccaggtttaagtgtttaatagaggaaactagatatatttaaaaatttattgttcagtcaagagaatacagattaagacagctccaagctccccccacccacccatagaacaaaaagaggaaaaaaaatatgtcatttacttaggtttttttggaattcaaaactgttaactgctgacatgaatggtgtgctatgacctagttatacaagacaaagatggattccaagtcataaggaaaaatccagatctttttaaaaagtcttctccagtcttccaactgtgagtccttgggcctgttgacaaatgttaaacacactgaga

SEQ ID NO: 71979 - DNA, 1017 bp, Homo sapiens
aagtgggtttttcctttgttgcaaatggggaatgtttttcctttgactctaccatccagttcaggacgtctcagtgtgtttaacatttgtcaacaggcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgattt

SEQ ID NO: 71980 - DNA, 1024 bp, Homo sapiens
gcgtggtggtgcatgcctgtaatcccagctacttgggaggctgaggcaggagaatcgcttgaacccaggaagtggaggttgcagtgagccgagatcgtgccactgcactccagtctgggcaacaagagcaaaactcaaaaaaaagaaaaaaaagactcctagtgaacacatgccccacacacatatctgagggccgtgttcagcctgggtgccaccagtttgaggccattggtgaggggtctggtgggggctggggcacagcgggtcctcaggcagcccctcgtctgtgtcccccatccagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccaggtaacacctgcaaccccctgggagggtggtgggagggaggcaggaagtcctcactgtcagaatcagcccgggcttcctggggtagatcgctgaccgtccccagcctcagtttcccgtgtaaaacgagatcagccggttgtgcctccctcgagcgagatgaggtgttgggtgccagcactgagcctggcactgcatggatcaacccaaaggggaacgactgctatttttcag

SEQ ID NO: 71981 - DNA, 1602 bp, Homo sapiens
ctgtgtgcctgacactgggttgggcgctgaggagtccttgaggggtttagctggagaaggacaggtcccgtgctcagactcagggctgtgagcctgccaggtatggagcacaaaataaggcactgagagacgtttggattgaatagtaaatgtctcgtgttcgctcacctctctgcagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctatatcctgctggcatggggggctctgcaccttctgggatgcaggaagtccctgctcacctctctgggccccaccacccagtctgtagcagcccgcggtgcccatgaaggtgacagcatgcaccaccgtcacttcccaagcagggtttgtgtcccggcaccatgc

SEQ ID NO: 71982 - DNA, 1051 bp, Homo sapiens
tacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacagatacgccgtctctcttgctctcctctctccctctcctctttattctttctttctgttgggagcacatcctgcttctgtggagggtggagtggtccactcagacactcagatcagcaggggtttttttgtttgtttttgagacagggtctcactctgtcacctcaggctggagtgcagtggtgcaatcatggctcactgcagccttgacttcctgggctcaagtgatcctc

SEQ ID NO: 71983 - DNA, 1035 bp, Homo sapiens
acaggcatgagctgtcatgcctggcccttcattccttctttttttttttttttttttttttttttgagacggagtctcgctctgtcgcccaggctggagtgcagtggcacgatctcggctcactgcaagctccgcctcccaggttcacgccattctcctgcctcatcctcccgagtagctgggactacaggcgcctgccatcacgtccagctaatttttattttttgtatttttagtagagacagggtttcactttgttagccagggtggtctcgatctcctgacctcgtgatccgcccgcctcagcctcccaaagtgctgggattacaggcgtgagccactgtgcctggcccttcattcctttttatggccaaataatattccactgcctggatatatcatattttatttatccatttgtcagttaatggacatttgaattgttaccactttttggctattacgaagcatgttgctgcgaacattcttgtacagtttttttgtggagatgtagttaaatttaattccacagccacttctgggataggtcctaatctttactcatttcatcctcgaggaaaagccttgcagacctgaagtaacttatgtcaggacacatagttcctgccaggtggaatggggtcctaaaccctggtcaggacacatagttcctgccaggtggaatggggtcctaaaccctggtcaggacacatagttcctgccaggtggaatggggtcctaaaccctggtcctaccagtcttctttaatggtcacaagtctgtaagttacacagaagctccctatcattcactaccccatctactgcatctaacccagtgccagttggcccacaacaaatacttgttacaggggtgaatgagtggtggtctgtcttcttaggacctagaacaagagcgtcactctagtcttggatgcgccctgtgcctgtggctgcttgtctgggggcttctagggcaagtgtcttgtctaaatgttgatcactgaataaaatgggcccagcctggcttgccttc

SEQ ID NO: 71984 - DNA, 1077 bp, Homo sapiens
gatgcccaactctttccaagagcacctcgcgtcccgaaccggtgccttcaactcggagaagtcaagagacccgcaagaaacttgcacgactgcacccgccgccgcgctctgggggctgggcaggggcagctgggctggctcccggggaacgcgacccccccgcgccccgcagaccggctgtctcccatggacccctcggcacctgcagcctccgaggaagggtcagcgcgcgtgtccgcacgcccgcccccaccgcgcgcccagagccgggggtcgccgtgcgcccttcgccacctccccaggagggcgtccggggcgtcccctctgggggcgcaggaggcccgggggcgctgcccggtggccgcggcgcccggaggccgcactgccggcggcggcggcggcgcggctccccctgctctgtgcagctgccgcccggcgcttgcgcactgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatggtaagcggaggcgcccgccgccagccgcctccccggccgccccgagcccgagcgcggctccagagagccgcggggcgcagcgccccggccgcctgccccggcccagccccgccgcgggccccgggacttggcgagggcgggcggacgggcgggcggcgcgcgagccgggtcacctgcgccaggctggggccgcggccgctgcccaggtgcgctcgcgcctgtagcccacctggcgcggcggcccggaggcggcgggcgccggggccaggcggttggagcggcggggcggcccccgccgcggcgctcggctcccgggaggggggctcggggccgg

SEQ ID NO: 71985 - DNA, 1035 bp, Homo sapiens
ttagctgggcatgatggcgtgtgcctgtaatcccagctactcaggaggctgaggcaagaaaatcgcttgaatctgggaggcggaggctgcagtgagctaagatcaggccactgcactccagcctgggcaaaggagcgagactctgcctcaaaaaaaaaaaaaaaaaaaaaaaaaaaagagcagtggggctttgttgctggttaatgtgtcaagaaagcccccccaaccagccatacaatcatagttgggttatgtttcattttcagaaatagatatgtgagctgggatgtggcctgtctcagtggcattccttagcatcccctttccctctggggactggggagaccccacgcccgactcaggactgaggttggattacagacgcagaattacaccagagggccttttcgagctgaggccaggaccccacctgggttcacatcctaactctccctgcaccttcccctggctgtgtgatcttgggctatttgtttaacctctagctttggggtttgtttagttttaatctgtagaatggggatggtaatgcctacttcataaactcactgtgaggattaaattaaataatctcttaaaaaccttggcatgggaccaagcacagtggctcacacctgtaatcccagcactttgggaggccgagttaggaggatcacttgagcccaggagtttgagaccagcctgggcaacacagggagacctcatctctacaaaaaaaacaataggtggttcgtatctatagtcccagcattctgggaggccaaggcgggcagatcatgaggttgggagatcgagaccatcctggctaacacggtgaaaccccatctctactaaaaatacaaaaaaattagccaggcgtggtggctggtgcctgtagtcccagctactcgggaggctgaggcaagagaatggcgtgaacctgggaggtggagctttcagtgagccaagatcacgccactgcactacagcctgggcgacagagcaagactcagtctaaaaaaaaatagattaaaaaaa

SEQ ID NO: 71986 - DNA, 1696 bp, Homo sapiens
ctgggaccaccgatgttggacgaggaagaggtataaacactggctgcatcttgtgttacccgactctatcgactccttcctccaaacgctttgtgtgtttcccccatatccagcagcggtcaggaccacctgttcggggtgactggaggctggctctgctgtttaatggttgtgtaacacctcggagcctgtttcctcctttataaaaggggaatgactgtagtgtctgcctccaaggggctgttgtggggatggagtgagataggtaaattgcttattccagtgcttggccagagttaggtgtccctgcacctggaggctggcccccttacaacctcatcgggaggcccgcccccatctcgggagggctttgggtgcctcctaagaagacttttggtgccacagctgttggaggtgcagtctgtccttctggcaagttggagggttttctggccggtcctgaaacattatatgagggagatgtcattgttgagggcagacatcccagacaccgttctgacatgtggattcggctctgggcagagattcctcttttccaagtcacagaaaatgcctggccctcaaagattaaagcgctttttcactctctctccctttcccactatgaatattaggtatttgctgcaggtaacttttttgtctgcgcaacagaacttctttggactggcagcagcggccttgagcagcttggccctgcagaaagctcatgatgggatctctgctgagttaagcttattgcattaggaactggactagcgggggctgtcttaggtctgctctggaggcatcgcgggagaagtttcctaggagactccataaacagcgtaataaaagagcaggaatatcttgccccctctcacctcacctttttaagagagctgtgagccccaagcatatccaggtttaaatgttatgcttttacctgaagttaaaatattagatacttagccctggatggcacccccctcaccgccgcggtccctggaataaacgattagtcaacttgttctttgttatgttcctgaaacacccctatttcctctcttgaaggtttccctgatgatctgttcccgtagctcctcctcccatcccccttacccggcacattggtcagtctctgctgattctctggtcttgccagtttgagctggcactgagcctgtaaagatgttctgctttttaaaaaacaaatggtgttgaggctgcagccctgtgcgccctccagtctctgattttgagcagttccattggaatcaaacccgactggatcgcagcatatgctatgcctcgagagagccttttcaaacaaagctcgaggtgaaagactggaatgtatcttattaagaaaacttaatcctcttctttattttaatataaacttctacatatacagggagagaatggatgagtcacggggggcatggactggaaaggtctcacctaagtaagctctgctaaatgaaaactaaatcagtctcccctttgcactcttgtttggataacctaaaggcttattaaacaacaccaaataattttagtaatggcattttttttttcatttctctcaaaaatattttggcagctggccgttgctcagttaactttcttgattgcaaaatgcaccatcagtttggtgcaagaagcttatcttgctctcttggctctctcactttcg

SEQ ID NO: 71987 - DNA, 1517 bp, Homo sapiens
aagtgttgtagaaagttaattttcctttttttaaaggatttatgtgatggctgatgagagcctgagctctcattccctagaatcaaattacttcttgggtagaaaatgtgcagtccagatagccagtgtcttaggtgattactttctgtattttgttggagttctgttgtctgtgattagaattcaggccacagggtgtgtgtttttggcagagttctctagccgcgtggatcagggaccctcgtgctggcctgtggaatggggtgctggtcacctcatgctaattccaggacttcgaggactggccgatttcagtggagactggtcctgggttccaggcagtgctaggtcccccgcgggggagatgctcttcttcactgtccggccagacgccttgaagagactgactctcacaggccagccctgccgtctttgcagccctgcttcttgtgctgccgccggctgtcacccaccaccctgtttcttttctggtacaaagctctgcccctgggagcttctggatccgcccagcttgagcctgccagggcctgtgtctcacatatggaccttgctatgagcttcctgggaccatcaacactcttggcggttgtctaattgaattagccccatgagggctaattgagagggagcctggctggccgggccccagagcatgaggctggctatgatctgggtttggccgccccagcacaaatgctttttccctccagaagtattaatcaggcacaccctgttgtgtgcaggcacggttctagcccttggggatacagtggtaagcaaggcgggttagtcctctcccctcatgggacttccatgctagtggggggattgtcagcacatcaggtcttatattgtgagtgcaggcaagaatagaaagaagatgaaggctagagagtactggggctggggagggtgggtggctactttaggctgggtagagaagtcctctgggggaggtgacctttctgggtgaactctgaaacctaagtgtcaagtaggagccaggcacgatggtcgttccaggtgcgggaagaggcccaggcagaggccttcgctggagtgagcttggcgcattgcaaggttagaaagaaggctagcttggtcagaatgtagagggcaggagtgagtggcaggaggtaagatagaagaggcaaggggccttgtgggccagggtaggaagttaggagatggttttggtggcactggggagtactggtttatctccacagggcggctggggccagtctacaggagacgggtctagggagggtgagagcaggagcgaggctaccagttgggcggttgtggagctccagcctcagactaggacggtagcagcgaggtggtgaggagctgtattcagggtggtttttggacttgctggtgaattggacctggcagatgaaaggaagaaaggaatcaacagtgactctgaggtttggcctgagcagctggggccattactgaaatgaagaaggctgggcaaggagcggtca

SEQ ID NO: 71988 - DNA, 1051 bp, Homo sapiens
aaacagtatataattatcctagcttggtgttttaaacaactgttttctagttgagtagcagggtcttttaaattgcctcttttgtctttaaattatcaagcagatctttctctgccttgaagcagaaaactctttcatccgtttgtagtcaggcttttttctttttaacacaactttctgtaagtgtaatttacatagcataaaatggacccattgtaagtgtaaggttcagtgatttttttttttagttgtgcagtcattgtcacagcccagtgctgggacattccatcacctcagtaagatccccagagtacatccatgttgtagcacacatcaggtgtttagtgcattttaatgctgaatagtcttcagttttttggatgtaccacattttgttttcttgacatgtttttgaggagacacctagtacctttgttattcgggtattgacttcccatttcctgtaataaggctcttatagaatcagctaggaacttccttacaggatgagaagaaggaaatggctgtgaggtatgtggaaagatgatgggattggaagccacaagacagtggtgcgactggttagcatctgccccttagctccttaagtcttggtgcccatgagggtggaggatgcaagagagagagggttagactggagtcatggttaccaaccttactcttcttccatggctttcttttttgaaagatattaccttaggaacaaagcgcattcagtaatttaaaaagaaacaaattaccagtatatgccacaacatggatgaatctcagaaacattatgttgaatgaaataagccttacccagccgggtgtggtgactcacgcctgtaatcccaacactttgcgaggccgaggcaggcagatcatttgaggtcaggagttcgagaccagcctggccaacatggcgaaaccctgtctctaccgaaaatacaaaaaaattagctggtgtggtggcacatgcctgtaatcccagctactcgggaggctgaggcaggagactctcttgaaaccgagaggcagaggttacagt

SEQ ID NO: 71989 - DNA, 1045 bp, Homo sapiens
ggtgtttttgataacgcctcccatgtttctaggcccctgttccattcatctctgttttcatagccctggttggctactttctctgaaaatgtctgcttcctcctccttcctgataggagcctttaccctgggaagctttcaagtctctaaaaatggcagcaattcttatcaccactttaggcacccctccttgtcccactgtcccaccctcccaggacaggtgtgtctaggggaatggtggtcagcaggcgcggagctgaacggtggcctgtttattctgagtccgggagtggaagctcctgcgctttcacatttgtccagcagcctgctgtggggcaggggtagaacgcacagtcagcagcatgcccgcaggactgatgccgcagcttgcatgccttgtggtgctctgctgacagacccccgaggctgtgaccgcggtgtccccgaggtgactcctgcccttggctgtttgttgtgcctgaggtagggagagcaaggctctgtgaaagttgtgattccaggtgtgagtccccccagctggcgtgagctctcacgtggaactggaatgctgcgggtacatgtccctgcaagttacaaaactggggaatgacttggtacatggaaggaagagctgactcaacgctctgaaaaatgatttaagtattttttgtcagattgagtccggagatgccgctgtctggcttggcagccttgcttctcagctgctcgcttgtggtgcttccgtgggcctgtctgtcctaacacttgcattgtcagaagagtgctcggcagaggagcttttggccgaaggcatgaggactttggttatgggtgttttttttgggcggacagggtctcgctctgtcacccaggctggagtgcaatggtgtgatcacagctcactgcagcgttgaacccctgtgcttaagcagtcctgtcaccctggcctcactacaggtgtgagccactgcacccagccttaattttaaaacataaccagggccaggtttggtggctcacgcctgtaatcacagcactttgggag

SEQ ID NO: 71990 - DNA, 1042 bp, Homo sapiens
tgcgcctgataagtttgtttgcttatctttgtttgtgtgcttgttgctggctccttggagctatgggtgtgtttgtggggtgttggagatgactgaccctgattggtaaaatagggatgaagcgagcagggcagggtgtggtgtgagaaataatgtcatctattcttccggtgccccccacttcttccccacagagagattttccttctgttccctgtcctagagggccctggggcagcagcttttaggttcttggaaagatggggagcagccacccccgctgagcaactcagattgaggttggggtgtgctgccctcccagacgactggaagattgacacagcagcgctctttcagttctttgttctttgttggctgggatcactggaaatatatcagtgagacttaaatgtgtcctgggagcttgagctgcccagtaggcgacccatggctgcagaacagccagctccagcaatgtgtcatcctggaagggcagctggcctgccttctgtcaggtcacatgggttggctgatgttggtttctgtgtaatttttttcctcctttttaacatggtgcctcaaagtcacggggacttgagggtagaaattaggagggaagggcaggtttttcagctggctcttgggctgtgcttgacaaagccatcattgttttgaataaagtgccagttggtgtggtttgcgtcgctccggtgctctgaaattggcttctcttcttccacctctgctgctgatcctgggggtgggctgggaggaggaccactggttccagagaagaaaccacttccctttgcctccctgctcagcaggagcagcgggaacagcgtcttaggacagtgagttaactactgcagagcagctgggcgtggtggctcacgcctgtaatcccagcactttgggaggtcaaggcgggaggatcacttgagcccaggagtgtaagaccagcctgggcaacatagcaagatcttctacaaaaattatttaaaaaattagccagtcatggtggcatgtgcccgtggcccca

SEQ ID NO: 71991 - DNA, 1009 bp, Homo sapiens
caaggccatgtctccaaaaaaaccaaaacaaaccaaaacaaaaccccaaaacaaacaaacacaaaaaccaaactattgcaaagcagattgctgtctcttggtccagagggcatcctggaccccagctgttggcagccagcgggcatcctggaccccagctgttgcagccagccttgcctcttggtaatgccctgggggcattgcccttccaggcatcgtgctgcgcactggtggccccagcctcacttggccctagcctgttccagacatgagaccgcctgctgtggtcaggttccccacctgctgtccctgcagcccgggctgatttccccaatgacctttttggtctgatgtctgtccctatcatgtgtatgatgcctcaggctacaaataaccagcaagagagaacagttcctctgctgaactccctcagggggaggagcagagcctcagggctttggctttctgatgccaacttaggttgcattgtcctacctctgcgcctccttggtttcctatttgtgtggctatatgaggaatagtcctcatatccaaatatatttgtggaaatcccagccctgaaggagtttagggcattaggagaactcccttggtgggtgggagggtggaggcggctcacatggaaaggtgtttgtagtgagaagatggagactacatttcctccccaagtcaggaacttcgtttctctgcatttgaatcaatagctctccaagtgcagtgtggttataccccgacatttgaagagccaggaaggaggaaatgcagagtgcaaaaacatgtcaggtctctgccccagacagccaagttcaagtgttttttttttctcaaagatggagctgcagtgcaggaggagtgtagacctggtgaacagagctgggtggtcaggtggcaagatgaaatgaccttatctacagggttagttattcagactgacttgggaagcacctctgtggtaccatttgaggagcacagaagaatctgtgaatgg

SEQ ID NO: 71992 - DNA, 1035 bp, Homo sapiens
ggcaggagagtggcctgaacccaggaggcagagcttgcagtgagccaagatcgtgccactgcactccagcctgggcaacagagcgagactccatctcaaaaaaaaaaaaaaatgtgtgtacaaaacccataagaaacaacatccagaagtggtcccaaatatatgtatctatgggaagggggtgtatgatgaagatggacctttagtttaatggggaaagatggattatttaggaaatcttacctaaagcaggatccctacatcatccctgtacattcattccaccaaataaatcctagttggctttattgaattgaatgtaacaagggaagccgtgaaagttctagaaggaaataggtaagtgttttcaaagtcttaggctaggaaaagccttgttaagtacgacacaaaaaacagaagcataaaaaaaggacttctaaattttgactatgttaatgaaaattagtgtttatcacagcattgtttatttgaaacagcacgtctgttaatataaatgtatgtctgtggggaaatggttaagtagattatgataaatgtgtacagtgaaatattctgtatataaaaataaaataatataaaactttattggcataagatgtctgtgacatataagtgaaaaatgggttataaaacaaacctgttcctacctatttaagcattatgttattcatatatatatggattttttggttttttctttttgttttgagacagggtctcactctgccacgcaggctagagtacagtggtgagttcacagttcactgcagccctgcagcttccacctcctggactcaggtgctcctcccacctcagcctcccgagtagctgggactacaggcatgtaccaccacacctggctaatttttgtatcttttgtagagatatggtttcgccatgctgtccaggctggtctcgctcttctgggttcaagcgatccacccacctcagcctcccaaagtgctgggattacagatgtgagccaccacatccagcctatttatatatttttat

SEQ ID NO: 71993 - DNA, 1075 bp, Homo sapiens
aaattgtcctcggggattcccgagcagctgcaatccaggctgcctctgctcagtaatagaagatggcagagactttggggagactctgctggactccagaaacaagatattcccaggctgctagccagctgtgtgagggccgttgccttatctgagctctgagttatttagtttttaatggaaacaagacccccgcagacacgcagggaaacacaaatccctatcagatcagcagccatggacgtggagacgtggcctttgtccctctgtcccagcgcccggcctgtgtagttggacttggcagtgtgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccaggtgagccaggcggggagactcagtgcggggctccccccgacccagagggatgttttcccatccc

SEQ ID NO: 71994 - DNA, 1887 bp, Homo sapiens
cattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaaaaaaatttagccgtgtgtagcagtgagtgcctgtggtcccagctacttgggcctgaggctggaggattgcttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccatttcccgcccatgggccctgaccacactcccttttctagaagtcaatcctaaggtttctctgctctggctaagaggatgtaaatttggattcttagagggcatggcaccccca

SEQ ID NO: 71995 - DNA, 2734 bp, Homo sapiens
tagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgtgcacgcgcgcgtgtgcgtgttgacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagcctgtgatgtgtggccttaaatactatcctgttgcagcagtggaagagatgggaaaatgaagagatctgagcatagcgatgcccttggccagctcactccttctaacctcgggaggtgtgataagcctgggatggaggcattgggtggggaagaggcccagggtgggagggcgattctagaggtgtgtccagaaagtcggtgctcctcttctaaagacaggcctccccacaaaggctgatgagaaaggcccagtgtggcgggttctgcctgtggcctcagcaggggctagtgaggcaggccactgctccaggccgcacccagatggacagaactcactggtgcccctataaacctcccgtttcctcatccgggacttgggcaaagagcaccaggcctgcacgcttgacagtttcacgtgaaatcacatgtgtccaagtgttcagtagcccgtggagctctgtgcttagagagtgcagtcatcagcacagccagcactggcccagctctgcaagatcctcagtcacagtgggagcctccaggcactgtggttcccctcctcgttattgacccaataccagagatgggaaagactagaaagctggccagtagaactgttcctttgttcaggtgctgagaaggtttggctcatcttcgtttaatgtagcagcttttctctgtcgttttcctgggccccgcgcccacccatctggcgccctgtgcctggacagggtgacccagcgagaagacacagccccgcacagagccatggggttgcttcaccagatgactgcccagatctggatctcgatgtagaatgcagtgggttgatacacaagctcttgtctgatcaaacccccatacctcccccgaggagacacaaagcaagcctgggccttgagagccgggggtcctagagggaaaggtgagcgcctcacagactcctttgggctggaaggaactcg

SEQ ID NO: 71996 - DNA, 1061 bp, Homo sapiens
aaagtgctaggattacaggtgggagccaccgcgcctggcttcttctctttttttttgagacggagtttcactcttgttgctcaggctggagtgcagtggcgcaatctcgactcactgcaacctctacctctagggttccagtgattctcctgcctcagcctcctgggtagctgggattacaggcacgagctactatgcccgtttaattatttttttttttttgtatttttagtggagacagggtttcaccatgttggccaggttggtctcgaactcctgacctcaggtgatccacctgcctcggccccccaaagtgctaggattacaggcataagccaccatgtccagctcccattcctgtttcaaaactctgcctccctcctctcctgccctcagcaggagcacttcagtttataagtcttctaggagaagtccccccacccccgtccattgcttgcattcagtgcaacggtaacttcaatcccattgcttcccgattacgattaggattacgcagcccaggtcccagcaagaggagctctctgtggctactcaaccgcaccccacacttcttccctctgtgctgccgtgcattcccctccctggaaggcccagcgctctctctccgctgtggcctggcccagccctccctgctgtgcccccggaaccaccgccagtgctccatttctgctgctgatatcaagtgcggtgtagctgtcagtaccacattttatctctcctttttcaggacaaggaccacatctcattttatctgtcatctatcatagcacacagcttctatgtcccaggcacttggtaatctcgcaatgtaaatcacatctgccgctgcctgccagtgtgagccctaggaggtagatgctttataatacccatgttagagataaggaaattgaggcttacagggttatatcagatatgccccaggcgtgagccactgcacccggccttatgttatcccattttcaacttcaaaaaactctccctatagagattgttgtcctcattttacacatgagaaaacaggtttacctttcaacata

SEQ ID NO: 71997 - DNA, 2347 bp, Homo sapiens
gagattagaggcgtgagccactgcgcccggccttcaaaacatgtttaagtgaaaaaattataaaacatatttaataccttttatgctgttacataaatttatagtaaaaaaatatttttctatgcattcctttacctttaaagattagtcaaggtgatgaaagggatctttgacaattttattcatgatctctttgtcaaaaagaaatggaagatgtgtagttaaaaaaattaatcaaaggtctgtactaaaagctctgtagctataaagatgattgtgagagttgcatttaataattgtgatgttggccgctgacagctgaagaaaaatgctgtttttgacagagtgtcagttaaatccagacctgaacatagaggtggaagtttctttgcagagagagaagacagggaggtcaaggaaagtgaccccaagaggggttcagatgacagccacagcacccccaggccaacgtccacatgagccttccgcgccctgcacggctgctcaacccgattgtcccatcttttggcaggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtcctatgcagcctccttccttgaggtcccagactgcagcgccccaggcagcgcccggaatgccccgacaggttcctggcagcatttgctacactttggctcccattcaacatatgctggacaagttagctgggttgcagtgtttttaatcagagctaacagggtgagaggagttaaaaaaccaagttggcattttctgtagagcagcaggcatcaatttcgcatcacgatagagaatcaacactgagtccactctcaggctgttgcccaacccacccttcagcgctggggtatggggccagctgcacacttgagcccctcatctgtcaccagtgcccacatggtccacatctcgagggggctgaggcggtgaaccagcaggagccccctatacaggcaggggtctaaggggtccaggggccgccggattccaaatgtcttgaagccagcatggtgcatagggctcagccccagccgcctcaggcacatacccacaaagacatcatcaatggggaagagttcagcatcttccatgatagcctggaggcgccgcactgtggctctggacatgacatatcctcccccaccagcatagggtgggtagtgggtggccctgtacattgagggtgggatgaagtatttgaccttagtgttcctgttgggcagggcttggcggatgacatctcccaccaggaggtcctgggctgggtcccagccatccaggaactctaacacgttggggacgtggacaaagacatcgtcatctccctttagcatgaaatgggcctgggggcaggcagccaccacccagcgctgcaggtgcagctccttgagcgtcaggttgaagaagtcctcagtgaagtcccactggaggatgtcatcaaactccctactctcataggcca

SEQ ID NO: 71998 - DNA, 1028 bp, Homo sapiens
catagcgagaccacccctctacaaaaaataattagctaggtgtggtggcgtgtgtcggtagtcctagctacctgggaggcaggaggatgatttgatttcaggagttcaaggctgcagtgagctgggatcacaacactatactccatcctgggcaacagaatgagaaatgaaaaacctacagtggctttccatgaggcgttcagaactaaaattaaactaagtctccctgcactccagggccctagtgagtctcatttctcttagctccaaccaggctagatccctggacatcccctgcaacaaaagtattattttcctcattgttacctattctccaggatgcgtggccattctgattctaggtatctttagtaccaagtctcacctctatttaaagcctttccttattcctgtccaacaactatctcctcctttttggccacttaatattgtatattttgatatttgatgataatcctttggcaccctcctgagtcatcagagcataatgggaagggtacagactttgaagtgagatttggtttgaggtctagatgtgactttttggaaaagttacataactattctgagcttccatgtcattgcttgtaaataagaaaggataataactggactgttgtgaggaacaagtgaaaacacattataaaatgtagcacattatgaagacttatcagaatattgagacaaaattagcttcttgtgagcagaggtgtctttcttccttttgtagtcctgtataagatgcctaatgaatacttaattatttgaaatataaagttcttgatttgttcatatcaaaaatatttcttgactgcctctttcaacatgcagtgattctgagtgtttgtactctgaatagcaaaaacaagacaacatagagtgattgattttttgtttttgtttttgttttgttttgttttgttttgagacgagtttcactcttaccacccaggctggagtgcaatggcaagatctcggctcactgcaacctccacctcctgggttca

SEQ ID NO: 71999 - DNA, 1391 bp, Homo sapiens
tcttctgtccatcaagggcccaacatccaactggtcccacagtgagcaggggcaactcttgcttcttcagcatctggccacttcgtttccatggtaactgccacgtgtacttttctagcagtctgtggccactccgtactcagctgaaaacactgtttcagccccctctctggtgacctcagccttctccaggtgtatctcttgatgatcttggagaccagcagccacagctgctgctactcctgcaggagactgtcaggctgtggtggggggcaggggtgttggaggagaagttgaaaatccgtgtgttctctgcccctctgctcctccatcttagcttctggaggagttaaggcaccaagggcaccaagtcaggttggcagttttgctgcccttgcccaagcctccagcaaaactagctggtcccctgctttgctgggtcccagccaggtgtgattttggttgttgattagtaaccacacattgtttttccccacctttttcattagtggaggtttttgttttgttttgtttttgtttgtttgagacagagtctcacgctcttttcagactggagtgcagtggtgcgatgtcagctcactgcaacctccacttcccgggttcagacgattctcatgcctcagcctcctgagtagctgggattacagatgtgcaccaccacacctggctaatttttgtatttttagtagagatggggtttcaccatattggccaggctggtctcaaactcctgacctcaggcgattggcccacctcggcctcccaaagtgctgggattacaggtgtgaaccaccgtgcccggcccattagtggagttctgatgggcacggtaaatattattaatgaaagagaaattctgtatacttttttaaaaatctctttaatgaaagaatgaagagtggcagagataataattgaaagattagtttctcatggaattaatttggccttgatattcagtatttggaaatgtcttaaagaaaaccattttcattgtagaaaatccttttttaaatacttgttatatcccagggagattagtttataccttccacctcaggcagtcatcagctgctttagagaatggaatccaccctgcccctccattttttggttcctggggctcaattcaagtctggtcaagtctccctggctggggattctgtcctgggaacagatactcagttgtagtctcatgtgtctgcactcacccaagactctatatacttgcttgctcagagcatagttagggcagctcctaaaaatgcattcagcagaagactgaaaaacttcaattgcttcatttgtatgcaaatagaaaatggtagataattatatattatacgcctttgtgtaagttcatttaatac

SEQ ID NO: 72000 - DNA, 1048 bp, Homo sapiens
gtcccagtccagcatctacagataattatgtactgttagtgtggttttcaggtattgtacagttgctttgtaaaatagtaaagcacttaggagtcagaattaaatacacctcttttgttcgttgctaatgtatgtagtaagaactcgaatcggattattccctgagggatagcagctttcaacttctgtgttgagaatctcagaagttaaaaaaaaatgttgagatcaaaatcagtattcttaggtttcagatgaactgtctggatgaaggcacttgtttattcttatgaatgataaaatgtttgaagaggtgggaagagaagcattaataataaatagtttttaattctgaaatgtttaaattttaggtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatag

SEQ ID NO: 72001 - DNA, 1032 bp, Homo sapiens
tatatacttttcttttctctttttttatgtaatgtaatgatttatttgtattccattcttcctttctcattaatataaatgaaacatcctctgaacaatacaaaaaacaaagcacttaaaatatcggccaggcgtggtggctcacgcctgtaatcctaacactttgggaggccaaggtgggtggatcacctgaggtcaggagttcgagaccagcctgaccaatatggtgaaaccctgtctctactaaaaatacaaaaattagtttgggcatggtggtgggcacctgtaatcccagctactcgggaggctgaggcatgagaatcacttgaacctgggaggcggaggttgcagtgagccgagattgcgccactgcactccagcctgggcaacaaagcgagagtccttctcaaaaaaataaaataaataaactatcttccctgcttgaggcactgctctcttgtttatttcaggaaagacacaatgctaagaccgtgggggagatcaagcagtttgtttcccagttgccccacatgcaggcagcaaggggctcgcttgcaaaccatacctcaattgcagaattgatcaaagatgtcactagtgagtatcctttgtaatgattgtttcagtctggggctacttgcacatacaacgtttgacacctaggtcatcaacaccacaatgcctcttcgggagagtcagctctgtcttaataccacgtgttcttctcagtgttaatgaagtatacatatgttaatagttaaggatattccaggcggggcatggtggctcatgcctgtaatcccagcacttcgggaggccaagacgggcagatcacttgaggtcaggagtttgagaccagcctggccaacatgatgaaaccccatgtctactacaaatacaaaaattagccaggcacagtggtatgcatctgtagtcccagctacctgggaggctgaggcaggagaattgcttgaacctggaaggcggaggttgcagtgagccgacatcacgccactgcactccagcctgggt

SEQ ID NO: 72002 - DNA, 1025 bp, Homo sapiens
tcaagtttagccagtgtgactgcggcaggggaagtcagcacgtgtggcaggtgataatgagactgaaatccccagcaaccccgagctttgaaattggtggcttcattatcaccttcctgcctcctcttgcccgttcactagtttattcttgctcaggctcctttttgaaacatgggaattcaacaagatcataaagtctgaatatttcaactttggaaacataaatgggaagtttttgaaaatgaatttttcactgagtatgtagttctagatttttttttgacagggtctcgctttgtctcccaggatgggtgtagtggtacaatcatggcttactgagctgctacctcccaggctcaagcaatcctcccacctcagcctcccgagtagctgggaccacaggcacatgccatcatgcctggcagagttttttgttgtttttttttctgtagagatggggacttcctgcgttgcccaggctggcttggaactaggccatgtaattccagattttatctttctcaggaattatgttcattaattgattttcatatttctgaagttacttttggtttaagttattaaattttgccaaaaaatattatcatcaccaagctatgttcgctttgttcatagactatactcaagactaaggttcaggccaggcacagtggctcacgcctgtcatcccggcactgtcggaggctgaggcaggaggatcgcttgagcccagaagtcctagaccagcctgggcaacacagcaagacactgtctctacaaaactttttttttttttaactagctgggcagtggcgtgtgcctgtaatcccagctccttgggaggctgaggtaggagcctaggaggcggaggctgcagtgagctgtgatgacaccactgcactccagcctgggcgacagagaccctgtctcaacatcaaataaaagactgagggtcaacagaaaaaatggatttttttctgttacacaggaaacttttcctctttatggtaccctctaaacataat

SEQ ID NO: 72003 - DNA, 1022 bp, Homo sapiens
agggtgaccagacgagcctgtaccacgcagccaaggggctgatgaccctgcaagctctgtatggaacgatcccccagatctttgggaaaggagaatgcgctcgggtgagaaccggctgctttgtggtggtaaaggagggcccttcacaccccaaaagggaggaggaacgggaagctccttacaaacaaattcagttgatcttaattatttatgaatactgtactcatgaatttgcctactgattaaaatgcacttataaccctccaagtcagtactcatggtgcttttgtcggcgtgcacagtggtgacagtttgagtaaccactgcgcatgttcccaactgaggcagctgacactccaccttcccatttcagctctcagactgcaaacaagtgtacttttcacagtctcactgtcatattttccacacgtgtgtactttttttggtgatttcactgtttaaaatggcctgcaaatgtaggactgaggtgcagtcgggtgtcttgtgcacaagaaggctgtggtgtgcctggcggagacattacgtgtgtcagagacgcttcgttcaggcacgagtcacagagctgctggctgtcagttcagtgtgagtgatcaacaattatgttaagtcaggcatctttaagcagaaacacatataaaactgggttacgtattgatcaattgacagaaacgttgagaccagaggctcccaggaacctaagtctgcgtttctcctaggaacagtggttccatcttcgctaatttagtgtttgcagtgacttcatagaacataactactgcgaatcacaagaatagactgacctgattttatgcctcattggcaaatggcagctgccttggtgcaagtgtcgggatgggtgccaacagcaaggtgcttttctagagctgcttatttctaagcaatgcactcttccagtttttctccttttttacttttttgattgtctttctggttttagacaaattttaaaatctgcttgttcccaggggggccccacctca

SEQ ID NO: 72004 - DNA, 1031 bp, Homo sapiens
ctgggattacaggtgcctgccaccatgcccggctaattttttgtatttttagtagagtcgtggtttcttcgtgttggccaggttggtctccacctcctgttctcgtgatccgctcgcctcggcctcccaaagtgctgggattacaggcatgagccactgcgcccagccatttttgtatattttatagagacggggttttgccaccttgaccagactggtctcgaactcctgacctcaactgatccgcccgccttggcctcccaaagtgctgagattacaggtgtgagccactgcacccggcctgagagtcagtatttatatgatttatctagccagcatttatttagtgcctgctatgtgccaggcagtggggataaaaaaagcaaaatggtccatgactcttaggagctcataagctaacaaatgttgcttcctttgcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagtaagtttggcatttccttaacttcaggcattaatttttgcccagtttatgagtgtgagcataccacagtactgattactgtgaagctgagtcccattttatatgtttattgatgtttaagattttctgttcaacaaattgttcattttctttgcccgttttttctttttgagtaattctttgtatattctggatgttgatcattatggattataaaagctgcaagtatcttcccagtctgtgacttgtcttttaactttgtttttttgttttgttttgtttttttgagacggagtctcgctctgtcgcccgggctggagcgcagtggcgcgatctcagctcactgcagcctccgcctcttgggttcaagggattcttctgcctcagcctcctgagtagctgg

SEQ ID NO: 72005 - DNA, 1057 bp, Homo sapiens
aaataatttttgtaatgaggactatgtaaatctggtactgacattgaaaaatatcgtatcctaaatcactaatctttggggaaagaaaagggtttcttttcattacaaagaataatccttgctgatgtcattgctttgcattttatttcttgtttttaatcatatttgaatagcaagttcagtgataagtgctgataattgtacacaagataaaagaaaactttacttctgtgtagcaatctagtttgaccttttggccaggtgtacaggatatatatatatcagactaaatgtaaggaggaggtttgcagtttgtaatagacttgtcatctgtaatctcttcacccaggagactttttttttttgcgagtgactaatttcatctgtcttttcagtacacattttcatgaataatttgttcattcatgtcactggaaaatgaaataatttcatcaagtttttttctcttggtctttaagttggacacacttaaagaaaacaacttgaaaaatgtggaagagctgaacaaatcaaaagaactcctgactgtagagaatcaaaaaatggaagaatttaggaaagaaatgtaagtttctatcctttgagaaaaaaatatggaatttattttaaattgaaaatgtgaacacaatgctaattacttaaaaattatttgagaagtacataaagtaaacgtatgcagactctattgcataccccagaagcaacatcagtaaccaccgtgaggtcagagccacagctaagttaaaggatcagaatgaaatgtgtactggctgatgagttcagttggggattcagatgtgactttggggtgggtgtggtggcacgtgcctgtaatcccatcactgggaggctgaggtgggtagatcacttgagcctgggagtttgagaccagcctgggcaacacagcaaaaccctgtttctacaaaaagtacaaaaattagttgggtatggtggtgtgtgcctatttgccaattactcaggaggctgaggtgggaggatcgcttgagcccagcaggttgaggctgcagtgagccat

SEQ ID NO: 72006 - DNA, 1456 bp, Homo sapiens
aaaatagaataatcactgaaaaactccacaaatgcttagaagaggctgcccatactgagatgagcctgaatgagaagatcacttacctgacttccgagaaggagatggcttctcagaaaatgactgaacttaaaaagcagcaggatagtctcttgaaagaaaaatcctcactggaaacgcaaaatggagctttacttgcagagagagagaattccatcaaagccataggagacctcaaaaggcaatgtgatcaagagtctgcaaacagaagtttagttgtgcaagagaatatgaaactcctcggtaatattgatgctctgaagaaggagcttcaagagagaaaaaaggaaaaccaagaactagtggccagcaagtgcgacctctctttgatgctgaaagaggctcaaaataccaaaaagaatctggaaaaagaacacactcacatattgcaagcaaaggagagtttggatgctcaacttaacacgtgttgttccgagaagaacattttgctgagagatggcttgaacctgcaagaagagtgtcacaaattaagcaaggagatccaggaaatgcagcagtccttaatcctggaacaggaagccagagcaaaggagagcgagtcatccttgtacgaaaacaatcaacttcacgggaggatggtgctcctggagcaggaggtggaggagttaagagtgtgtatcgaggagctgcagtccgagaagtttgtgctacttcaagagaagagcaaatcagagcaagaactggcagagataatcgaggagaaggaactgttgactgcagaagcagctcaacttgctgcccatataaagactctgaaaagtgattttgctgccttgtccaaatccaaggcagagctgcaggaactgcacagctgcctcaccaagattctggatgaccttcagcggaaccatgaggtgaccctggccgaaaaagcccaggtgatgcaagacaaccagaacctcctggctgagaagagcgaaatgatgctggaaaaggatgagctcctgaaggagaaggaaaccctggcagaaagctacttcatccttcagaaagagatcagccagttggccaaaaccaacagccatatttcagccaatctcctagaatctcaaaatgaaaaccgtactttgagaaaagacaagaacaagcttactcttaaaattagagagctcgagactcttcagtcatttacggtaaagtgagagggtcaagtattgagcacccagactgcttactaacactgtgcactaactcaagtggtgtaggtcatctttcttcatttctgcttatggaaatccacctcattaagtcagttgcttatatgtctcaagctgttcgttacagtctgaaagggggattctttactaagtatctcactgtagtagtctctccccatttgaaaaaaattgcaaactgtgaataaaaaggatttatt

SEQ ID NO: 72007 - DNA, 1134 bp, Homo sapiens
tttaaaatttcttgtgcccaggcatggtggctcacgcctgtaatcctaacactttgggaggccgaggcaggcgaatcacgaggccaggagatcgagaccatcctggctaacacggtgaaaccctgtctctactaaaaatacaaaaaagtagccaggcgtgctggcaggtgcctgtagtcccagctactggggaggctgaggcagaatggcatgaacccgggaggcggagcttgcagtgagcggagatcatgccactgcactccagcctgtgcgacagagcgagactccgcccccccaaaacaaaacaaaacaaaacaaaacaaaacaaaatttcttgcctagttctgatgttattaattacacataacttttgaaaataattacaattattaatagtatattttaatataacttaaatttaaaacattcttatgaaaaatctgacaccttatattgaaactttttctagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggtaaggagatactcagtgggcctgttggctggcaaggaaggcaagggatagtacacgcatgggcagatgactcattccctcattcggggtctctgcaggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagtacgtgacgcgagagaatttccttgtgttgtagcttgcctgagctctgtgtcgaggcaggaagggtgcttagaaagcagcagccagtgggaaaagttaaggtggcctctacagacgttacccttctgagtgcgtggcagggtggtacattacatttcctatggcttcaagtgttttgtgccagc

SEQ ID NO: 72008 - DNA, 1078 bp, Homo sapiens
actcagggaaagccgtgatccttacacgatcaggccctattatctctcggatttcatctgggacccccttcccctgttcattccactccaaccacttcagcctccttgtggtgctcagacgtggtgggtgttcctttctcagagcctgtgcacttgcttttccccattccctcacttccttcaggttttccctgaaatgtcagcacctcagggaagccccatctgagattctaacctccttcccagctcctttgcctgcatttattttccttcctcttagcacttaccgctattaattatatgatttattttcgttatcttgcttattgtgtgccttcttcactagaatgtgatttttatgaggacaagaattgctgtgtgaaaatattaccagagcaagaatacactcagtcagtttttgttgatataacacagccgtgctattctttttttctctatatatttagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaaggtatatgtgactgttgaaaagagtgctgaccttaggttaggctctgcggcaagctctaggtgggaggggagacaaaatgtttaggattgttacgttttaaagtttcccgtctctgttcttttctgttattacctcattgtgtccttgaatcaactatttaaccttctaaaatggattttacctatcttacttgtcaagaacaacagaattaaggaatacaatactatttatagaccttttggtgacttgtaaagaaaagataataaggccgggtgcggtggctcatgcctgtaatcccagcactttgagaggccgaggtgggcggatcacttgaggtcaggagttcgaggccaacctggccaacatggcgaaaccttgtctccactaaaaatacaaaattagccaggcgtggtggtgcaagcctgtaatcccagctactggggaggctgagatg

SEQ ID NO: 72009 - DNA, 1932 bp, Homo sapiens
atcagttaatggatatttatctgatttaagcttctttagaattggagatactaaagttggacttaagccattatcacagttagaaatatatattaacctataaacgttcataatagtttgctgcctgagatggggtagttattaaatatcttcagtgttaaagaaaataatcaggccaggtgcagtggctcatgcctgtaatcccagcactttgggaggccggggcgagtggatcacctgaggtcaggagtttgagaccagcctaaccaacatggtgaaaccccatctctactaaaaatgcaaaaattagctgggtgtggtggcgcatgcctgtaatcctagctactcaggaggctgaggcaggagaatcgcctgaacccaggaggtggaggttgcagtgagctgagatcgcaccattgtactccagcctgggtaagaagagcgaaactccatctcaaaaaaaaaaaaaaaaaaaaaaaaaaaaaaaaaaaaaagaaaagaaaatagtcaatgacttgttatttaaatgatctttttttctttggactgctgttaataggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggtttgtattgacatcctccattcttttcttttccatttgttattcttgttttgcattatgttacttttgagttgagatcattcatcttccaaattgctgatttaattaaattgcttgatgtccccagttgagtatagtgtagtatgttctgagtatctcaagtatggtttcatctgaggagattagagaaaataatggctcaaccatgtgaatttattttggttgcctgttatctgggtacctgatctatttatctctgggctatgctgtgacttctaatttaagcttagctccagtctataatctgtttaaaataaagaatgccctaacactatggtgttaagatgaatgaatgaacagaaactcaaaagatcggccaggcgcagtggctcacgcctgtaatcccagcactttgggaggctgaggca

SEQ ID NO: 72010 - DNA, 1044 bp, Homo sapiens
tggctgcccacaccatgcttaaatttgaggggcccttccaaacagcaactctgatttctttgaaaataaatgtatctttacagttaacaaagagcaaggggggcattttctgggttctagttttatggggcccagaatttaatggttcattaacaatttaatagatatcttcttcactcatttcatatacagccacattcctttagtcaatttttgtgttgttctcatccatttaaaaacaccccaaagtctcattagaagtttcatgtcatcatctaattcatgtgaaatatagcccatggtgtcttcaggagggtccagttaaaataatttacatcagcactgggttgtatagtctgtctgataaacttacttgaaattaatcaaataaagttatcttgaaaccctaacacatattgaagctttattggaatctcttttttgttgttgtttaattttttttatttttttactgatagcaaaagagccagatttctgaagatcctgagaatgtaagagggcacttaactgtgtggatatttcccttgttaacaaagattgatcacagattaaaatgcttattgatatactcaaacactaactgcataatctgaccttgggacattgaccttaatgtttctgtgcatgtggctttcaaagcaattacatttatatcctgaagaaattgtatgtaatgactaagctccacacattcatgtgtttaatgaataggccaacgtttgctttataaagaattttgccagaaaggggggaaaaatgttttttgtctggagacctggccttcttcacctaattcataatgtcttctaattttagtggaattattccaaaagagatgatatctggctggagcataaggcattctagatgtggagttgtgggaattctggggaagtttccaagttgtctaattttgcttcccatgagaggaaaggggattgtgaggctggctgctgtcccggagctgactggctgccttttcagtgtgcccccgccactggccagtgcctgccagtgcagctg

SEQ ID NO: 72011 - DNA, 1037 bp, Homo sapiens
gcagaggctgcagtctcggcactttgggaggccaaggcaggcggctgggaggtggaggttgtagcgagccgagatcacgctactgcactccagcctgggtaccattgagcactgagtgaaccagactccgtctgcaatctcggcacctcgggaggccgaggctggcggatcactcgcagttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggctgcagtgagccgagatggcagcagtacagtccagcttcggctcggcatcagagggagaccatggaaagagagggagagggagaccgtggggagagggagagggagagagggagagggagagagggagagggacccaattcattctttaataaccagaatgacttcatgttactgtgtgcgctgctgttgggctctacacatctagtcaagccttggaatctgatttctcatcaccaacctcatttcctgtgcatgttgatttttgcatcatactttcattttcgtcatgggaatagccaaaacccagctttgaaagtacatgatgttattgaaaggactgtaggacaatctaatgagactgaattgcctcaaactagtagtttgcacagagtccagcagatgtcgctgtgtttctcttgaaattttaaaacatcctacagtgcactggtgagtttgctcagcaccctggggcatctctgcacatggtttgggaaccacacatttaatgtattcaggaagaaatattagcaagagaaggtataatttagctatataatgaaattggaaggtcaaggtcaaatggttaaaaaagacaacaggagtttcttcctggtatgtttaagtaatttcaagaacaaaaggttgattcttttgtagttctcaagttgccgagttattaattgaggaaagatcctcgctgtaagtctgcatcctgtg

SEQ ID NO: 72012 - DNA, 1002 bp, Homo sapiens
ccagatatggtggtgcacatctgtaatcctagctactcaggaggctgaaggaggagaatcacttgtacccggaaggtggaggttgcagtgagccgagatcacaccactgcattctagcctgggcgacagagcgagactgtctcaaaagaacaaaaaaccacactttaaaacacctttctaagagttctgggctactcctgtgggctgttggctttctctagtttttctttaagttagaggttgtctgcttgaaaattaaatcgaatctcttatgatcttttgttttcagttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggtgagtagagaaacattctgaggtcatttcattgaactgagatataaacaccagtgagtggttgaaatacacacacatcagggctgggcgcggtggctcacacctataatcccagcactttgggaggctgaggcgggtgga

SEQ ID NO: 72013 - DNA, 1442 bp, Homo sapiens
tgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataatctaagactttgaatacaaaaaagtgattcacaggtaaaatcagtgtatataaccttttttttttttgagacaagggtttcactcttgttgcccaggctggagtgcaatggcacaatctcggctcaccgcaacctccgcctcccgagtttaagcgattctcctgcctcagcctccggagtagctgggattacaggcatgtgccaccacgcccagctaacttcgtatttttagtagagatggggtttctccacgtcgg

SEQ ID NO: 72014 - DNA, 1024 bp, Homo sapiens
agagaaagagcagaagatagaaaactcatgagtaagtgtgttaggagaattgggcgatgaatggccctgttagcagtgccagtgcttgatgggagagagactggagcctgggaggccccatagcagtcactcctgcctacatcttctgcttgcagtatgtagaaccttttttggccaagtgattgtgtcaggtagtcttttagtattcagtcttaattattttgcaggcaagtttagttttccttcaacacattattttccttaatttccaataaaggaaaagtaacataagaaggaaaaatgtaatttgagatctccactgtacctcctttgagcaaaatctcaaaacatgacattttccaaatacatgtgttttttttttccttctcttttcatcattaggaatggaggatctttggttccataccaatgcaggcatgtcagcagaaggatgtgtttgccaattaccttacttctaacttccaagcggtaaatagattttaagggtgtgctctataaaatgttgttgtgtctgcgagattgtgtaatttattagcgtcttacagccttttcttgctttgttatcttgacaaaccaaaaggaaaacagtggcaaaattcaccaattacctagacttaactccagattgtttttctacatcattttaagtgaagggatggagtttaattcattatctaccccgcttaacttgtgtttggtctggttgctcttttagccaggtgtgaagtctggcaacaagaggtcttcatctcactctagcccaggtagtccaaagaagcagaagaatgaaagcaactcagcgggatctcccgccgacatggagctcgattcaggtaggtttcatcctatggctctgatttctctcttttttttttttttttttgagatggagtctcactcttgtcacccaggctggagtacaatggcgtgatctcggctcaccgcaacctctgcctcccgggttcaagtattctcccgcctcagcctcccgagtagttgggat

SEQ ID NO: 72015 - DNA, 1106 bp, Homo sapiens
cggtcaggagttcaagaccagcctagccaagacggtgaaacccggcctctactaaaaatacaaaaattagccaagcgtggtggcaggcgcctgtaatcccagctactcgggaggctgaggcagtgggtggatctcttgagctcaggagtttgagaccagcctgggcaccatcgtgaaaccccgtctctactaaaaatacacagcctaccctggtgtggttgtgcgttcatgtagtaccagctatttaggaggctgaggtgggaggatcacttgagcctgagaggcagaagctgtagtgagccaagatggtgccactgcactccagcctggtgacaaagcaagaccctttctcaaaaaaaaaaaaaaaaagttctgtcctaatgatttagaaaaattataatgaaaattgaaagccatttcaaaactaattctgttgccatgattataagcactttccaggtgtacttttggtctggggagggatatatattgacatttagcaatattaacactttttatggtctgtaatagatggcactgatggggaaacagaagttggagaaatacaacagaataaaagtgtcacttacgatctctcaaaattggtcaactatcctggttttaatatatctactcccagaggaattccagacgtaagtatattgatttttttaaattatcatgtgatgtgatattattatgttaaagattggtcaaaatattaacttgttggctaggcatagtggctcacacctgtaatcccaacactttgggagtccgaggcaagatgatcacttgagtcccagagttcgagaccagcctgggcaacatagcaagaccttgtctctatgaaaaaatttaaaaactagccaagggtggtggcacatgcctgtagtcctggctactagggaggctggggtgggaggattgcagaggttacagtgaggtgagatcacactagaccctgtctcaaaaaataattagttaattcatatacacctacaaacttatatagcagttactatttaaaggaataaatttgttacttgtttacatttttaatttcttttatagaatctttctagaatcttaattgaagtcttata

SEQ ID NO: 72016 - DNA, 2760 bp, Homo sapiens
tagtcatgatccaatacagaggaaaaactgatctagcagagagagggaactgacgatgtagtttctacttacacatcaaagtctggctccttaataacaaggaagttattatttctaataattccatccaaaaataaattgttaaaacagttaatcataatcttacattatttaatgtctttttttctgcttaaatagcaatattttttgacttgttttctgcaggttgtaggaagtgtcctgtattttactaatttttgccttgataaattggggcaaccgcttctaaatgaaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggcaagaaatacaagtaaaggcaaaaaggtttgtgtggggagttgttttgttttacttatttacttttttaaccaaaatcataaacttttggcttgaaaagttcatgttctttactgctggtttactctaaggttaattacagattgagctagaattttaatccatacatatatgttaaatgtttaaatgaatcatctgcttcctggaattcattggttctcacctaatgtgcctgggtgggtggaaaggtataattgttgctgtcaatttgattgcagtcttataaccatctgccttctttccatgttacctaacggaaatatgatcaatgtgttcaccttgattcttcgttgttaaccactgaaaaaactcaaaagaggtaacagatcagtcaggaacagaagggttcttggttaaaagactctgcatagtactatttaaatcactaaataaaggagattaaagtgtacttcttgttgcagatattagtgatctgtgatcaacttgctttcttgtctctctgatacactttgctgtcatatagaattttattgatttgcttttctatttttattgacattataaaaatctttgtcttttgaccaaataggccaaagcctcactgtttcaattgtggttctgaagaacaccaaatgaaagattgcccaatggtaaatttttctcatgttaagaaaagtctttgaacaagagctttctaatgttttcaacacatttatgttattgtatgacatgaaggaactttctttgttcctttaatttgaaatcttgtgtcctttaatttgaaatcttttcaaatttgtgttcatattttaagacattaaattttttcagtaaataatttaaaacagtgtcctttaatttgaaatcttttcaaatttgtgttcatattttaagacattaaattttttcagtaaataatttaaaacagtactctttgtatttgagatgaataaacatgagaattaaattgtagagtttatcctaaaaacttgatttaatttatgataataggtaataaatagactgctcctttccttacgtatttttctaaaatattcaccctcttttacacttgttcgttatacattaaaactaaaataatctgtttacttgatctaaaaaaaagtatttttatttaatttctgaaatatttctgagttgcatgaaaccattcttttcaaatgtgtcatgatgtagcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattaggtactaatggcattttaccatagaaggtcatttttatttccctagcatttggaatgttctgtgtctctttgggctaattatcaggatataagtgtactctggcaaagccctaggtaatatacattaattcatttagaaacacttctttaaattttaatttatatttgttagacgtcatggtatgtaatataagcaagaaatgttttaaaataccagaatactatgtgttttcatgcaaataagaattcagtatttttcttcctcctttatttttacttagtgaggaacttcaagatgcactaggtgtgacagacaagagtcttccaccttttatctatcggatgcgccagctagggtacccaccagggtggctcaaagaggctgaattggagaattcggggcttgcactctatgatggaaaaggtatagtatcttaagttagagaagtcaccttaagtgtttcctttttttttttaattaaagaatcacaacaaaatgtgataggaatggccggcttctttaatgtgtgctaactaaaaaatatcatgatgatgtttccttggtaaattttacaaggaaggaataaaatttcagtgagtttgtagattatctgatggttttctgggcttgctcaggtactgtctaggccagagtatcacctctccagccagtcctcataagctcttatctttgtcagtaataataacagacataaatcctaaatgccaggagacctgtaaaatgtaaaatacagaaaacctctaatagtctagaacttctctcctagatacctaccctagaaagatattcacacatatgaaaaggaaattgtatgtatacaagaatctttttgtatcattgaatatgatagtgaaaaatctacgacaacattaaggccctaaaaaagaatggttaa

SEQ ID NO: 72017 - DNA, 1419 bp, Homo sapiens
tcaggtgagagaaactggtactgagactggagtgagagtggtgctgctgagaagtgcttagaacgtggatgtactggggaagtagagctgatcaaatgtgttgatgaattggacgcagaatatgagagcaaaagagtcatcggagtgactcaggtttttggcccgagtgccagtaagaatgtcgtcgtaaaaaattagccaggcgtggtggtgggcgcctgtagtcccagctactcatgaggctgaggcgggagaatggcatgaacctggaaggcagagcttgcagtgagccgagatcgcgccactgcactccagcctgggcgacagagcgagactccatctcagaaaaaaaaaaaaaaggatgtcgtcatattttctctgatggggaagactagaggaggagcaggtttggagggggctagaaatccagtgcagttttaagcaggtgagtttgagatgccactcacacgccccttgagagctgtcaagttgacacttccatatataaaattggaggttaggactgatcagaacttgaccgtaaaggagaacatatattcagggcaacttcaatctatgctcccagtgaaaaaataataattaaaaagtgataacttaggccaggcgcagtggctcatgccagtaatcccagcactttgggaggccaaggcgggcagatcacctgaggtcgagagtttgagaccagcctgaccaacatgaagaaaccccgtctctactaaaaatacaaaattagccgggtgtggtggtgcatgcctgtaatcccagctacttgagaggctgaggcaggagaatcgcttgaacccaggaggttcaaccggaggttgcagtgagctgagattgcgccatggcactccagcctgggcaacaagagcgaaactccgtctcaaaaaataataataataacttgacctttagaagtcgtaagcatacatattatactacataccatgggtcaggatgaaccacctgagtagtgaaagtggagaggaggactgagacctagggcactctaatacatggaagatagagggatgagaagagtctagcacagaagagcgaggctcagtcagcaaggaaagaagagaacggagaagcatgtcctagaagacaagggaggaagatgtttttaggaggaaggaagaattgtgtcaattgtcacagctaggttaagaaagatgaagagtgagaactgttcattgaatttggctgcatggaggtcattgggaagctccattgttaggagctcagcccagtgatatgtatagaagcattactggaaatgttcaagagagagggcagtgtcattaaaaaaatggaggccaggcacagtggctcaacacctgtagtcccagcactttgggaggctgaggcgggaggattgcttgaggccaggagttt

SEQ ID NO: 72018 - DNA, 1026 bp, Homo sapiens
tttatcttttccagtttcatatttatattggtgtttccttatgtacgtattaagaatctctgggaggaggatgtggaagacctgaatatatggactatctttgtgttgcagaaatagatggccaagagacagggtaggaagggagcttttcattatgtaacccttttacttctcttggattttgaaccatttacatgtagtatctatttaaaaattaagtacacagaatttttaaataaaatccgtgtattctttgcacaactggttggcagttgttatgccaatcactgtgttactttatcataattattgcattaacttggcaataatatgtaatttatcttaaggaatatgttcctgagtattacagagtcagtgatttattaaacttctgaaaaacaacaacattcacacttgaaatcttacagtaatgcataagacttcagtctattgaatgttttactctgtctgggttctgaccattttgtcctcttacacaggcaatatcatcaagaaatagaggaatttgtatcaaatttagtaaaaagatttgaggaacagcagaaaaatgatgtggaaaagacttcctttaatcttttgccccaggtatttcaaatttaagagactttaagattagtaagttatgcgtttcactgccaattattgggccacaaggatcctcttgaatcaaaaccaaaatgattaacaccgtttaccacttctccttctactggcttgcttttccgaagcctgactggtttagccacacagcgttcttttaccttgtggctcagactttttacattgcctgacttggacatgtggttttgggtagaaaattaattttaggccagaaaaaaatctaagtttctggggtttataaaagatggattccttttatctaaaaccaacaggcttgtggactatccttttttccctctacttgtttttagaaaattaattgtgtgcccaaagaaatctgagaagttttactatgtgaatattagatcacgcatttatgtttta

SEQ ID NO: 72019 - DNA, 1426 bp, Homo sapiens
aaaaaagtgatacctctgtataaaattattaaagtagatagaattggtgaaaatgtataattttcttgagaaaactgcaatatgtggaaaatgctatatgatttttggtacttaagaattttaaggctggtgagatggttcacagctataatcccagcacttggggaggctgaggcaggtggatcccttgagctcaggagttcgagaccagcctggccaacatggcaaaaccctgtctccacaaaacatacaaaaatttgctggatgtggtggtatgcacctgtggtcccagctacttgggaaggtgaggtgggattgcttgatctcgggaggcggaggttgcagtgatccaagatctcaccacagcactccagcacgagcgacagagtgagaacctgtgtcaaaaaaggaaaaaaaaagtataaaagttatgcgtttatatatacgtatgcaagttttacttaaatatcttctaagaatatgttctaacttctgttttagtggaatattggtgaacgatactaagttagatggacctatattacagattctattcatgaacaatgctatttcaaagtaagtaattttttccctttcctaaatataataatgtgtttatggaacaattttctctataaatatgctgttttcatttgtactcatatcatttttattattttacttaaaatgcccctggagttaaagtacaaggaatcatgattaagagcaaggacattggggtcacagtgacctgaatatctggactcttactttctatgtctgtgaacctgggaaggtcacagatctttgctgcatcatccgttacttcactggaaaacaggatagtcatagtaactacctatggggtagctacatgagcacctctaagagctcaataaatagcttctaataaaaatcatcactatcactgtaacaataacaatgatgttcaccatttctctttctgaatcaggtaactgagttttccatgttggccatcttcaaagcctactcacttgattatttgttttaacagcaaaactagacttttgcaaaccatcagcatcagggtttagggtgaccctgcgcattcctgcagtgtttgctcagagtgtaaggtctaaaatggtttgctctgtccctccttcagagcatggtcatagacatttcacatagttgcttgctccctcgaaagtcacttagtcatattgttgtcttcttaatgctgaccaaggtcaggtccataacctactctatcccagcagaagtggaacccaaggctctgagggttgggaagctggatgctaaatacagcagcaaggtgctgggcacaactgggctgtagcactagtgtccctctcatgcccaggttagaatcagtaaccctctagctcatgacggtctcatttctgcaccattcacctag

SEQ ID NO: 72020 - DNA, 1342 bp, Homo sapiens
aagcgcgatttattttttcagaatgtcgtcttcctccacattgtgaggaaaattttcagaatacaaaaagttgaggccgggcgctgtggctcaagcctgtaatcccagcactttgggaggccgaggcgggtggatcatgaggtcaggaggatcatgaggatcaggtggatcatgaggatcaggaggtcagcctggccaacatggtgaaaccccgtctctactaaaaatacaaaattagccgggcgtggtggcgcgtgcttgtaatcccagctactcaggaggctgaggcaggagaatcccttgaacctgggaggcggaggttgcagtgagccaagatcacaccattgcactccagcctgggcgacagggtgagactgtgtctcaaaaaaaaaaaaaaaaagttgaaaggattctacagtggacatccatagatttattccaaattctaaagttgttaacagctcgttatactgcattctctttatcacatagtggttgttgaaaggtttgacaggaacactgatgcttcaataatggttttggttcagtttgttagtctgttgaacttcaggatcgtgtcttagaatatatgttcgaaaggataaaaaccgtactttaattttgggtttcaaaagcctacccctgcaacaaaatagaagctcaataagtgtgtcatcctcaaaatatccgtgggtcttttgtctttataatattctgacaccaaaagtgagagaagtagtagttgaattttatgatttgcattgttaaatgagggcttatcttccttaacaaataataacatcaagaacttaaacgaaaattgaacattctgactcgaccgaggtatgagatttttgaaattactccatagttgtcccttattatttatcctgatattaatatttaatcagaatttcgttgtaaaaagtgtatgggatttttgtatcatttttatttgtttagcatactctgaagaaatcaaagtaatagttatttaattgtggggataaggtctgaattctcataagtggattaaaattgtaagctcatttattggatgaaaggatgaaacaaaatccagaaaatgtttacttaatgttcagaataggcaagttgttaacctagctattcctatttaacaaacatttctagaaagttagaattaagattacaatattggctgggtctggtggctcatgcctgtaattccagcacctaaaaaaaaaaattatagtataatgggccaggggcagtggctcacgcctgtaatcccagcactttgggaggccgaggtgggcggatcaactgaggtcagttcgagagcagcctgggcaacgtggtg

SEQ ID NO: 72021 - DNA, 1217 bp, Homo sapiens
atggcaccactgcactccagacgggacaacagagcaagactccatctcaaaaaaaaaaaatacataaaaaatagtgtcaagtgagagaatatttatctccatctgaattcattgtaatgttttatgtctgatttttagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttactaaaatagtatgttttcctattataagggacagacttggtattcagtatttgtcaaatattacatgtgttattcaggagatagattaatgcattaaagggatgtaagcacttttattttaataaagtgccttataacaagttctttgcatgctttttgctcattatccctttgaagtcttctccagcatagactataaaatattaaaatattagaaattttttttgtttgttttttt

SEQ ID NO: 72022 - DNA, 1455 bp, Homo sapiens
atagaaagggtaaacttaacatatagcttgtttagtgtgcatactcattagtgaatttaatgtatgcacactactcattcaacagagtgagtagagagaacaagcattcatttttgggctgggcatggtggctcacgcctgtaatgccagcacttcgggaggccaaggcgggcggatcagaaggtcaggagtttgagaccaggctgaccaacattggtgaaaccccatctctactaaaaatacaaacattagctgggcatggtggtgtgtacctgtaatcccggctacacaggaggctgaggcaggagaatcgcttgaacccaggaggcggaggttgcagtgagccaaggtcgtgccattgcactccagcctgggcaacagagtgagactgtctcaaaaaaaaattcatttttgttttgggatgaatttgtgtttcatgttactagttcctttgtaaatgataaatttgttcaactgctagaagtaatttcctaattgagaaaagttttcctcccattttattagattacagagaatggcaaggtttgcttgaccttttagttttggctttttgatttttattaaattgaagactttactaaggtctgtacaatataaaaaattatccgaatgtcttgatcggctggctttttctccctcaagaaacatttagataattctataaatttatttactacttaaccatgctctaaaatttactcagctttcaatatgttacttgcaagacgtaatttttttcacttgttaattggaactgcatataaaaactatgcccatttctgactagtcaattcaaaaatgtttaaaaccactgttgtggtattcttcaaatgtagcttatatcatcttaagaatgattgctttttcttcacatacggctatcggtggagggatgctaaaaatttaaaattttatggaagttggcttgtctctgtacatgcacatatagagagatatatacataatggttttatattgtgttattttaaattcattgaaattaattttgcaggttggaaagggcaaagaaattacaagaacagcgagaaaaggaaatggttgaaaaacaaaaacaacaagaaatagctgcaggtaatttttttcattcttttttagtcatctcgatttgagctctttcaagcttttttgtttttcacagggatttgctctgtcattctgactggagtgcagtggctccagcatagcgcatggtagcctcaaactcccaggctcaagtgatcctcccacctcagcctaccgagtagctgggactgcaggtcccacatcaccatgcatggctaatttttttcttattttttgtagagaggacctttcactatgttgccaagactattcttgatctcgggcttaagcagtcctcctgccccagcctcccaaagtgctgggattgcaggcatgagccactgcacccag

SEQ ID NO: 72023 - DNA, 1923 bp, Homo sapiens
gatgcacaggaagctttagctagaaggtgtgtatatttcttaattcatttgttccagttcgcctttaaataaatgctcaattgtgtggataagatgaattctttcagtaagagaatgattcacatactttagtaatatggtggcatatttgtgatctagaactatgtaaatagtttaattctcatcctaaacatttgcacaactataagattgagatgtctacaatttctgttttttccttcatgatttaactgatttcatttttctcaaatttagactcccaaatattttcagtttgcatttgaaactttttttttttgagtcttaaatctggttcaagaactattattttctcatctaagatgacttttcctttactttttgtttttctccctcaaatagacaaaatacctgaaacagtaagtaaaattttgtcaatattattattttgaagatggcaattaacagataatacattataagctaatttatttgatcttgtaagttttattcctggtaactatgggagaactttttttttttttttttaattttctgctgtttcggccgggtgcaatcggtcacacctgtaatcccggcattttgggaggccgaggcgggcggatcacttgaggtcaggagttgggagaccagcctggccaacatggtgaaaccccatctctactaaaaatacaaaaattagctgggcgtggtggcaggcgcctgtaatcccagctactctggaggctgaggcacgagaatcgcttgaacccatgaggcagaggttgcagtaagccaagatcgcaccactgcactccagcctgggcgatagagcgagactcagtctcaaaaaaaaaaaacacacacacacacacacacaaaaataaattttctgctgtttcaaagatgagtaatggtgaaaccacacacagcacgactatatattgaaatctgcaaaactattcaaagaactgcctcatagagaggcaaaaagtaaaataaaatccaagcacttgtttgcagtatttcccatattttgaaaaatagactttttaggttttgatttttttttctctcgttacaaaattaaggtgttttgttttttgagacagggtcccacccaggctggagtgcagtggcacatgatgacggctcactgcatacttgaattcctgggcccaagcaatcctcccacctcagcctctcaagtagttgggaccacaggcatgcctggctaatttttgtattttttgtagagaagacggggtctccctatgttgcccaggctggtaacacagtgtaacctgatgtgcttccctgggaacccagcctgacagaaactgcagctgaacagcagcaaaagtgtgagctcaccccttctttccattcaccttagtgaatggtattaattccaaatcttcaatggccattttaatgcaaccagttgtagtcacacgtatcttctttctgaaactagtatggaaataatttactataaaattggatttagtatatgctagattgtaatttcattaactctgacaaatattttttaagctcttatttacttgaatgccataagtctattctgtttgtgtttttggatttttttaaaagtgaagccgttaatagcatccaaaatgtcattgatatatagattacttggtgatctttcagataaagttttaaatgtagttctttaatttcagaatatgagattatttactaccttgaaatctggagaatttttttcttaagaaactaccatgtatagaccttttatattggtttcttttttggcttaaaggtcaggatttaaaactgtttaggaaatacatttcagatctgtgacctactttttttattttttatttttattttattttatttatttatttatttatttatttatttatttattta

SEQ ID NO: 72024 - DNA, 1076 bp, Homo sapiens
aaaaagatttttgagaaactggatcacagctcaaatttgtgaatggtttttggtggggttttttttggagaattctgtgggttgtgtgtggtatcagactcaaaaatttttagtagataaactaaagtattaagatttgtaactactgtgggaagagtattaaacggaagcttaaatttgggtaggatgcattgaacgcttttgacatgttaataggtttactatgttctaggacaaattatcaaacaaaatgaagggttcgttttcagttagtatttcctttgaaaatctcgcttatttctgtaaataatatagtgcagttacttgcttgtctttattgcgttactacaagtaactaattcatgatgtgtataaatgaaacaacacaacttttaagtaattacaaatttgtgcactttaatttcagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcggtaggtgaccatcatcctgaataaaatttaataggaccctcagagagtctgtttatcttcctcagtaagagagtattaaaattgtgagtcacaattctatttatagattatggtaaaattattttagtcattacctaacgtatgaagaacacacctaaccacttgaatagcattcacaggtattctcgtgattgataaatctcttgcgaagtgcaggtatgaataggcctattaaaatgcagttgttggctaggtgtcgtggtttacacctgtaatcacaacgaggcgagcagattttttgagcccaggagttcaagaccagcctgggcaatatggtgaaaccccatgtctacaaaagatatgaaaattagcctggggtgatgacccacacctatgatcccagctacttgggaggctgaggtgggataatcacttgagcccagaa

SEQ ID NO: 72025 - DNA, 6759 bp, Homo sapiens
cctcagatgatccacccgcctcggcctcccaaagtgctgggattacaggagtgagccaccgcgcccggccgggttctagtattttaaaaagtgaatttaaacatttatttatgccgtgccttgttcaataaaaagacagtcccctagagaagtgacctagtattcaatccagtgcttacctccttcgcagtggaaaaagatttgtctatgtttcgagccgttattagagtttgcaacaaaatgtaaattataagaaaccaaagtggctacctcgtagagccactgctggaatagaaggctgttttgcagttaacgtttatgtgtacacatagattagtactaaattaaagcttagaaaatttcagagcaattttaatactcagtttttggtaggtttttttcctggatacctgtattatgctactataaaatatcctcagggaaataaaagttttccatggcctcaatgaccacctatcattcctatttgtttagtgttaagatggtttttgttgttgctctgtagtatattttacagatgaaaatggttgatgatgtaagtttaagttagcctatgtcacagggaggtttctctgttgtccagctttgtgatgttaagcatgaagttaaagttagataaaccattgcctgaaaactgcctaggctaagcactagattttccatgagaaggttgttttcgattctagtcttgttctctgcaaaagtaaatgggatttgccactagttaaggaattctgtctctggcaaaagtgtcgtgcaactgagagaagtaatagcggtgcttaaaattttcgagatcacttctgtttaccaagtgtaagctgtacaaacactcagcaagtaataaatgagtctgaaatagtcctcaaggataacgatgaaaaaaaaaagtgtccagaattcattgtgaaaaatcagaatcatccttaatgatacagcattatttattagtagtaaacagtaaagatacggagatgcagtatcattttaagcaagtcagctaatgttgctggatctcatctgtgaaacgagaaagttgaactctattctaaggggtgaaaacctttcagcataaaaattttatggttccagaagtcacccagactggagaaataagtacatatacaatatgctggcatgagagcctccctggtagttaatttcttactgttctttttgtgccattgttagaggaataacacgtaatttatgtctttcatctcataattgaactgcaaaacctttctgtttttaatttatcattttattccctaagtctagcattggttttggcacatttttgacccttagtaaatacttgttgaagtaactcgacctctcacaacttcatttattaaagtacaatacacccatttattgtacttgatacttgtttaaaatttgttaaaatacaatacccccatttattgtacttgatatttggtattcattttctggactaactttcctaaaggaggaagttctctaatgtgattcctcctgctgaagactatcgattccctatttattcaatccagattccgtttgatgttatacgtgaaaagtccataaactgtttctgtaaagggccagacggtaaatatttttggctttgtgggccatgtgcagtctctgtcacattctttcccaggctggaggggcagtggcgcaatcttagctcacttcaacgtctgcctcatgggttcaagccattctcctgtctcaacctcctgagttgctgggattacaggcacgccccaccactcttggctaatttttgtgtttttagtagaagcagggttttaccatgttggctaggctggtctcaaactcctgacctcaggttatccgcctgcctcaacctcccaaagtgctaggattacaggcatgagccacaacactggcgttttaagtgcctttagttttaacagttcagtctttacagtgctatttactgaagttatttattaaatatgcctaaaatagttttaaaaaacgtaaaaaaccattcctagctcaaggccatacagaaacagaatgaggaccatagcttgccaacccttcctaagtaatcaattccccaggtgtatcaattattttattttcatgttatcttctctggtcagatagccgagcattgtctaccttctgcattagttgaaacttgtaaaatttatattgtaataattacttataaaatgctttaaagcagaaacaacttaatgttttcatagcccagagcacatgtgaggagaggcagaccatattttgcagcagcactgtgccaaggggctgttttcattaaagagggttaatgacattaagatgaggttctcacttaggtaagttaattttctgtttattattttataatattcttagggcattgttttaagattttatcgtcttgagtatctttaagctttaacaactcatttttgatgtttgacatgtatgctaatttaaaagtattggtaaagtcagctaaatgcattcacacatctaaaaaggactattttctctgcttgaatgcttattagaactacttggagcccttattcctcccccaccccaccccatgttttaaaagttatacaaatcatcgttagaaaattaaagatacatcagtctaaatatgtaggtcttgctttagtatcaggttcgtcatttcaagccattcagccttattagtgtacaaagcacatttagttacttggaaagcaggcattctgatttattgattgtggggggctatcttccctccctttgtccctcttttaagaaattgaaaacatttaaaatgtaattaagaactttaatcatttgtttttaaacttttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcaggtatgaattcttaaaggtggttacaactctcagcatttgtataagatatgtagacctgttgtataagaagacacatacatttagtttgttggctgggcatggtggctcaagcctgtaatgccagcactttgggaggccaaggcaggcagatcacctgagccaggaccaaaaatacaaaaattgacacactctcagcccaatgcaacctccatctgctgggttcaggcagttcttctgcctcagcctcctgagtagctgggattataggcgtgcgccaccacgcctagcttatttttgtatttttagtagagactgggtttcaccatgttggaacatatcaaatataattcaacctgtttattttctttagtttttatttttcttaatggcttacctctctctattaaacccccttatgaatttgctgtagactaggaaactagatgggctggtcagaatatatgtaaaatactgaaagtctatgaccgtttaaaagatgtatctaggctgctttatgtcctggtttgctcagattgcttgatttgtttcacatgtgtgttgtattaatgtagaataatcccacccgtgccatgaaaaaattagtcattggaagaagactaatgggagtcatttttctccagcattaagagttttttaagatgaaatgtttctccaactttgtttatggtgattattttttttgtgtattcacagataatgaaggaagaaaacacaggagccggagcagaagcaaagaggtaattaacactttgtagtgaataggtactttaaaatacttataaagtgtctggtagaaagatttgtatgaatataagacgttgtcaaggtaagtacaaaacttgaaatttaaaaggtttattgggttataaaataagcatgattttgattcatcatttttgaagaagatgtttatgtgaaaagtaccttcaaaactttaattttattatattgtgaaaatattcacaataaaaatttcatatgaagaatatgattggtttttttaggcctgtcacacagagcttccattaatctgaggtcccgagtctcctggtgcctgacagttgctcaggatttttaaacagcaatcatctttacatagcaataccctagatatctgtgcgctgctttttccttatgaacgataacaggagttctcttttcttttgcaaactagttcagtttccctaatagtagtattgaattttgaaataaaggtttgagtgagggacagctgaaaaggtggcggtgacaccaaaacttgaggaaaaagaaaggcagcagctgtattgcaaaggagttacttgttcacccacctgagaagacaaagaatgagccaataaggaagtgtagaagtagtagccagaaagggagaagagtcttgtgggggctgggtaagggactcctaaaacaagagtgggcagggacttcacctcttcccgtaatggaagctctgttaaatttttaatttaggagagtttttgtgaaaatgactattttgtttagctcacatgataacatttctataataaatcatactcagcgtgcttatgcgcgaagagactgaactgaagacgctgcagactcagatagcaaaataataagcctacttcatgataaggtaactattagtcattcaaactcctatttcccttaaatatatcttaaatcagttaagggttttaatgttttttttaaattaatagtaatgttatgtttgaaaaactggtttgaaataaactttaaaacctttagaagtttaaccacttaagacttttccagtctgcctcgttatagcaaaaccaaggaaaatttcttttctaagctcctatagagaactggcaatgaaactaaaatttaattgtgtctccaggtctcttatttttctgcaaataataaattatgtactatgatcattttcagataaatcatcatgcatgttccaaaatgattggccaagttttatttttaagaaacattaatcgtgagtggaaagaaacatgctatggccttttgggagacagtagtgtcttattacagtggaaaagtggtagcgtgggcatcagaaaaacatggggaaggttcagctcacccatgtagctttgtaactttagatcttagttatacataaaataaggggattaagttagaggatcttagtttccttccagaattaaaatttagtgattcagagatgtctaggattttaaactttcactacaagatgaatttgacagatcttcctgtagggaactgtagtatgtagcacttctactttggtatttggtaggatgagacttgatcatgcagttaatttgagctgagtctctgaatgcacatgtgaaggccttggtctttttaaagtgtgggggcagtatgtattgtgtgatggcatgtggattgttatacctagtttggtttctttaaaattgaaacatacagttgccatttctaccctaggtacatgaagtgtaatactcctctaagcctattgggatactgcaagatgaaaagtgattgcttcacagtttagacattgggaggaaaatcaagagctgtcttttagaggatgtagcaggcagtataactgtaaaagggacactgcatctctgtgtaaaataatttgaaattatagaaaatattagtacttagtaataattatatttagctacctaattgaaatgcgtttctggtgcactttttgtgtcattatctccattacttacttaaacttaacattatgtaatctggatttagaagttgatgtatatacatggtctgtattcttttagataaacataagggattcctcttttgtctggcataatggcttttcaatatttcaactttaaaaatcattgtttctgttgtattgaaaatattttggggaggaactacattttgggtgtttatagtaaaaaaaatagtaattacatctgcaacatttgggtgatgtgaaactagatcttttttttatttgccacacactcctaaggttactaatgttgcatcacaacatttttgtctactgatacccatactaactctctttgttgcactattttcctgaaagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaaggtaagtcatgttgtattataatgtagtaccttctaacaagttacataaagtttctcattgacccagcaacacccaaaaaaatcataattagggagtttttcttgttcgtttgtttgggtttgtggttttgtttgttttttgcctttgggctttgctttctcatcatgcaaaaatggtttccaagaatggggtgtaagggatgactaaatctcaagtgcctagatttcttttcccttttttttttttgacacggagtcttgctgtgttgcccaggctggagtgcagtggcatgatctcggctcactgcaacctctgcctcctgggttcaagtgattctcctttctcagcctcccaagtagctgggattacaggcatgtgctaccatgcctggctagtttttgtatttttagtagagatgaggtttcgccatgttggc

SEQ ID NO: 72026 - DNA, 1322 bp, Homo sapiens
aactaaagaggaacactcagatatctggcccctcttcctgactcacacaaccgcctctagtctttaggttccatgccacaggcttaaattggcgggagaacactaaacccaacccctttacggcggccggaagagaccaagattactttagactcgaaataggaagttgccccaccctgagttccgcccattccgttctcccgactgcgcattccgggggtgtattcttggccccgccctcttcacggtctttacactcccctatgaaagaacacccaatcaccgcctcgaattgcgttgttatagaaacttttgttaccgcccctttttctcccagcaagctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggtaggtaccgaatctgagtttaaagccagggatatttttctgctacgttccaacagtgggtgaacggctcccagaaccttgttcgtgtgtatgtgtgtagacaaaatggcgccgcggccttcttctgcgcccgccatcatggctgcctgctgtagggagggggaagtaaggcggtgttggtgggggtggggagccgcagggagtgcctttttttttccagaactttcctcctctcttccccaaccctacgttcctttcgcctcactgaacttcctccattttcgcttattcaccctggctagtgatttattctaagttttttttagggcctgagaatttgcggtggagaaaggggctggggaagagaaagacgatcaggagtggtctctgaaaagtattgggtcaaaaaggcagtgtctgtaaagggtagtgtgggagaagagagcgacttgtagctatttttttttttgtacgctcaatgagatgcttctagttgcataatttcaattagtgttcgtccgtgtaaaccttattattgtgtattaacgagctaggaaggtattgctgaaagggagtgaaaattcaacttaaaaggttgtggaactaccaattctgactgatgcgcggtttccgaagtggcccgtgatgtaatcaatttgaagtccgagaagcgttacagttaagtcttgtcactgaccttgttcctttaaatttaaacccttcgttggccgggcgcggtggctcacgcctgtaatcccagcactttgggaggccgaggcgggcggatcacgaggtcaggagatcgagaccatcccggctaaaacggtgaaa

SEQ ID NO: 72027 - DNA, 1131 bp, Homo sapiens
ttttctgaacttcatctggaatcttatcatcctatgatatccctgacaatctggcatctaaacctacactgtttgctgctattaaaggtttatttctaatgaaaggtttatttctaatgaaaacttggtataattaaaggtttatttctaatgaaaacttggtataattccaaactagacacacaaagtaatggaagctctaagatacattggtaagatcagaattgttggtttgtgtgcataaaccaatatgttgttctctggtaaccatcatagctctagttccatttatgttattggcccgaagtgtttagtggccacagcaataacaagaagactaagatgtctgtatatgttaatgttagacttttgtttttgttttgtgagtaagctttatcatttcccaaggaaccaggttctatgcaacaagataatatggtgtctaattttatgttgttcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggtagtgattattacactgactgtttcattcacagaatttttactgagtgcttagtagggctagtggcccacagtaaatattttgtgaatgaacatagcacttcctcagggaatcaagattcaatctcagattgctagaaattcacgtctgaataccctctgcatcatgtcaggatcagtattttcacaactgaaggattcttagttcctcttgatatttcatgcatacaaaaatatgtgtaagttgatacaaaggatatcttttttttttttttttgagacagattcttactctgtcacccaggctggagtgcagtggtgtgatcacggctcactgcaatctctgactcccagattcaagtgattctcgtgcctcagcctcccaagtagctgagattacagttgtgtgccaccatgctcagctaattttttgtatttttgtaaagatggggtttctccatgttggccaggctggtcttgaactcctggcctcaagaaat

SEQ ID NO: 72028 - DNA, 1067 bp, Homo sapiens
tatatgtaaaaggcctagaacaaagtttaccatatagtaagtgctcagtaaatatttcttgaccagctgcatgcagtggctcacatctgtaacctcagcactttgggaggcagagatggacaatcgcttgagctcaggagttcgagaccagtctgggtaacatggcaaaacctcgtctgtacaaaaaataccaaaaactagctggccatagtggtgtgtacctgtggtcccagctacctgggaggctgaggtgggagaattgcctgactgagcccaggaagtctagggtgcagtgaactggggtggtaccactgcactccagcctgggtagcagagcgagacgctgtctcaaaaacaaaacaaaacaaaaaatatttgttgactgaataaaagtcaacaacattcttttttactttcatcacatctgttttgcagtatttagaagtaacttaagtaatcgttggctttttaatgagaaaaatttgtattttttttgtattgaaaataaagattttcgaaggaagcttgtaactttgatttgaaattttcagatactgaagtggatgtagttggcctttgtcaagaaggaaagtttcttttggttggcgagagaagtggcaacctacatcttattcatgtaacatcaaaacaaacactactcactaatgtaagatcttgttgtattttaattttcattatttaaattctaaataatctcttagacaactaaaactctagcaaactattacttaacatgtgttttaaattaaagcaatgtttttttgaacaattaagctttgaaggtgttaccacagcttggatcctgagttcttggctctcgtgtaaatagaaattaacaccaggtcaaacagaaattttcccagggaatgtttagtaggcttgtggctcaaggaatctcaaggaaacagcgtatgggaaagggatcccaagtgctagctccccgaagggcttagctcttgtcattttgaggaagctgaggtgaaaaagggagtgatttgtaggcatgtagaggcagggaacttttagcgcctgtgaattttggtcgc

SEQ ID NO: 72029 - DNA, 1673 bp, Homo sapiens
catgttggccaggctggtctcgaactcctcacgtcaagtgatttgcccgtcttggcctcccaaagtgctgggattgtaggcatgagccactgcgcccggcctaagtgatatttttaaaatactgacttgccaggcctgtgctacgtcttgggtatatgacaagattgaagatttgttttccatagcttcatgatggagctagaaacgtaagagctattccaaacagtgagaagcacaggagagttggagtagggagaagatccccttagtaggaagagaggtggtaagggtaggtatggagaggtactggctggtgccctgaatctaacatgtcacagttagcgtattttggtcaggggcaaaacttaattctcaccagtgttctttgaactagattgtatttaatttcaccttgacacaaaacaggtgacttgtattattttgtagattaatactatacatttagcctgctttcttttttaatgcagcaattgagaatgtagacttcagtacagcaaaaaaggtaagaaaataaatccatattgtcctcttaaaaaaattacatttaatattaatgtagtagaatgtttctgtatataattggtctacttcttgatattttagaaattattatgatataacattttaataacatttctatttaaaaatacatttatgcccgtaatcccagcactttgggaggccaagggggcggatcacctgaggtccggagttcgagaccagcctgaccaactggagaaaccccatctctactaaaaaatacaaaattagccggggggtggtggcgcatgcctgtactcccagctactcaggaggctgaggcagggaattacttgaactcgggaggcagaggttgtggtgagccgagattgcgccattgcactctagcctgggcaacaagagcaaaactctgtctccaaaaaaaaaaaaaaaaatttataactgattgatatcaactgattttagtgattttatggagcataaatatgtattatatatatgacgttgttgtttttaattttgcagttacaaggacaaatcaagtccagttttatttctactgaaaattatcatactcttggttgtctcagtcttgtggctggagatttagcaagtgaagttcctgtgataattggggtaattgtttttataaagttttgttttttgttgcctaaagcattttctcagaaaaatgtttttgttttggttaaattgcaaaataatttgtaacatataaccgaaacaaggaaattataaaattaaggtaattaaaaataactcaataaataaatttctgtcttggaaaaaatattgcatctttactttccctagtctttacctgaaagtacagcatttttttcaattatgagagcagacaaaaacgatagaaaacaaaaccaaaaaattccattgttacagtacctgtgactttgtcactaatggaaaaacagcacattattgcagctgtcttgaaataaatatttacacaccactacttcaaaattatggtcatcatagtttttctaataggaagtgtaattactactggtgacatactcacagggactgctgattctactgctttttgttttttggggtttttgtggcctacattcataagtgaaagaaattctgtttcagatggagattag

SEQ ID NO: 72030 - DNA, 1050 bp, Homo sapiens
aaaaaagaaagaataagacatactatttgattatacaagagagtcaataataacttaattctatatttaaaaataactaaaagagtgtaattggattgtttgtaacacaaaggggatggataccccactctccatgttgtgattatttcacattgcttgcctgtatcaatgcatctcatgtactccacaagtatgtacacctactacgtgcccacacacaagcaaaaaagacaatcgtggataagaggtttatggacaaaataaatatttaaaggaaaaaaaagaaatcgtggaggtttttagttatgtcagtgattatccattaagaatttcatttttaaataatctatttcagataattcttgcaaaatggttggaacaagcagccaggaaccttgaattaactgataaggtaatactgatttaattaacagtaaaaagacattttgcacactcccaacagcataaaacattgttttgaactgtctgtaatcttttttaaaggcaaattggccagaaaatggacttcaattggcagagatattttttacagcagaaaaaacagacgagttgggattggcatcttcctggcattggatttccttggtatgatgtgagaatggatttttagtaatgaaacagtcagtttacctgaaagggtttgtctgcatgtatgtgaagtatctggaaatatatctacttcttaaattttctgtttttttgtgccttttttttgttttgtgcctttcaaatccatatgtaggaaaatttgctttttctttctttctgatttgtgttaaaacttcaacctatgtttttaatttatttatatatttatttatttattattcatttttgagacaaggtctcactctgttgccccagctggaatgcagtggtgcaaccatggctcactgcaccctcaacttttgggctcaagtgatcctcccacctcagcctcctgagtagctgggactacaggtgcgcatcaccaggcccgactgatttttgtattttttgtaaagaaggggttttgccatgttgcccagg

SEQ ID NO: 72031 - DNA, 1102 bp, Homo sapiens
gcttacagcagaaaaaatactcttctgaatttttctgaatagtcaaattgttctctatatgtgaaaactgaagaaataaatggttttccagtgagtggatgaaatattctcaaactaccatgtggttgatgtaagacctgctgattagactgtgctgttcacttgcatgcatcgtaaacctgagggctgttccttgtccatgcgtgcatcttttgtagctcatatttgatgccgtgctcaagatcatgtatgcggcagtggttccttggagtgcagctgtggagcaactggtgaaacagcacctggaaatggaccatcccaagtaagatgactgtctacgaaacaatgttgttatgctctggagaaacattgtgttttgagttgacgttcatttatgtttctatattgtttgctgtgtcccatagtacttcataaaaaagacaatccatgttaatatgggtaaatttgctttcagagtcaagttattacaggaaagttacaaactaatggagatgaaaaaacttttacgaggctatggaataagagaggtaaatctcttaaacaaggaaataatggtaagtacactcttcgaagagtcttttttctctttcatttctggggcaatatggaaagcttaatgaggaatttatattctaggaggctaatagagctaggtttttccactacatttcttttgttagatatgatgttaataaggtgttcagttatttatgagagtatttattctttttgacatggagtttcgctcttgccgcccaggctggagtgcaatggcgcgatctcggctcaccacaacctccgccttctgggttcaagtgattttcctgcctcagcctcctgagtagctgggattacaggcatgcactaccacgcttggctaattttttttttgtatttttagtagagatggggtttctccatgttggtcaggctggttggtcttgagctcccgacctcaggtgatctgcctgcctcggcctcccatagtgttgggattacaggcgtgagctaccgctcctgggctttttatgagagtattaaagacaccaaataggccaggtgcggtggctcacacccgtaa

SEQ ID NO: 72032 - DNA, 1037 bp, Homo sapiens
cttcatgaaaagtcttcctttattcctttatcagcaattcaagaacagatgcatgcaaaatcaacctatcatttgtttatatgctcacttactatttagtgctagactagatttccttagcgtctcgcactcattgctcatttttctcatttatcagttgcttatgatggtggggagaagccatttgactggaagttaaataaaacagtgaagaaagtaactttccagggaaaaaaaagaagctacaatttacttcagaaaaataacttttttgtaacacataaacttctgttttctacctcctgaaagaataattagatttttttcaaattagatcttttgtacttagttactgtatattatcatttgagaagaactactgaagacttgagatgagagaaccaaagctaattaaaatttcttctttttaaaattctgataatatgagaatttgcatgtctgctataacttttaaaaatttaattacagacaatctgcagaagaaggacgaatgtgaagaaatgttgaaactatttaaagaggttgctagcttacaggtaaacatattgagccatgttaaacattattacttgaccaatcagtgcatttttccctccttaaagttttctgtatggctgggcgcagtggcttacccctgtaatcccagcactttgggaggccaaggtgagtggatcacaaggtcaggagatcgagatcatcctggctaacacggtgaaaccccgtctctactaaaaatacaaaaaattagccaggcgtggtggcactcacctgtagtcccagctactcgggaggccgaggcaggagaattgcttgaacccgggaggcggaggttgcagtgagctgagatagcaccactggactccagcctgggtgacagatcgagactccatctcaaaaaaaaaaaaaaaaagttttttgcactagcctttagggactggagatactggttttccttctctctctctctctctcaacagctgtattgagatgtaatttacataccatataattcatcc

SEQ ID NO: 72033 - DNA, 1058 bp, Homo sapiens
ccaacgctttgggagaatgaggctagaggatcacttgagctcatgagtttgagactaccctaggcaacatagtgagacctcgtctctactaaaaataacaaaaattagctgggcgtggtgatgcgtgcctgcagtcccagctactttggaggctgtagcaagaagatggtgtgagactagaaggtggaggctgcaggagctgtgtttataccactgcactccagcctgggcaacagagtgaaaccctgccttaaaatgaatgaatggatggatgtaaacaactgggaactaccttgctgaggtggggaggggaggagggcaaaggtcgaaaaactacgcatcaggtactatgctgggtgatgggatcagttgtacctcaagcctcagcatcacacaatatacccaggtgagaagcccagacatgtacccctgaatctaaaataaaagttgaaattatgaaaaaaaaaactaatgaaaatgattattttaaacaatagattaaacagacttgggactttgtcttgcttacctttgctacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcaggtgacattccagatccctgaattgcatagcttctctgaaattgcggctgggcacggtaactcatacctgtaatcccagcaatttaggaggccgaggcaggcggatcacaaggtcaggagatcaagaccatcctggctaacatggtgaaaccctgtctctactaaaaatacaaaaaattagccaggcatggtggcatgtgcctatagtcccagctactggggaggctgaggcaggatc

SEQ ID NO: 72034 - DNA, 1079 bp, Homo sapiens
tgcctgtgggactgaatcttccttccatgatacatgatctagcaagccaagctgccaccatttgcagtccaggtgacaatatttataatatacgtagttttatattctctggttcatgtcatacttgtctcccaaatgctgtctctttacaattggacatcacggtaatcagactagagatagtatctgcatttcacaaagggatgcttataattgattctctttgaggattattgtttgaaagtatttcaaaatactaacaatgtcatttctgactgttgacattactcacttttgtaggattatgaaattccttgcctcccatatctgatcttattttcaagtcaagcttgagaaaaaatttaactttttagggtagtcaaagctatatggaacctttctatctacattgtggccttccttagaattttaaatggtaattattaaaaggttgttttcattatcctaaagacatgaaatatgagtttaatgatttttctccattttgtttcagattttttactagatgctttagaactatgtaaacatactttaatggctgtagagctttccagacaatgccaaatggatgactgtggaatcctcatgaaagtaagttacttttgagttttttcccttaaatcctgggcaacgcattatgcaccttttttttttttcggacagggttttgttctgtcacccaggctggagtgcagtggcatgatcaaggcttactgcagtcttgaactgggcttaagcagtcctcccacctcagccttctgagtagctgggactataagtgtgtgccaccacatctgactaattaaaaaaaaattttttttttgcagagacagggtctcaccatcttgtctaggctggtcttcaattcctgggctcaagtgattcccccacctcagcctctcaaagtgctcggattacaggcatgagccactgcacctgggccgttttttaatcatttgcaaagtttatgaaaatactgaatccacctcttatgttttcttaccctagaccggaaaacaacgtaagggcatgaggccacttctctgttccagtcactt

SEQ ID NO: 72035 - DNA, 1087 bp, Homo sapiens
aatatctgctgtttgttttgttatcacctaaatggccaaattattataattatttctgagagtatcattgagcatcattgaagagattctagaagacaaactaactgttgataactcgcttatgaaactgggcctcagagggagttgtcttcatttctactactctgttgatatgtattaaatgctgactcttttttaatgaactgtattgaggtataactttcaaaattaaaatgcacattttaagtatatcaaccaatgtactcaccttgtcaccaacaccacagtgaagacttagggtatttttaatgcttcctctttgctccctcccagtcagtcccccacccctttctagcactataggttaaattctgatactttttggatataatgatgaattttcaccaaagttccttaatatttgaaaaaattttcagaatgttatatagaactagacctaaatatttttttcttcttttctaaaagttatttggagagactacattagttaaatcaaggcatgttgttatggaattgaaagaaaaagctgttatatttatcagggaaaatgctacaacactactgcacaaagtaagtatttgttctgggtaaaaattttgtttgttttttttttgccttttacctcagttaattgcatatgactcaatagtttatgattcagtacagtagtattttactattcaaaaacttcaagaaactgtcttatagctaatcaattatatttttattatggtaattgacatgctatagagcttttatgaaatagtagtcaatcttgtccactgtcgtatcctgattttggttacttatatttatatttatttattttttagagatgaggtttttctctgtcacccaggctggagtgcagtagtatgatcatagtttgctacagccttgaacttctgggttctagttatcctcctgcctcagcctcccaagtcactgagattataggcatgagcaactgtgccccactctgtagttatttattttacagattaaagcattccaatgatcctttcacttatttctattgcagaaatcctaattttccattaccctt

SEQ ID NO: 72036 - DNA, 1050 bp, Homo sapiens
gtataccgtttactgtttcatcattttctggcatgctctttctctatttttctatttatatataaaatcatttcatattttgtatatattttttgtatttaggatttagttacatacattatagctctttacccctaaatatttcagtgccctatagaacttgtagttgctttccttactcttcagatagtcataaaggacattaaacctaagcaaacacattagaactatgttactataacttttcatgaaacacttcttctgtagtgtctataattcaatttagtggtaaataaaccttgagacactgaattctgtttttttttctttaaaaagttttttttaagtataaattaaaattattcctctttatttgtatttctgccctttgtgaacaaagttaattctgttttgattgtgaagaatttgcttcttttgctggtttcttcctgtaggtatttaattgtcgcttggtagatcttgacctggcgttgggttactgcactctcttacctcaaaaagatgtgtttgaaaatctctggaagctcatagataaagcatggcagaattacgacaaaatcttggtatgtcctaaggaagcacaccttcaattcttgaagtattcaagattgggggggagaaatgaagttggttttgccacctgttcttaaagatttagtagaagaaatgttgagctaactcgtgatttctaccagcttctgcttgactggtgacatactgttgcctgtatatgcaagttatgagcattgttcaacccaaagaattacagttttttaatttcttaaaatctgtgtacacccttagaacctcaaatcttattttggtgtagttgaaaccctagacccatgaatcagtttgtttttgtaggataagtttaacagatagaaaatttctcttggatattgtgttaagggattttcttgcaagataactaaaatttggccttttattataaaggaaagccaggctaaatgtatagcattatacgaaaacctgaattacctaaatattacgtaagaagtaacgact

SEQ ID NO: 72037 - DNA, 1002 bp, Homo sapiens
cccacagtgctgggattataggcatgagccaaaaccctgttttctttaccaaaaatataagacattttatttgccaacagttgacttatcagaaaggtaatcagtacagaaatgctatatgttttgaagcttaattcttctgcagtaatggaactggtgttctgttgacattaacaatcaaacttttcagatgaagaggcaatggttaggatgactaagaggagtttcggacccatgtacacctcaaatctcagaatgatggctgggttgggtagtgtgaggttggaggagctatagacaaatgtttctttttgaaaaaggatactaagaaggcaagtcatgatgttgcccttactctgatacatttcagtgtagagggtttttttgctttgtttttttctttttatttctagatttcttttcaaccagttttcaggcaacattttctcaccaagaaagacctcattaaagctcttgtggagaatatagatatggacacaagcctcattttggaatattgcaggtaattctttaaacattaacggtatttttgctgttaacaaactggtaattcttttgcaagaacacagtaataacgatgattattttatgaggtccatagaccactattttcttttgctcattcccaaactgagtaaatatgaaatcagattagagtctcttatgataccaccatttaaattcaccatttagtgtttcccaaacttgtctcctgataagcactgcttagggcacttgatttcaaatgcaggtttctgggcctctctggcagttctgactcagtgggtctggaccaaggcctagaaatcgctggtctctaataggagctcaggtgattcctatgatcagaaaagttggagaatattcttctgagtaataaacttctaaatcaggttaactagggagcaaagtaatcttaaaaattaatgaaaagtatgatttagggagaatttctaatttcctattaaaaatgtttataaa

SEQ ID NO: 72038 - DNA, 1019 bp, Homo sapiens
tgatttttttttttttttttttttttttgagatggagccttgctctgttgcccaaactggagtgcagtggtgcgatcttggctcaccgcaacctccacctcccgggttcaagcaattctcctgcctcagcttcccgagtagctgggactacagccatgcgccaccatgcctggctaatttttgtatttttagtagagatggggtttcactatgttggccaggctggtctcaaactcctgacctcgtgatctgttcaccttggcctcccaaagtgctgggattacaggtgtgagccactgcacccggcctaatatctgatttttaaaaggcaataattagctttgatgacaggtagtttgtctgattttgagactggacaatgacaaggttaaatttcaacaatggaagcatgtacccaagtgttttgtcagatactttgcatggaaatgcctgcagtttgggagactggtgtgtattgaatgcttcttttagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggtagacacacagtgaaatgaatcgggtcatctcagccatccctcccacccttaataattagatacattagtaacaaattggatgtataagtctatatttttatcaacttttaatttgaaatattctcttgatttctatatttttaacacagttaaatacaattttcccatttttcaaaatagaaatagcttttcttccccagatttttgaaaaccttacacattctttgaatttatatgagctagagagaaatgtataaatcaaaacaagcaatttccctataactccactccctagagatgaagatgttaatagtgtg

SEQ ID NO: 72039 - DNA, 1822 bp, Homo sapiens
cacacacacacagaaaactcctaaaggcatataagaatttagagaataggaatggaatctgatgagagggccccggtgggcttttttttttttttttttttttttaacagagtcttgctctgtcgcccagtttggagtgcagtggcgtgatcttggctcactgcaacctctgcctcagcctctcgagtagctgggactacaggcatgtgccaccatgcccagctaatttttgtattttcagtagagacagggttcttccgtgttggccagggtggtctcaaactcctgacctcaggtgatccacttgccttggcctcccaaagtgctgggattacaaatatgagccactgtgcccagccatgagtatgcatttttgtaatttttaaaaagttgctaatttgaccaaaatacattttcttgaaaagattaagatttgcctgtaaatctttatttatttatttatttatttattttaggttccttcaagatatctgctttgaaattctgcctttatttagctgagagatggctacagaatatcccatcgcaggtgtgtctgaactatcagattggcggcttctcttcttcctaattaaattgtactagcttaatttaccttctcatgctgccctggtgcctaaaatggagaaggaagaccaaggctttatgtagatgcttaggaacataactgaggaaggggggagggattgtgattgataaagatggatgcttggcttcaactgaggcttacaaagtaagattttctttttgcttggaattgtttaaaaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctggtgaggacaaaacaatttttttgttgtccaagaaaagctattattttgattctcagttttatgtatatatgtacgtgtacatatatattacttacatatgcttatatatgtatatacttatatgtgtatgtatgtgcatatatacacatacacatataagtattcaatataaatatttaaaacttgagtttttcttttctttattttgaatatcttagatattcatgcagcagctaaagaaatagccgaagtcaatgaaattaatttggaaaaagtctgggacatgttgttggaaaaatggctatgcccttcaacaaaacctggtgaagtaagtacttgctgcccaagagtatctgtagttgagtatgcactgatggcttcttctcaaaggctaaatatttatcccacatgatacagccttctaattaggagcgcagactcttcaaagaaggaagtttctttgtttgttttgtttttgagatggagtcttgcttgttgcccaggctggagtgtaatggcgcggtctcggctcactgcaacctctgcctcctgggtgcaagtgattctcctgcctcagcctcccgagtagctgggattacaggcgcctgctaccacacccggctgatttttgtatttttggtagagacggggtttcaccatgttggtcagactagcctcgaactcctgaccttgtgatcctcctgcctcagcctctcaaagtgctgggattacaggcgtgagccactgcacctggcctcttttgtttgttttttaaagacagagtttcgctctgtcaccctggcaagtgcaatggcacaatca

SEQ ID NO: 72040 - DNA, 1018 bp, Homo sapiens
tttgttttgtagagacagggtctctcactttgttggctaggcgggtctcaaactcctggcctcaagtgatcctcccgcctcgatttcccaaaatgctgggattacaggcataagccactgtgcctgtctggaacttttgttcattatagtaccctctgttatctgataagttttaaagagattgtttacttttttttttttttttttttttggatacagagtcttactctgtcatccagtctggagtgcagtggcgtgatctcagcaacctctgccgaggttcaagagattctccctcctcagcttcccgagtagctggggttacaggtgtgcgccactatggccagctaatttttgtatttttagtagagttggggtttcaccatgttggccaagctggtcttgaactcccgacctcaggtgatccgcccgccttggcctcccaaagtgttgggattacagacatgagccaccacgcctggcctgtggttgcttactttttgtttaaatattgttttgtagctgttttacctttcagttgatgatttcagatgctgtcttgtatgaaagaaatggcctgttcttttactcagattcatgtgattaactttttgttttgaaataatttaaaatgtacacaaaaatgcaaaaatagtaaaaaaagaattcctatatacacctttcaccgagatccatgaatttttaacattttgccatatttgcttcatctctcctctataattgatactcttacgatatttttctgaaccattggagagtaaattgcacgtggcatgcccccttaccccctgaatattttaaaggtgtatttcccaagaacaggattttctctaatccaaccataatataattatcaaaatcagaaatttaatggtgatataattgaatttatggtccattttgcagttacaccaattgtcctaataacgttttttatataagcagttttctcccccaggtccaggatcttgtctaggactatgccttgcatttgttg

SEQ ID NO: 72041 - DNA, 1048 bp, Homo sapiens
tacttatattcacctatatcgtgatgcaaaatagaaatcttaccagtacatttttcagcagttgatttttttaaagggctttcttgataaaactcaggtcagagtctatgagatgaatcagttcactaatacgtggctaggagtctgcagtggaaaacatcagagccagccaagatctagaatttctgaactcctgcgagggcgagggttcctagcacacctttagctgaaaggtgcctctcaagcagaagaaaactctttcttagctaggactttggccccagacccttttatgttctcttaccatgctaaactgggttggttcagatatgggccaccagattctttttgctcttctaacctacgactgaggcctagaaaggcacattgattttatctaatgtgctagatctgattggttatggcttgtattcttgagaagactctatctgggctcaagtcagaacgaatgtggcaatccattaatgatgcctggcacaggcatggataagggagcatggtggttcacatgccagccagctttttgtctttctagcctaaaccaaaagtaagccaagtggcctggggaggccctatgtccagcctcagccttggagagctgatagaaaagatgtggaaagacaaccccaagaaacggattccttctggtttggaacaagcaaagctgtcctaatcacccataccatgccctctttccctctggacccgcaccttggcctcatttagtcttttaagggaaaggccacctttgttcaaacaagaagtagctcctggtatgtctacctgaactaggcacgtggaaggtcttggagggaagcgatttaaagaggagagaaaaaggaaatcccaaaaggctacttaatgcaaaattcataacgtgctgctttttccactaaaagctctgccccacccctcctccagctggcctgattcatcctcccttcccggagaggggccagcctgccctgggtctagaggttgaaatgggctgctaacaaggtcctgcataccaaacacagaatttccc

SEQ ID NO: 72042 - DNA, 1509 bp, Homo sapiens
gtgctgggattacaggcgtgagccactgtgcccggccacctctttggttttcagtactgccagggcatgcctgtaaatacaagggctgcaacaacagttgggggccctccctccattctgcctgcaatttcacccaccattgcttttgcacagtcagtgcaaatatcaacacagtgtaaaggcaaataacatcttagtatcatgaaaacagctttgaccctttccctcttgaaggagtctcaggaatgccccttcaggggtccatggaccacatgttaagaaccactgttacacacagtgcgttccgtaactgtagagattgactttacattttaaaataatgacgttgtttatgttgcctatgttgaaactcatttacccaactacaatgtgcaggtgttcaactctccaaacctcttttggtttttcagacattaggtatgcatcagttaacttttgcccatagaactcgagctcttcagtgtctcttctatttggctgacaaggaaactatagaatctctctttaaaaaacccattgaagaagtgaagtaagtagaaatgtttaaattgtattaagaaataggaaacagatcattttttggagctgtaccttttaagccctgaattcagaagagcatagtagagtagctgtgtgaatacagttctgttgccctgaatatccttgacattttggcaaagggaaaatagggctttgagaacatcttgtttccatcgtttcttggagacatttagaaactgaatgttttatttatcttgttcaaattgatttctatctaatgttattatatattcagtgaatatatttggaagtccaaaatggacatttaaaacaaactggcctaatatttccatatggtagtttttattttaaatgtaaatgtggcctatgagaatgattcttagaaacgtttctgttttccagatcttatttgagatgtataacttttctggcatcatttgagactttgaatatccccatcacatatgaattattttgcagcagtcctaaagaaggaatgattaagggtctgtggaaaaaccacagccacgagtccatggtaggtacacctcactgccccattcccaattccctgcccctactcagaatcctgaaagagaaaaccaggaacagtctttttgttgttgttgttgttggggacagagttttgctctgttgcccaggctggagtacagtggtgtgatctcagctcactgcaacctccatctcccgggttcaagcctcagcctcccaagtagctgggattataggcgcccgcccaccacacctggctaatttttgtatttttagtagagatgaggtttcaccatattggccaggctggtctcgaactcctgacctcaggtgatccacccacctgggcctcccaaagtactgggattacaggcatgagccactgcacccgacccaggaacagtctgtatccctgagcaactctactgctctgagacctttctactctcctgt

SEQ ID NO: 72043 - DNA, 1219 bp, Homo sapiens
tcctatgtattctagagatttccttttttttttttttgagatggagtctcgctctgttgcccaggctggagtgcagttgtgtgatctcggctcattgcaagctccgcctgctgggttcacgctattctcctgcctcagcctcctgagtagctgggactacaggcgcatgccgccacgccctgctaatttttgtatttttaatagagacggggtttcaccgtgttagccaggatggtctcgatctcctgaccttgtgatccgcctgcctcggcctcccaaagtgctgggattacaggtgtgagccaccgcacccggccgagatttcctgttttacaggcatgtatgctatgtgtgtgcatatctacagtgtatatatgcatttttgcacacataaatgcaatcacattctaaacaaagtgttgttttcacataacagtggtctctggagattgttccatatcagcacatgtagatctatctaattgttttattgagatacaattcacatgtaaaatttatccttttaaaatacacaatgaagtagtttttggtatatgcacagagttgtacagcctcaccattatctaattccagaacattttcctcaccccaaaaagaaaattcatatccattagcaatcattccccattccccactccctccagcccccagtgaccactaatttactttctgtccatggatttgcctattctggacattttgtatcaacagaatcccacactatgtgggattttgtgtccggcttctttcactcagcatccacattgtagcatggatcagaacttcattcgtctttattgccaaataatgttccattatatggatataccacttttatttatccatttgccagttgataaagatttgagtttctatttttggtcattataaataatgctgctatgaacatttgtgtacaagttttcactgaacatgttttcatttctcctgagtatatacctagaagtgggcttgttgggtcttacagtaactctatgtttagccttttgaggtattttattatttttaatgcttgattattctccagaatatgtggtaaaatatacctgaagttacttaaccactcctctattgatggaagtttacattttctttcctcttttttttctttaaatgtatagagatggaggtcttgctatgttgcctaggctggtcttagaactcctgagctgaaaca

SEQ ID NO: 72044 - DNA, 2578 bp, Homo sapiens
ctcagctcactgcagcctccctcccgggttcaagtgactcccaagtagctgacgttacgggctcctgccaccacgcccggctaacttttgtatttttagtagagacagggttttgctatgttggccaggcaggtctcgaactcctgacctgaggcaatccgctggccttggcctcccaaagtgttgggattataggcatgagccactgcgcccagctgaacatgcatattttttatttgtcatttggcttattaattacatttttaaaagccatctgttcttgtctttgactttttcccctcttttcatcattcatacactcattccttgatgtcgttcagtgtttcagtatttaaatagatttcttttggcacttagaagagcaaaatacctgatcaacggctcttgctgttggaataaataataacaattttctattaattctgctttgatttttctctagaattttctgggttcctgtgaccctcaggttattttaaagcaattggaagagcatatgaacacgggccagctagcaggattttcacatcaagtaagaggcgatttcatctcctttttgctatgaaaatgttgatactagaaggtagtcattttcccaaaccaagagtaagctgaaaactgctatgtctagctgtttgtttatgtatagaattattttgcttttactaaaacctcagtaaattttttaagaggcagggaccctgagcgtcttgttgactgctgtactccatggaaaatttgtagccttaagtgcttttaattgaaaacagatcttcttcctcataaaaagtctcaaagtgcacaacaacaattactttatttattgactgatgctgacaggcctcctttccctttttaccccctcaaaaaggaggcgcagtcacaatgcagtgctaattgggcttccgattgtcagaaatgttttgatattgaataaaggcttgatacctgtcattctatagattagaagtctgattctaatagattagaagtctgatcttaatgatacctgtcattctatagattagaagtctgattttgaataatatcatcaataagaaggagtttgggattttggcaaagaccaaatactttcaaatgttgaagatgcatgcgatgaataccaacaatatcactgagctagtgaactatttggcaaatgacttaaggtaagttaattaaaaaaaaaaaaacttactgtggaatttccttaaaatctatctttataagctgggcacgatggctcacgactgtaatcctagcactttgggaagctgaggtgggtggatcacctgaggttgagagttcaaaaccagcctgaccaacatggagaaaccctgtctctactaaaaatacaaaattagccgggcatggtggcacatacctgtaatcccagctactagggaggataaggcaggagaatctcttcaacccgggaggcagaggttgcagtgagccgagatcgcaccattgcactccagcctgggcaacaggagcgaaactctgtctcaaaaaaaaaaaaatctatctttatgttggagcagaatgtcaactgtagagctatttggttgtaattaaaagctcaaaatattacatctctcattactgcacatatccaaaagttaatcatttaataacccaatttcttggaatatgaccttagaatctgacaattaaacaggtcatctgaacccccaaatcaagtgtctcacagccctgttctaaatcctacattacaattttatgtctagacacttgctcagaacattaatgactttatgtagcatcacttttgttaaacctggttatctaattttccagcacccacaagtttagaaacaataagcttcttgggatagagctgggggtggatatggaaactgaacgggagaaggaagaagtgggctgacactaaagaaagggaagttcaagaccgcagtacacaccagatccatccctgcatgtggtctagccatgttggcgcttgagaggtctttctttctcattaccactccatggatttccatctgcttgtttatctcttgtgatccagccataattagatattgtcatttttgagcaagtattttttgagttataattgatacatataataagctggacatacttgaagtctgcaatttagtaaattttgacatatgtatacctataaagccatcaccacaatcaagagagtgaacataattctctgaaagtttcctcatgccctctgtgaagttgattacatgaattaggtcattcttgtgatacccaaattcatcagagtcgaggggcccaggggaaaagcactcagagtacaaaacattgctccaaaaacataattctggccgggcgcagtggcttactcctgtaatcccagcactttgggaggccgaggcgggtggatcacctgaggttaggagttcaagaccagcctggccaacatgatgaaaccctgtctctactaaaaatacaaaaagttagccgagcatggtggcgcatgcctgtaatcccagctactcgggaggctaaggcaggagaatcgcttgaacccagg

SEQ ID NO: 72045 - DNA, 1054 bp, Homo sapiens
ttttttgtatgtaaaatgtgcacataatttatttttactcccattttgaacttaagtgccaggtaaaatttttactttgatcatattttggtagctttattttttatttgctgtttttcagatcggaatattttggtagctttagtaaacctaagtatcgtggcttttttcttcctttggtccagatcaggcatattagaatgagcccgcattttgttaccgcccattaataacttacagggcttacctccaggtggttgtgctcaatgccataagattactttttttttcagaaggggagagtattgattcgggagataaatttgtggcgtttaaaatctgtttctctctaatctaaaatgccaaatagtttgatatgtagatttgtatcacttcacttaagttctgtagtttatctgaccattttcaatttgaaaaactaagtgacttataaaaatcacttctgtgtttcttcccatttagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactcatgtcctgaattaataagtcttttcattgccagtcacttgtgcaatttatagagactatcaacttttttgcaccatatatgaaggaaacaaagtgcaaaaagtttgctctctcccttaagaaaattgagtgcttatagcctatgtcttccatataaaaaagtaagaatatcagtctttttaatgttattctaagaaaatattggtataattttagtggcagagtttatcagtcagaaaaataaaagccactctagatatgccaagcagagaagaatttcatgccagggattggctataaagttcttcaaaagactgaaagaacagaagggaggtagaagcgggagccagacaaaagggaagaagggctttgcagcc

SEQ ID NO: 72046 - DNA, 1889 bp, Homo sapiens
atacaaaaacttagccaggcctggtggcaggcacctgtaatcccagctacttgggaggctgaggcaggagaatcacttgaacccgggaggcagaggttgcagtgagccgagatcacgccattgcactcccacccgggcaacagtgcgagaccccatctcaaaaataaaaaacaaaactaaggatgtgagaaaaactgatacatttattttaacaagatgctcagaatatagattcctattatatttttatataatgattacctgtgaaacaactctttaaatttggaaacctatgtgagtaaaggataagatctattccctgtgacctcagagggtcagtgaactaggactaaagtggaaactactgaaaggtgcctttctaccttgtcaacactctccagaacagtacaggcttccacttaatgtaaaaacattcttatgcttaattgaagaaactagtagtggagatgggattagactgtaccttttaatttctaacattaccattttgtaaaagtagtggattttgttagccagcttggtaagaaggtatgatgacattgttaatagagtccacatcataatcaacaatttacaaagactataaacaatttttacctagtatctctgatgtataaggtcctcggctaagttctgtggaggcatataaattggcagaggccctgtctgtctacatataacttaacagggaagatgatgaatgctgaaagaaagagacaagaaataggccaggcgcggtggctcacacctgtaatccaagcactttgggaggccaaggtgggtggatcagctgaggtcaggagttcaagaccagcctggccaacatggtgaaaccctgtctctactaaaaatacaaaaattagctgggcatagtggcaggcgcctgtaatcccagctactcgggaggctgaggcaggagaatcgcttaaacctgggaggcggagattgcagtgagccaagatcgtgccactgcactcagcctttgagagcaaaactccatcccagaaaaaaaagaagaaagagacaagaaataaagattaaggactaatagctgcagtgtcagtacaggaggggagagatttgtaggaaattaggggaagacttcatagaggcaaccacagccaaatggggatttgaaggaaaggttgcattcaggcaggcacagaagggctgaaggttggacttgccaggcaaaggagtggaggtaggaaagtatttaatagtgggtagtgtggagggagtttcgagtgttacagtttggttgtattgtggaattcatgaagaggggcagccggaaattatggcaacgtggtttggggccaagttctggggcacctgatttgtagataattgtaagtcattgaaagttttggagcagtgaagttacatgaagatgaatctggcagcaagataacaattgagggaggcaggcttattggccaggctataataagactttagacaaaattaatgagcatttaaatgagtggcataagtgaggaagagaggttgaaaaataaattatggtaggatgaacagtataaagcagttaatcagatttgaggacaagggagatgggagaaataaactggatgtagttttgacagacatttagtattgctggagtgcttagagaagagggaaaaccctccaatagaatacccaactgattaaagagaaaaatagaagcgatagtgacataggcatttttcttatcattccttccccctccctccctttccccttttgcaaaaagaaggatgcaaattagagaatttgctctcagctaaagtctggggtttcagagagcagctcaaattcatttaggaaacacgttttaagcatctgctctgtggcaagcattgtgc

SEQ ID NO: 72047 - DNA, 1933 bp, Homo sapiens
atgaataaaaagtggtggctgttttggtagaaccatcaaaagaaataaccaggctgggaacagtgcttcacgcctgtgatcccagcactttgggaagctaagataggtagatcgcttaagcccagaagtttgagactagcctgggcaacatggtgaaaccttgtctctacaaaaaattagctgggcatggtggtgtgcatctgtagtcccatttagttgggagactgaggtgggaggatcatttgagcccctggaggggtggaggctgcattgagccatgattgcaccactgcaccccagcctgggcaacagagtgagaccgtgtctcaaaagaaaagaaataaccagtttccttcaaactctgatgtatgggaaattgttcgtgtcttagcttaattttttgacccactgaaatggttatggtaagacctcattatatacaaaatagcatattttgatgttccatcagctgatggagacactctttagatgaaaaagtcaagatagtatcatctcaaataaccatgtgccttttaccccaaaaacactgaagagtagcatttgaaaagtggtatagaaaacttatagggaaaatgtaaaaatgaagcattttctcaaatataaaagtaaggataagccctgtgtatgtgtgtacatataggtttaacatttcaaatcttttttctttttacttcctcagtctgttcattaccaacagaggtaagttctttaatttttttttttaccttatgtatttgaagttattcttggttttaaagctaccttgagaatttttttttatttttcatttttgattatttgatagtaaagctttaaccttttatagagaactttgatttagagtaattttttggtcttatatattctttcctaaatttagaccttaaatcatacatgtgcatcttttgcacatggctgtgcagtttggatttttgcatgggacttatgaatagtcagctaataaaataagagtaaccttaatgccaaaatctatacaaatgagcagaggaaagaaagggcagtataaattatgtgtaagactttctaagtccagctctatgagcaagtcatgaaaatgaggcacttatgtgctcaaagcaagaaatagagggagaagaaataaattggtactgtgaagaggtacctaatccttcttaatatctaattttttatgggacatatcgtggttgaatacagatttcctgtggataagaagtcagatgggagtggtttgttttattctttgtattaacaagtatagggggtgatttttaattacgacatattgtttgactgaaaatgttttgttgtgactcagttctttttttttctcctagtactgtgaatatatgcctgatgttgctaaatgtagacaatggttagagaagaattttccaaatgaatttgcaaaacttactgtaggtatgaacattttttttcttgcattaaacttctgtacctgagacaaatgcatgtatggcattattctaaagataggaaagtcctcctttagtaggatattacagaattaacatttatctgttagctgtttaagttctctctgagataggataggtctgaatatcaactttcttacataaaaaagtaaatgggccgggcgcagtggctcacacctataatcctagcagtttgggaggctgaggcaggcggatcacaaggtcaggagatcaagatcatcttggctaacacagtgaaaccccatctctactaaaaatgaaaaaaaaaaaaggcgtggtggcaggcacctgtagtcccagctactcaggagggtgaggcaggagaacggcgtgaacctgggaggcagagcttgccgtgagccgagatcgtgccactgcactccagcctgggtgacagagcaagactccgtctcaaaaaaaaaaagtaagtaaat

SEQ ID NO: 72048 - DNA, 1064 bp, Homo sapiens
gatttccctgacacacaaacccctaacttggtaagtccattttggctggtagctactccatcactgtcagtggttgaataagaaccctcaagtctggttttatattcagtctacatggttgtccctgaacgggaccttcctgggataggatcatgtctgagcgggtggggagctcttctctagatgttaacaaaattagtaagtttagatgctagagcactcctgcagagcccaagtgttctatgctcctttcctgtggctaaaaatttcagccctcacatatcaaaagactgggttttctcttctgttaccatacacttactataatgactttagaactagacttgaatagaaatctagcagtgtaatccattgctttacaaatttcatgctcagctgttggtaagatgccttatttgtatatgaggttgctcaaaggtgatttctttttttttaacagtgtgagatgatgttcatgcttttgtatttcacttttatatctagaaaattcacccaaacaagaagctggaattagtgagggtcaaggaacagcaggggaagaagaggagaagaaaaaacagaagagaggtaagacctaaattcacatcttgatttgtacagtcataccgtcactgcgatagaaaatgtaagtaattaaaatggttcccaaagctaggcacaatggtgggcgcctatagtcacagcttcttagggggctgaggcaggaggatcacttaagcccaggagttcaaggctgtagtatgcaatgatcgttcctccacatagccactgcactctatcctgggcaacatagtgagacctcatcccttacaaaaagggggaggttcccaacattaataccatgtacctgttattgtaattccccatgtatatcatacaaaggggcacatactaataggatcatggttggatgtggtatgatttgggctgtgtcagtaaattggacctaggaaaacatgcttatttgccctgtttgtatgtaaaaaacagctaaaattcctgtgtcttctatttaagtagagtgaggacatttatataaaaaa

SEQ ID NO: 72049 - DNA, 1026 bp, Homo sapiens
cttatgcctctccagcctttttccctttacctggacctttccttattcttcacaactccacctagatattacttcctctaggaaactttctgtgtcctctggaagcagactaagttgtttctctgcaaagctatcataaagccttattcatgattcctattattgtatgtatcaggttgctgtaacttctttttttactcccttcactagactgagtctctggagggcaggggctatgttctgttcacttttgtatcctcggctcttagcccagtgctaggcacatagtaggtacttaataaatgtttattgaatgaatacttggatgtgtttagtaatttttgtattagagaaaaagaaacttaaaccttttgagaattaataaatttaaagacagtattctcttatgtcaaaaacaactaaagctaagctctttcttaataaataaaggtggaaggggtcaaataaaacaaaaaaagaagaccgtaccacaaaaggttactatagccaaaattcccagagcaaagaagaaatatgtgacaagagtatgtggccttgcaacttttggtgagttcaggcttaagtatatttaaaatgtgtgaactattttctctctctgtctccctctatctctctgtctctctctctctcacataccatgaaaacttcacaggtctgttttttgctaagaagataaattttgcatttctaactatagcttcaaaatcaaattttagagaaatgtcaaaatcttttgtagaggggactttttactttctggaattcctgcttgggcacattttatgtgggatgaggacggctgggtaggattctctttgaaaccagccaatgctgctcctctgtcctctgcaggcatggtggcaaaaggttgcaaaatggctcatcccctctgggaatgacaggagaggttgaggaaggtggcagaacatccttctttagagccccttagttcctggaagccttgaatgagtagtgaaactgggtgaaaatgtaaactatgatgcc

SEQ ID NO: 72050 - DNA, 1076 bp, Homo sapiens
atgtattgagcctttatttgaccttgaaagtgtaaattgcattgttaagatctctgtggtagtttgtattgttctgaaaggaatataaaacccattaacaatctgttttatgattttaaaatgcagattaaatttcaaaatggaaaaacatctttgcacaattccaattacagttcttgctctttctttttttaaaaaaatagaaattgatcttaaagaagcacaaagattttttgctcaaaaattctcctgtggtgcctcagtaacaggggaggatgaaattatcattcagggagattttacagatgacataattgatgtcattcaggaaaaatggccagaggtgagtgcatggaacacatacatcgctagagataagtttttaaagcaaattgcttccattttttcttaattgcaaccacaactcatgagatataattatttgtgttttataggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatatatatacatacacatatatgtatacatatatacacatatatgtatacatatatacacatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcc

SEQ ID NO: 72051 - DNA, 1023 bp, Homo sapiens
tgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaacccgtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctgg

SEQ ID NO: 72052 - DNA, 1964 bp, Homo sapiens
aaatgaaataagggcgcgggtgtgcgttttgtacttgtgtttgtgccggggacccacgatgcagacgttgctgcgtttctggtttcctgttgctttttattttacaaactcttgaagtgctctcaggcttgggggatgggcggtggaggggggcatacttgtttatttgccaaaataagtcaaccaagactgaaatggctgaaaaattttactctagagataaaggaagccagaggacccctcccactcctgtctaaagcaggttggtgacatttgcgtttgtggcggctatttgcaagttccgtcccacttgtccttgcagagagctatgacttctgcggttgccttcacatctagttagcacacgcactctacaacagctttcgttttgaaatgagagagaacgcagggagaccttctaacctttgtgcttgggattgacccagaaagcgataataaatcctgaggatatcaaggctttagaaatgcgaagtgctggaacccaggtggctgcaaattaccaatttagccttgtgatcttcatcaccatcaactggttcagcccggatagcccgtcattttaaaaaaatttaaagtcaccaatacataattaattgtgccaagaacttgtagatcatagggagaaaacctgaattggcagacatatctggatgttgtcagaaactttgtttattcactgagttttttctcgtgcctttgaggacgtataaagaggtctgattgctacatggaggagatgggatgtgaaggaccaacttcattgatcttactcttaaatgataagaagtcaagggcaaccttcctgagtgtcaaagagagaatctctgatacaggaccacacattttagtggttggtttgatacacaagaaggtggattttttttttttttttttaaagacagagtctctctcgttgcccaggctggagtgcaatggcatgatctcagctcgctgcaacctccgcctcccgggttcaagtgattctcctgcctcagcctcccaagtggctgggactacaagcgtgcgccaccacacctggctaatttttgtgtttgcagtagagaaggtgtttcaccatgttggacaggctggtctcgaactcctgacctcaggcgatccacccgcctcacctcggcctcccgagatgttgggattacaggcacctctccgaaggtggattgttttgttttgttttgctctggttttttctcagaggctaagagggccactaacaatgaataactttgtaatgggtgaatgtcacaggtcttacctattctagggccccattttctggaaagttggagtttgagttcattgtctgggtttgctcgtcttcacagtgacttattgaggaatgtaagaatgaggttttgtacgtggttaatatttaattagatcgttcccagaaataatcaggtgagccgccagccaggtcccgtggtggaaaaggacctggagagctgaggttgttacttccatgtctccttcgggacagaaaatagcacatgcagtccagggacctggcttcctttgtaatacgctgcttgtcttgcattgaccacagcactgtgtgctgtggcaggagcactaggctggcttagaatttaaatattcactagcctgccagcctcgctttcctcccctgggctcctgggtcaggaggaagataattgctttcctgtgagcttttttgacaggacacaccctgtttgcaaatatctgtggggttagcgctcaggagtgtgaagagaggcgatcatgtgcctgctgggagctggtgcctgtgattgttgcatggtgtgtgtgtataatcccaggggaatgtccagaaaaccagtgtatgcttttcttccctatgactttagtccctttggttaaaaaaaaaaaaaatccttttcaaaatggaggtgacaaacttttattgtcttgttgctgttttc

SEQ ID NO: 72053 - DNA, 1016 bp, Homo sapiens
ctgaactgtgaaggccatgcagcccagggccgcctgggaggggcctgaggggctccatctccatctctggtccatgtctggcccacatctttttgttatttatgaccttggacaggtggttaacctgcagcctcaatgtcctcccttgcccacctgctccgaggttccttgtgaacattaatgaggcaacactggaacaatgctgtctgctcgggggcccagtacaaggctgagctcaataaaattgaatttattaataggttattgagacctgtctgctggccttatggcatagagtatgttcttacacacttggcgatgccagctatcctgagtgtatctgcagagcctcacctgccccctgggcccctgggtgcccctgagctttgtccccactctctgtccttaaaggtcaggcccctcctgctgccagcactgggcaggataagagcaggctcagagagttgtgagcaggtggcccctggggcgtgggtgtggactccgaggatttttcgagacccgaaaagctgcagggtctgtggaaccaggcaggagctgacctcactctgcttctgcccctctctgctgtctctgcggaccctccaactcccttctgcaaggtgtctcacggcgctgtggaactctctattattgttttgttttgtttgagatggagtttagctctgttgcccaggctggagtgcagtggcatgatcttggtcactgcagcctcccaggttcaagcgattctctgcctcagcttcctgagtaactgggattacaggcacacaccaccatgcccggctaatttttgtatttttagtgggagtttcgccatgttggccaggctggtctcaaactcctgacctcaagtgatccacctgcctcggtctcccaaagtgctgggattacaggcatgagccaccacacctggcctattatttttactttttagaggcaggttctcactctgttacccaggctgcagtgcagtggtgctatcatggctcactgca

SEQ ID NO: 72054 - DNA, 1064 bp, Homo sapiens
tggttcagtggccgctgggtgggggggagccctggttcggtggccgccaggtgtgggggggccctggttcagtggccgctgggtgggggttctctccacagcatccccagtttcccgcgggcctggaggtgacagatgaggtactggagaaggcagctgggaccgatgtcaacaacatgtgagtcactctgcatggctacatagccagttcccctcggcttccccattccttcctaccgcgtctcacgcccaggcgtccgcatggggcagtggggttgaatgagtccgtggctttgttggttgatgctcacgctcccagggacagagggtgaagttaaaagggtggggtgtacttgaaggactgtcgtcctggcagaggcacgctgtctcaccagagccatggtgtcggcggtgcccccgtccccactggagggggcgtctcaggacgagtgggtgggtccacccaccctttttcatttcttcccccacttctcttgcgtagcttccagctcactgtggagatgtttgattacatggattgtgagctgaagctttctgaatcaggtgagccgtaaagaggggatgcgggggtctgagtgtattgctaagtccccagagatgggacgagaagaaaaaagaagacatgagtgatcagaccaactgatcactatgaaatgaccctggccagccgcagtggctcacatctgtaatcccagcattttgggaggccgaggcaggcagattgcttgaggtcaggggttcaagaccagcctggccaacatggtgaaaccctgtctctactaaaaaaatataaaaattagccaggcgtggtggcgcacgcctgtattcccagctacttgggaggctgaggcaggagaatcacttgaacctgggcggcggagatcatgccgctacactccagcctgggcaacagagtgagtctccgtcttaaaaaaaaaaaaaagaaaaagaaatgcccctgcccctcctggggtccctgcacctccagggataggtaatggggcctcctggcccctccaaagcatggcaggccccagcgggta

SEQ ID NO: 72055 - DNA, 1010 bp, Homo sapiens
gatgggccctgggggcaagcgaggtttcagggtcacttggggtgtgcagagccaagctgtgaccctagtgccgtgttacttggcagaagccctgcctgttcccacatctgtaaagttaggcatttggggtgctccatcgtgagcctccttcctgctctaacattcagcgtgggtttgaggcccgtgggcatggagctatccgtcacccttgtcagtcgggcacctcgtcctgggctcccaggtggaggtctctggaagcccttgctgagctgggctgggagctcctttgccctgaccttgttgttgccgttgacctccttcatgggagcatctggtcttgacctggggcagccaccagcacatgaggctcccgtcttggaggcagggggcacactggtgtgtgggagctggcttagggccctgcttcacagttggaccaccttggacaggttgcccagctcccaagggctcacgttcttcctcctgccccttttgcacagttttccgacagctcaacacggccatcgccgtatcccagatgtcctcaggccagtgccgcctggcccccctcatccaggtcatccaggactgcagccacctctaccactacacggtcaagctcctgttcaagctacactcttgtgagtggcccagggcaacccctggcccggaaggctgtgtttatatggcttagacattcactgtcaaaaaggaaaatcgaaaaattagaggtttattcatttaaaaatggcagtaataaacccactgcccattaatagaaataacatatattttatgaaaaaaaaaaaaaaaaaacccactactttaccaagcaaaaaacttagtgagtggcttggttttcatttttacgactaaatgcctggctcggccaagacggaggccccagctgctcccaggaatctcccgccaggcaccctgggggtgcaagcgcaaaaaggcaaaaggtgtctggggtgttaggagagttttgatctaaccaaccccttgaa

SEQ ID NO: 72056 - DNA, 2232 bp, Homo sapiens
gagtttgtagcatacggaggaacaaggcagggcaggtgagcccctgagcagtgtgcagagaagtcctgttacacttgtgccaccctccaggtctccctgcggacaccctgcaaggccacagggaccggttccacgagcagtttcacaggtactgcctgggacagggacaggattgaggccggtgggggagaggctccgtggccccttcctgaacccgaacttcccaccatctctgcagcctcaggaacttcttccgcagagcctccgacatgctgtacttcaagcggctcatccagatcccccggctgcccgaggtaccacccccaagagggccccgaggccctttgaggaccccaggcacctggctgggccccacacaggctatggagatggcggaaggagggcttgcttaggggacagctgagcaggtcccacctgccgcccctgcagggaccccctaacttcctgcgggcctcagccctggctgagcacatcaagccggtggtggtgatccccgaggaggccccggaagatgaggagccggagaatctcattgagatcagcacagggccccccgcgggggagccagtggtgagccccctgcccagcccgtgtcccccagtcctccagctgcagcatgaggccaacgggagtgtcgggtggccagccctccctttgcccactgcccggcctggagggcacaggtgagtggggtcaccatgctttgctgtggcaggtggtggctgacctcttcgatcagacgtttggaccccccaatgggtctgtgaaggacgacaggtgagggctggaggagccgactgggctgggggtggttggaaacgggctcagctgagctgtgctctggacagttctgtctggaaaggccataggtggggaacatgaacccgtgaggtgcccaaatcctgagtggccactgaggaggagacaggttcctgtgctgggtctgttgactgttctggttgacttaacttgaaccccaggacctctgtccccagggacctccagattgagagcttgaagagagaggtggaaatgctccgctctgaactggagaagatcaagctggaggtgcggggtggggatgggtgggggccagggcccctcacggcccaggcagggccccacgtcacacctcctcccgcaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagagtacgtggggccttggccacaggggtccaagggtgtgtccccagcccctgccaccccacacggggcatcactgcccctcctctcgcccccagggaaggccagtgccacggaggcgcgctacaacaagctgaaggaaaagcacagtgagctcgtccatgtgcacgcggagctgctcagaaaggtaggtgcagcccatcctccatcccagccggtggcagggcctctcggggatggcagcagagcatgagcccttcccctgcccatgcagaacgcggacacagccaagcagctgacggtgacgcagcaaagccaggaggaggtggcgcgggtgaaggagcagctggccttccaggtggagcaggtgaagcgggagtcggagttgaaggtatgtcccttgtggcacagggccctgccccggcatccccagcccactgccccagtgacacgctgtcctgtcccagctagaggagaagagcgaccagctggagaagctcaagagggagctggaggccaaggccggagagctggcccgcgcgcaggaggccctgagccacacagagcaggtgcatctggctttgatgactggaggtggggttctggggccagtcctgggtggaagtcaggtcctctttcccgtgaacaggccccacctgggtgccactcggtgatcctgggatgcagccctgacccagacccaggggctacatgggagacaggacctaccgctggtcctcagggagccctgagtctaatggaagtgatcactaacccccagggcccagtttataagcgtgggggcagggtgggtggggcctgggagctctgttcacatgcctggtgtccatgtctgtccacagagcaagtcggagctgagctcacggct

SEQ ID NO: 72057 - DNA, 1050 bp, Homo sapiens
cctgctccttcccaggaacccacccctgccctgtggacaaataggcttttgcctctggggcctgggccaccatatgtctgcaggtggcagagcactgaagggcccggggccacacacactgtggtgtggttcccactgcctcctggacgttgtcttgccgagccctcctttcctcttcctcctcctcctgggatagctggccaccgacggtggtcccagtgctagtgtctcagtgtcatcctcccccaaccttggccccacccacccgcacagacgcctccgccctggtggcagctctgacccgcttctcccacctggctgcggataccatcatcaatggcggtgccacctcgcacctggctcccaccgaccctgccgaccgtaagtgggtcctgggatggcaggttctgtccacctcactggcttgtctcccctgggggtccttatggagcctgtcggtggggggggctccactcacggtcctttctcaccccaggcctcatagacacctgcagggagtgcggggcccgggctctggagctcatggggcagctgcaggaccagcaggctctgcggcacatgcaggccagcctggtgcggacacccctgcagggcatccttcagctgggccaggtgaggcacagctgagtgtgggtttgggaggcttgggcctgcctctgacctctgcacccacctctgggttggctgaacaggtgtttgtgcgtggagcctgcagcctcaggacacagggtggggaccatgcaccctcctcgatccctgtggtccccaacctctttcccaggctgcccgtgggacggggggggacggaggctacccctgtctgactcccatcctcaccaggaactgaaacccaagagcctagatgtgcggcaggaggagctgggggccgtggtcgacaaggagatggcggccacatccgcagccattgaagatgctgtgcggaggattgaggtgagcacgggatctggggactcccctcattcctgtggagctttgggggccggaggccccaactgggctgggtacagg

SEQ ID NO: 72058 - DNA, 1842 bp, Homo sapiens
agccgtccgtggggtcagagaccctggccctgactggcccttgacccgcagggaggcagctgacaaggtggtgcttcacacgggcaagtatgaggagctcatcgtctgctcccacgagatcgcagccagcacggcccagctggtggcggcctccaaggtgagcttgcacgccgacagcagcacactgggctctgggcccagcttggcctgggctgtggctgccaagcccaggcctgctgctgccctgagctgggagacctgggcccaccctgacctctcgcccctcaggtgaaggccaacaagcacagcccccacctgagccgcctgcaggaatgttctcgcacagtcaatgagagggctgccaatgtggtggcctccaccaagtcaggccaggagcagattgaggacagaggtgagtgccagatgccaacgggggctgctggctcccgaggctgaatgggggtgggtgcccagatgttcacccccttgtcctccggccacagacaccatggatttctccggcctgtccctcatcaagctgaagaagcaggagatggagacccaggtaggcgcccatggctgccccgtgacctctgagctcatccctcgggcgaagcctggacccaggagagagctccctggggaggctgggctgggctgagcaggccgtgtggctacaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccaggtgccgtctgcactgggatgggggagttcctggacgggggtgctgtccccagccctagaggggcacatggtgcacgtccctggggaagtcagggaccactgacaacatgcagggaggagcttgctcaagggagaggtggggccccaggtgcctggctgtgaccactgaccccccacctttaacccctgcagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccgggcgctgccttcactcctggagtgagtttccatttccagctggaa

SEQ ID NO: 72059 - DNA, 1126 bp, Homo sapiens
cctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacg

SEQ ID NO: 72060 - DNA, 1056 bp, Homo sapiens
tctcgagcccgctggagtccaacacctccttgcttccacccggctgcaccctgactgacagactcgccctgggtgggtaagcaagacagaaacacctgtgcccccagggcttcagagttcatcgagcccagccctatcttggcaagaccctgccggccccagcctgcaacaactgcacaacattcgaccttgactcatttccttatcgcctggcgaggctcaaggctctaatgcgcagctggacgtgtcccagaagctctgtagcctcctcccagctggcccttgaacgacggcacgtggtaatccgccactggccccaggggccggcgttcacagggtggcacgcatgccctctcttggccctcgctcggacctgccctcactcaccccgctgctccctggacccctgcctggcactttccccagcacacaggccaggctgcctgctggtatacagcccgtacacctgggaggcaccactcctggccgtggcggtgtggcactcacggtccctggaggcagcgggcccacggactgcccaaagcgccccaaggattccaccaaggctggtgggctttacctcagtgtcttcctcaatcttggccccttctgcctgaagaagtgctaacagggtctccaaggaagcactgctagactgtctgtctggaaaaaaagcaagaggtatgacaaaagtgagaggtgtccaggtaaagcccttcatgatgccaaccacggcaggattgcaccttcctttccaggaagctgaatgtgaaaggcttgaaaacctacaggggaacaagtgcaccaagccagtgcccaggggccaacatcccatgtcagagcaacctgtgtcaccagctgcttctagaaccagctgttttcaaatatggggcagtgacattctcatcatgccactttgtatttcctttatgttttgagtggtaacttacatcgagtatacacatctcaagtgtgtaagtcaaatttccacgtgtttaaccgccaaccaccaccccccagatccagacacagaacctttccaccgggcgccctcac

SEQ ID NO: 72061 - DNA, 1131 bp, Homo sapiens
aagtttttttcctttgttgttcccttttgggatgattttttagagtttttgtagagtttttgtttgattttaacctaaagttatactctgggtattttcttattttttaaatcagaatattcttacatgacatgatttttaacagctatgtgatctttcatgtggatatgtcatttatataaccattcctttattggatatttaggcacttttttgctgtcataaattataatgcagttaacatctttgaaatctgtttaaaacaaatacgttaaagtgatcaacatttaactttttttttttttagtaagtcttaagtgtctaggcagtttttaggtaaaatatctgatcccctacatgaaatatgattatatagttttttaattacgaaatttcagtggagtaatctcaacagattctcttttgactaatcccttttttccctaaccacagactgaaaaaaaaaattccattattagaatagcattttctcatttaaacggaatagaagatgagtaattggagtcacgtgagagttaaattttatctgttgaaccaaattccgggtcaggtgttggaaagttcatgtcatgatgtattttaaatgtaaaaacaaaattgtcaaaagatacagtcttaataaacataaatccagggtccacctggataggcactttcttatttgcacctgtgtaaagactggtccgaagaattcttagacatgaatttccagaaattgtaaaaaggaaatagagatgagggggaaaaaacaaacaataaaacccgaagctcttcctaaacaaatgaatgctttggttgttggtcctggccagaaactattaataagaaaatcagaattttaggaattctgtcttccgtaagctggttttttttttgagatgggaggggagtagaagctattaactgacacccctcatggtcaggtggtcatgactaggtatctggacatttctgctcctacactggaatctcatacttacacaggatcaaatgtgttcactcccagatctgttcattctggttttattacaatagttctatgatttcattaaatcctggggcaactggatttttgcatgagtgcaaagagaaagttatttctacaaaaac

SEQ ID NO: 72062 - DNA, 1037 bp, Homo sapiens
ttagccaggtaatgagggagaagggctcccaggcatatgggaggaacaaaggcacttagggaagaagccgggacagagtgtgtgtgcatacaggaatattataagtattgctggagggaccagggcagggtgtagtgggggctgaggcccaaaaggcagtcagggaccagatggcctcatatgccctgttaaggagcttgggcttgatcctctaggcagggagccgttggaggatttaagccagggagtgctgcggttggtcacactcgccatttatgtagatcgttttggcagccaggggaaggatggatttgagggggatgagattagaaagctgggatatgagttaggaggctgaaagatggttgataaaaatgatcgttgggcagccgagataactgacttcaaggacatatactggacttatagcagagcctgttgagtcttgcttttgcacacagttcaaataatcacttagtcatgtggtttatctgccagtggcaaatgttaagactgtggggaaaaactagaagaaccaataacatcatcaagaaataagtgataggaggcaaaagtcataaaagccgtacaaaaattggaaagttgactgttgaagcatcgtggttaagacaggatttgggttgctaggaaactttggggcaagtatttaaccttcctaagtgtcagtttcctcctctttaaaatgggagttagtaataccatccttattgagttattctgaggattaaataagatgatgcgtataaactattttacaccatgcctggcaagaaaacccagtaagtggaagctgttactgtgaatacattttgtggccttttgattagggtagtgttttccttagatctctaattttgtggatgttaattgtattataattacattaaaaagagttccatggtaaatcaatttgggaattaaagaggggtttgtttttttgagacagggtctctgtcgcccaggctagagcatggtggtgtgaccatagttcactgcagcctccatcaaacgagcct

SEQ ID NO: 72063 - DNA, 1078 bp, Homo sapiens
ctcctgacctcaggtgatccgtccgcctcggcctcccaaagtgctgggattacaggcgtgagccaccgcgcccggcctgaaactgctctttagggaggttaatctgtcagcaaagcgtgggctggcttggcgtggcaggaccaggttggcggcggaagtggaggttaggaagaaattaggatttgagctagggctctgggagaggtattcggaccagctggcccgactccctttctcacttcccctctcctgctgacctgaagtgctttccccacctctgtcacaggcacgtggtctcttagcttctttgtatacctctcctgtggcacttgacacacattttgtaagtcacttccctgtgtcccccactggcttgggggctgcattttgtcatgtttgtctttttgtccttggcacccagcacagtgcctggcacccaggatgtgcctgggtagtgctgctgagtgagtggtgataaccgggcttcaagtggaagtgagtaggagacagggctctggtgagcggggaggggaggggcagtgggggtgcaggagggagggagtcattgaggccggattaggcagagcatgagggatgggcagggctttgtcccgcaggcagttggagtgtggttctggagctcagggtgaatgctctgcttggagacagaaattcaagccactctcctccaagtgcttgtggaaatcaaggagaatataaaagtttgaaaggccactaggagctattagtgggttgggagaaggaaagagctgccatcgaagggaggggagaaacgagagaaacaagttggatgacctaacatcctgttagagactggctggaagaggaacccagaagtagactgcactgtttgaccctcaccggtcggtcgtatgcagagtggttgtgttcttgagctgaggaatgccggccttgttgcctgtttggctttgattacagtatttgtagcagaatgttgctatggagattcatgccaggtacgcagtgggaggtgatctagaagaccgtgtgccagccactcgtaggtaatcactggcgctcagaacatgctgagaca

SEQ ID NO: 72064 - DNA, 1031 bp, Homo sapiens
aattcatctggcaggattttttttttttttttttttttttgagtaaaagtgaccttcatacctgaatacccaagagaagtattgaggcctgagcgactccacttgataagcctgcatagttcacattaaattactcagcagtagtttgcttttctgggtgtagtgcttttaaaacaaggaaacaacttgaaaaccaaaataccttagctcacctagcgaggatcactgtcaatcctgtcgtcctggtcatgtgtggtgtgcctttctcggaatgggtgtaatgtgaaccgaaatttttggtcatggtagtttcactcatctggtaatgctatgcattggcttatgttgggggtaattgtgagacacaatagaagaaaatattttatgaactgttgaccaaatggaacatttgtgatggcgtgttaaagaacattctggttttggaatcacacactccagactggacttggccgcttcccagctgtgtgattgcaggcaagtcacttcacctgcctgagtatctgttggaaaaggataatatgacagtaatacctatttcatagagtgaggatcaggtgagatgatgcctattagtacttaacacagcccatcagtagggctcaataaaaagtaattgcaataattaatcacttatattaatagttctctttttgaaagatgactgacaatcattaataccagatcatcctgaaagttactaggatcccatttcaagaatgttgagtaaattatgatttgcaattagcctaaaaaacatttaccttttcctttttttttttttttgagaaaggatcttgctctgttgcccagctggagtgcagtagtacaatctcagcgcactgcaacctctgcctcctgggttcaagtgattctcgtgccttagcctcctgcgtagcagggctcacaggtgtgcgccatcacacccagctaatttttgtatttttagtagagacggagtttcagcatgttggccaggctggttttgaactcctaacctcaggtgatctgcc

SEQ ID NO: 72065 - DNA, 1039 bp, Homo sapiens
agtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttccttctggatctctttactgcagtggcgaccgtggggcatggtgggatgggggcatggaacagtaatgctagtgacactcacagtgacgccaacacgtgagtgcggggctgactctaggcctagcctgcttctagctccttcctgggatggaactcagtttgccctcacagacctcagtgaaacgggtgctgtgagcctccctgcctcagagtggaagacacagctgggcagtgagagccagacctgccacacaggccacccagccccagcacctggctctgcactgctgcgatctgtggaatgaacatggcaggggaagccgactctctccatgcctgagtgcatggcatttcagagccagctctctgggtttggggttcagctggcatgaggtctggtccaggcaggctgacctgaaga

SEQ ID NO: 72066 - DNA, 1067 bp, Homo sapiens
tggggagaaggtaaggacacggcgggtaggggtaacatggagggactttggggagctccctgctgccctctggccggggtgcagggggtggagaggccagacacagccagcccgtgaccagcctgctgggcccaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggtatatgcctgcactgggagggcgggataggcagggcgaggctctgggtggttctgatgagcacccccaccacctgccaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggtgagtggcccagaggggcacaaaggggctgtagcaaggtgggtgggctcaggggctcccaccagccaggtggaggaggacagcggagcctctgtgggggacgcctggctcgggcactgggccttaaggacctcagttcagagcccagcacccccaattattagccgtgtcaccttgggcaagcgatgtcacttctcaatgtcggctttcaattcccgcatctggaaggtgaggctggtaagccagggacacagcagcaggggcatctgccgcccagtgcgggcacccaagggcctgctgcagcacgtcattgtcaaccattgtcgtcgttactgtctgagctcaatcagagatgtgctttccaatggcccaagtgggccctggctgggcaggagacagggaggcccaggagggaggaaggggtgaccatgagacgacacctcacccccaggcactggcaggacctgggctacctcatcatctacgtgacgggccggcccgacatgcagaagcagcgggtggtggcgtggctggcccagcacaacttccccca

SEQ ID NO: 72067 - DNA, 1036 bp, Homo sapiens
ctatgctgagtgcaagaagccagacacaagaccacatggtgtatggttccatttataggaaatgtccataatagacaaatctgtagagacagaaaattgattggtggtggccaggggccaaggaaggcaagactgaggacccactgctcccgggtatgaggctcccatttagggaggtgagatgttctggaattagatagtggtgatggttgcagggcactgtgaatatactaaatgccactttataaatggtgacttttcttatgtgaatgttaccactattttttgtaatggtcaggaagatgcccaaggtgtggggctgtgtggccgtcctgttgaggaacggtcagagcagagccgtacacaggggcgtccccacctcgggaagccaggcttccccagcgttcccagtcccacctgagtttccctctctcctctccagaggacctgtccgacacagaggaaatgttccccaaggacatcaccaagtggagctccaatgacctcatggacaagatcgagagcccagagccggaagacacacaaggtcagcaggtctgggggtgctgcagagcctggggagggcggttgcagggcttcagccccctcctttctgaccagcttctgcacagtgctgggcatacatgtgagttggggacccccaagctcccctcgtcacagttgcagcctctgtccggtcggccaggttgggctgcccctcagctcacagcacggcttctgtgtctttgcagatggtctgtaccgccagggtgcccctgagttcagggtggcctccagtgtggagcagctgaacatcatagaggtgggtgcccgggtgtcagagggacaggggcatggccgccaagggaggggcagggtgcagaggaatagtctgaggggttacagaggtggaactctgggcctggcagcctcacctccacgcctgcctgggtactgtctggggagaggcctgggcctccttttttgctgccctgctaggaaggcgcctgtcgccctctgtctctgaggtccccga

SEQ ID NO: 72068 - DNA, 1020 bp, Homo sapiens
ttcccgccacagcatctcagagtggaggatgcagagtattgccagggactcggatgagagctcagatgatgagttcttcgatgcgcacggtaggcaggcagcgctctgcagtccttggggccttcctgggcgaggtggggaggggtctgaaagggcttagggtgtgggtgtggactgatgcgggtgttgcctgttactattctatatccagtccctatacctgcactgtcccaggtggacagcctggtgtttggggcagtgcacagaggatgagatgaggtcatcttgttcccttgagtctggggtctcagaacccgatatcaggatgtgctgtgggcctggcagatggggactgcgctcttgaaaccccaaataaggatacaccatcagactagggctttattccgtatgtgaatttatttccatggaagcataacttcttttaattttctaattttttgtacttaccttatttcttcttgattaaattaataccacatctaatgcaggcactttagaaaatgcaataagcagaaaacatgtgaagtgcccattttcccactagtcccaaaataagcgcatgaccatacagcagatgcaccacctgtgccaggaagaggcatgcatacagcgctcgcctgcttggtgccccagccattcctctccaggaagctggaggggccagcaggtgtaggggttgggggcttgggtccctctgcaagccagtggctgagccagcccaaagttcacacagcagctcagaggctcagaaagggatgggggcgagcccataggcactcagcagacacaggcagcaccagatctcatgtcaccactgtggcttggaggggcacaggaaccacataaggtggcattttggttaactggccagctgccctcaagggaaggaacctggggagtcagtgtccaggcagaagaaaggtgcctggtttggccctgggactggaggacctggaatggtggctggggactcccgagctggcctctgcaccaggagcc

SEQ ID NO: 72069 - DNA, 1041 bp, Homo sapiens
cttgaactcctgacctcaggtgatccacccacagtctcccaaagtgctgggattacaggcatgagccaccatgcacagccagtttctttatctgtaacctaagctaggctctcagagagcatagtttcccattttacatatggggaaattgaggtccacagggccagggttggagctcagatctccgggctcctaggtggcctctttgggacccctagtaggccaagggaggctgctgccaatctcagaggtgagggcaccctggcaggcggagaggaccaggaggtgccagtgtctagattggggaggaggcagcattgggagggatctcccctctcaaccccagcctgtgctgtggctcccaggcctgagggcagagcaggtgggcaggaggggagaggttcaggccaccccgacttggagacccaaggcactacctgtgcccttcctgtcaccaagacccctactgtcagcccaatttccatcttgagagctcttgcccctcctgcagggctggtgtgaatgcccctcttccaggcagcttcctctgaccctctgggtcctgagggcactcattcttcccagccccacctgcccgtctgtgcccgctctagcctttttctaacctgcggttcctggggttcttgtcactgtggggtgatggactcaaaagtgtgaacgtacgtcagaatcaccagctgctcctttacatgtgtacagcttattgtatgtcagtcatacctcagtaacattgctaaaaagtaagttaaagtcacctgactttcctgtgcacttcctgtgccaagggctgagttgcagagggggatgaaagtccttcccgttctctgggaagatagatttcacatacgtttcagcacaggctcaagggcacagtctgcactggcctcccaagatggataggccttcaagaagactgctgtgtttttgtggaaagaataataagaagaccttagttcatcatttcccacttctgccacttgccagccagtggcagctaggaataggccttcctctctgcaa

SEQ ID NO: 72070 - DNA, 1068 bp, Homo sapiens
ctgtttgttgatcagagagcttacacatagcctctcacttgtccttttggtagctgttagcaaacaagaaaaataaaggttggaaaggagagaacctgctcaaagttgcaccgttggatcatgcctgatcagaggccacaattccagcctcaggtgtagaccgggcctttcctctgtgctatggtattcaccagcctttgcagaaagtgactgttctgttctgtcctctctgtctcccaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacaggtgggtcgtggggcaagggtgggtcatggggtgagggtgggtcgcgccagcgcacagacaccacatgtgggttaggtggagttgtggccttcacagtgcagtgcctgccccagaacttcctggtaagtgtgaattgtgctggacccctggcctctaggcacgatgccaggcgcacagagcacaccatgggcgcacggcatcagattgctttccggcactgtgtcccgccgcctacaacgcgaacacttgcccttgcgttcagcaccattatctccctggcccagacgttatccctatgttttcctatgtttcagtttgcctgggctgccatcagtaaataccacaaactgggggcgtagaggaacacacttcctcacagttctgggggccggaagtcccagatcaaggcctggcaagtgcggtttctggtgagggccctcttcctggcttgcacatgggcgccttctccctgtttcctaacatggcagagagtgagcaggctctggtgtcttctctttttctttttctcctctgttttttatttgtgtaaatgtataggatacaactgtaattttgttgcatgcacagattggaaaatggtgcttgtagggtatctatcactcaaataccctgtactcattaagtaatccctcat

SEQ ID NO: 72071 - DNA, 1360 bp, Homo sapiens
aggtgccactctatttcttttcgtcgtgctttcactaacatcttgcaagtgtgtgtgtgtgtgtgtgtgtgtcttcaaactatgatattagtatattggggatgcttttatggagggggcttgtggggagtcaccgttccctctgccctgtttgcttctgctggggaagggagcaagatgtgggtggcttaagagagcctggcaagaagaagaattctcacccagaatctgttgaaaggatctggttttgaagctgaatggaagatcccatagcctgagctaccctcacagtggtccagaaacatgtgaatctgagccaagtctactgatgtgtgattaatttacaaataggcgtgcagagcagaacggtgtgtacacaggagcctgctgttcctacaaagctgcatcaagatgtcactgagttgggttttattttagttccaagtattgtatctgtttagcacccagccagcttggtgccgtgtgcacgctgggcaggctgagctggtggcgtatactgcttccttagacgggagaagcctttgaggtagttccaggccccacgtgctgggcccagagcaactcctcagattcacagaaagagctcatatttcatgggtggtcatttggcagaaagagtctgcacatgatgaaagggtggcacgttgggaacactggactttatgtcgagctgcatctgcccttttctccaaccagctgcagcgtctttctcctgaccagattcacaccacgtcttctgtggactcagaggacagacttcgagacttcagaaccatcatacaaagagaaaacaccttaacttatttggagttttcaaccattttttgaccttggagtaaagtaaaatgtaccttttcttttcttttcttttcttttttttgagactgagttttgctctctcgcccaggctggagtgctgtggtgtgatctcagcccacttcagcctctgctcccggattcaagtgattctcctgcctcagcctcctgaatagctggaactacaagcgtatcccaccatgccgggctaatttttgtatttttagtagagatgggttttcactgtgttgtctaggctgatcttaaactcctgacctcaggtgatcctgtcgccttggcctcccaaagtgctgggattacaggcatgagccaccatacctcagcataaatgtatctttctgcccttcaggaggaaagggtttgctcagcaagtgaataacatgcagaaggtcaaagcaagatgtatcatcctactcttagtcaggacctttctgagtgcaacagaaatccagtttgaactcaggcaaaaaggagacctaattggaatgttcatgttcaccat

SEQ ID NO: 72072 - DNA, 1066 bp, Homo sapiens
atcagcaagggcgactttgcctccacgagtagaatcagagagcccagagcagccgagggggtccagtaggcagccactgtggagagggtgtactagtcagacacgtattttaaggtgtcctggaggagaaaggctgcatgtggctccaaaaagtcaatcaagaccccaggttgagtcccagtggggcaaactgttcagtataggaactttctctaatagcagtaccttgtagcccatcccagggggtggttaagcccctctcacaggatgggcattgcagagaggagtctgtctgtctcccagctctcagtctgtgcttgtctcagaggttcatgcccccacccccaacagctgtggggtgaggtcacggactcactccacaaaggcagtggagatgatggtggcatacatagccagacccctgctcttgctcctggctggctcatgagtttgtgggttgtggggagtacccacaatgctcagtcttcagggcatctacagtgacggcccctcaccctctgcccctgcctgcaccagcccactccgtgtgtttcccagcttggtcttctctacccctcgtcaggccctccccttgctcgatcttgacacttggcctccttcctggccaggctgtctgcctgcatccagccctggctccctgagctcctctcggatacatcactgggcacatggtggagtggccatttcaacacatggcacctgcaagagctttcatctccttcccctggcccatcgcagatgagacacactgacacctcagctgtgaaggtgacatttgtctacacacacgcacacaaacgcatacagggctggatacaacaagggacaaggcttaggcctgctgcagaccttgggtgagtctctgccccacgtctccagcagttaatgaaagacaatcttgctctgggaagcacttcctgcatctgacttctagaagtctctgctgtccaggatgacagagggtgcccctgaatgcaggaagtgctgagtgttgccagtaccagtgcccctgtggctgcctgaccaccatccattccttcccatc

SEQ ID NO: 72073 - DNA, 1042 bp, Homo sapiens
ggacttgaacatgctctgtcactctgcaaatggtaggtgtgtcttgggagaagacaggagagggacaattgccagccttaacttgctgtctactttgtgcctcactttccccaccttgttgccatagtgagaggaattttcctcatcaagtccccatcacctttctctaagcaagactatgctcaggggctggagggcaggggagaatgcaagttagaagaccttgtccctgtcccctgtctaccatcagcctgattataagatcttggagaattcctttgacctctcggagcctcagtttcctggtgtgcacagcagagttagcgatggatgccctcaggagaatgggaaggacaaatggatggtgtgtgcccagcactttgtttcatgccagcgtcctcacttttcctgtcaccctgtgcccttgtaaagcacttcacagctttctaggcgtgggcacaccattatcacagcctgtggctgtgaacaggctttgtcaagcctgtgcagacagagaatggggaatgggtaaatttaaaacactccttccgcctgacttcatttgcctgctgggcctgtgctaattgcatggctgaagtcccctttccaggactctagattcctgagatggaaaggatcgggactgggctgctctaggaccttcctaagctggtagaagagcaaaacttggtagtcatataggctcgggttttgagtcctggctgtgtgacccacagaagctgcttaatcccattgcacctcagtttcctattgtgtggaatgggagtgatggtccccccatgggcgttgtgtgagaattcaagattctgtgcttcttgcctgcctcgtcgcaggagcgtgtgaagcggatgatcgtcttgtggggctctcctccagtgtcagattgctctgtaccagaggctgtcctaggatcagggccaggccaaccgctgcttttcatgctcccaaatgtttggagagccagtgcggtgtcttagccagcagagctttctgtcaggaggtgtgatcatcgagccgtttg

SEQ ID NO: 72074 - DNA, 1050 bp, Homo sapiens
ctttttatgcattgctttacagctcagtgtctcacctgagtgagacaactgtccctgtccacttctggaaagagctgcctctgttccctcttttcctccctggtgctctgttgcatggtctggtgtattacagggattggcatgtttgtgtctgcaggggagcctctgggtgctggctttctgtccagggcttctgagggccgccagcccaaagggaagggattcatcagagactgataagcttagggtgtactgagctgtgaggccatatgtgtgtgtttgtgtgtgtgtgtgggtgggtgggtgtatgtgtaggcatgtgtgtgtctatgtgaggtgtgtgatgtgtttgcatatgcgtgtgtggtgtgctcatgtggggggtgtatatgtgagtgtgtgttgtgtgcatatggacatgtgtgtatttatatgtgcatgtgtggtatgttgtgtgtgtgaggtgtgtgtgcatgtgtgtggcatgtatatgtgcctgtgtgtgcctatggggtatgtgagagtgtgtgcagtgaatgtgagtgtggcatttgtatttgggcatctttaactttgcattctgcttctcccattttctgcttcaattcccagagcagggctcagcaaactccttaacctatgtctgcactgggatcttaaatccacttcacagacactttcccaagtctcatctgatttaacagtttgcagccaccctagaagtacttggcgttgctcccattttacagataagtagaccgagtctcggagggttgagtagcctgcctgtgaaggcagaaccagaacttggatccttggctctttcactccttcgctccctccctccctctgcctcactcattagttatacatgcaacctgctctgcaccgggcatggctgctgggctcttggcctgaagactatattcagcccttgtccttcagcgggtgctcagtatgggaggaggccaaggaggttgggtgaggagagctggggggtgctcactctccctgcactccacggccacccaccttagttgtctgagaaga

SEQ ID NO: 72075 - DNA, 1153 bp, Homo sapiens
cgccagggagacagggcatcctggcttagtcatgctggctcacacaaagagcccttctctgaaggtccctggtgttcatacatgacaagacaggccctgtgagcctctgcgctgtgctttaagcattgagtctgtctgggggcagtttgcagagggtcccaccattgtccctgtggagttattggccatcctgtatcttcaagttgcattttggagagtgggcttttttctccttgtatttttttttattgtggtaaaatatacataacataaaattttctgtgttaaccacttttatgcgtatagttcattggcataagtacatttagaatgtgtgtaaccatcacccctatccatttccagaattttttttatcatcccaaacagaaactgcacccattaactaacaactcccaacccttttcctcacccccagtagcctctgccgtactctttgtctctatggatttgcgtcttctagatgtttcataggaacagagtcttgcaatatgtggccttttgtgtctggcttcttttgctcagcatcatgtttttgaggtttgtctgtgttgtagggggtgggctttttgaagcaaaggggatgtcagcactgtgtgctgaccctataccaggtgctgccagggagcaaaagaggaagagaagcccaggtcctgcccaggagcccccatctgggtcacgcagatggcgctagctcacacctacttagttactcctcagctcctggatctacctgtttgcatctctccagacaggtgcccctcgaaatcaaggactcagttccacatgtagcactctacggtgcatgccacaactctaggttcatctcagggcctgatttctgtgcttgggcacctgacatctctcagccttgtctctcccatctgtggaatggatctggttctctattaagagccatacttggcccgattaagctggcttcccagagtcagctcagagctgacccttgatgggggaggggggtgtgtgggatggtgcttcttagattatgacttttttatttattaaaaattaattcagggactttgatgtatcagactttaaaaggagttgacaggtcacatggtctctgaaagcacagggctggtaatccatttaagaaaacattttcttc

SEQ ID NO: 72076 - DNA, 1057 bp, Homo sapiens
tgtacacatgtgggtgcacgcccaagaaatgattgtttctaaagatggcagcgcagagcaatcgtcagcaggggctgccaagcgggatctgtgcccagcacagggccatcggttctgatttgcttagctctccctgtcaccacaggggcgactgtccagcaagcttggctactgccaaaagccagggtctggagcagagataaccgactccccaggggagcagcccattcccctgggccccctcaccacgttccaagccctgaatcagcctgctgtgcaaggatggtggagtggagagtcttggatccccagcagccaccctaatgtggacgcactgccgtgctgtgagccccagtgccccgaaaaagaagtgaccaaagaaaaagtgttgtatgagggaaggataaacatgcttgcttcagtgcgccacgaagcccagaagttaatctgatcatataaatattttcacgtgtctgtggttctgcgagggtgtactgataaatagagtgaagaaaggagaggttgtgtggctgcagtcttgccctgggggtagatgtgatgtttgttcccaactatgagtcagacgtggggtcagagccaggaggtcggtcagtccaaggccttcgattcttagatgggaacctggccttccctgccctcggccccacctgggagctgcttctaggaggtggagggaccccaccccactgcctgtgcttggtttcggagaaggctgtctgggcctttgatgcatctgtgcagatggaggacggtaatttatggtcctgtgggggaggagaagagtttctccaattaccagcttcccaagttcctggctttatggccagagttggaggcagctatttgggtaacgtccccagaggactaagtccgctttcctggggcagagcagatgatggagacttccatggcattgtgggtgagcctgatgcgccggaggacaagcctggcaggaagcacaggatcacaggccttggctgggctccgcttcagcctgctgggtgaagacatggggcctttccgaggtcagccggag

SEQ ID NO: 72077 - DNA, 1045 bp, Homo sapiens
gcagggggagggattccagatgcccccgggcctgtggctgtctccttccctgttcctctctgctccttcctcacaccttcctccctctttcttccttctccatgtccttttgggttctctctcattcctcgcccccctccccatcttcccactgcctcttcctagctagaagcagattctggcattgggtgaggaacagaacgcatgcccaagacacacttttcatggaaaaggattgaagtcggtaagctggcaagaatcccaggaactcaccgtgaataaaatatggttgctgtgcagtcaccaatcatgggaagtggcttcccgcgagcccattcctcttctgtggcctcatttaaccagggccaagagctggggcatgcaagcagggcatgtgttaatattgcgtaaataaatggtgcctgggtgtgcttgctggctacagatggagattgagctgccatcacatgggagcggggctagtccctcaaaggaggggtctgtccccctgtcccaattcccaatgtattcctggtgctttagggcttcaggggacaagccacggggccactttggctccctgagcaggcgacatgtgtatggatccatcattcagccctgagtgtgggctctgagctacagggctgcagaagtgaatcaattccagcccccactctcaaggagctctcaggccatcacaggcatcagtcatgggcggtgatgatccttacgatagtgccaagccttgtggaagtggggttgggggggtctgccactggggcgtggagcccatgaagggagcctcaggtgctgacgcttggtttagatcctgtggggtgctgagttcacacgacacaggaggcagggttgcgtgtaaacaagggagagtcttcctggtagagggaaccgccttcacaatggccccgaggcaggaggagccccatgggctcctgtctgtgagagtctggctggggctgagctgcagggaggaccaggttgggggcctcgtgccctagttaaggagcttagatgtcgccttgaaacc

SEQ ID NO: 72078 - DNA, 1016 bp, Homo sapiens
tgggcctcctccctctctgtagaggagtatcccacttgtcccgccagtcaagccctggcagaacagtagcttcccaatcttgctgtgctgggtgttctccgaggaacatagggaggcagattcagagagccagacttgcctttgccctcatctccaaagggagtcctggtatgaggtttcattctttaaaaaaaaagatatatattttttttttcagcaaaatcgacagttctgggtgagcgtgaaggagggaatcagttgcctcccttatctggcaggtgcttgctgtgcccactgaatcagagatccagtgaggaaggggaactcagcccctgggatgggggtatagacacatgttagaatgcatagcacatgcacagaagggaggcacagagtgcagctagagcagagagaaggcagcagctgacatctgatggagaagatttcatacaagagggagcatttcaaatgggctttgaaggatatggaggagtttatcaggagtaaagggggaaaggcagacggaccagaatgagccttcagtactcaaagtgcatggtatctttggggagtgctgagaagtttcaggttcttgaagtacagagacaaaggctggcaggatggagattgggctgggaaggaagccggcccctgagctcagctctcaggagtggacacttgggagcccgtgggattcgggggactcactcgccaaccttgtggctgtctctgtggcatctgtttgtttgcttctaattaggaggcgcttcctcttctccatttgcatattagctgactgcagccttgaactcctgggctcaagcaatcctcctgcctatgcctctggagtagctgggactatagatgcaggccaccatgcctggctaattaaaaaaaattgttctctttttgtagagacagagtcttactatgttgcccagcctggtcttgaactcctgaactcatgtgatcctcccacagtttcccaaagtgctgggattacaggtttgagccac

SEQ ID NO: 72079 - DNA, 1032 bp, Homo sapiens
tttaaacccatgattcagttagcctggtgtggtggtatgtacctgtagtcccagctactcaggaggctgaggtgggaggattgctttaggccaggaggtcaaggctgcagtgagctatgattacaccattgcactccagcctgggcgactgagtgagacctgtctctaaataaacaaattcatgattcagtcccttggaatacaacgggcaaggaaggttggtgggggctgagatctgacagccctacaggtaactgtgtcaccaagaacaggtttcccttaaacctccaggacccatacacttaggttgatcactgtggggtgtcctctcattgcatcgagtgacttccatgtgcttctctgtgaagaaagctggtatttttcttttttagtgtgcaaggctgctctaatgacaagctttaaggtttcctgtggctagtgggattcagaatgagacctgtgaagttcccagctcagcatgggaagaatcagttgtcgtctttacactcctcagtatgagggctgcctgtgggggatgggaggaaaagatgttgcttttgctgtcttgggaggagctgaatctataggccaaaggggagggaaatccagtttgctttttctttcagttttttaacttcatcgtccccatcacagtaaatgtattgttgaggaatgacaacttggaaattacttccattgattggtgtatgggctgccccaggagaccattctcaactgccctttgctctggtgggcatgtccttgcagaaggccacttcttagtgttttcttctgaggctggacgaggatgcggagacagtaaggaagctggaggcaagctctctgcccttaagtagctcagggcagcatcttcccccacagcacatgttgttcagcactttccttcctctccccagccttctccctcctgctctgggatgcagcactctaacacaccttgctggggacttccttgcatttctgtggcaattctcaggtgtaggcagagttctgtgacaactgaggttgagt

SEQ ID NO: 72080 - DNA, 1070 bp, Homo sapiens
tcacaggggatgcgatggcttggctcgggctcagaggcctgacagggagaggcagcgggtgtgtgggggctgcgagcctgttgggccccagatgtgttctaaaggtagagccaggccaggcatggtggcccacgcctgtaatcccagcactttgggaggccaacacgggcagatcacctgaggtcgggagttcgagaccaggcttcagcctgattaacatggagataccctgtctctactaaaaatacaaagattacccagatgtggtggtgcatgcctgtagtcccagctacttgggaggctgaggcaggagaattgcttgaacccggaggttcaacccggaggcggaggttgcggttagccaagatcacgccactgcactccagcctgcgcaacaagagtgaaactccatctcaaaataaataaataaataaataaataaataaaataacaaaataaataaaggtagagcctagaggaattctgaggcattgggtgcctcttgcttaaaagaaggttcttgtggacttggagagatgcaagaagtcatctaggccaacctttacacctaacccactggaaaactgaggcctaagaaaagaagtgacttgtccaaagtcccatggcaagctggctagttgcagagccaaaatttgggcttctggaatgcaggtccagtgtttttacagctgaaacaatgaatggtcccagtgaggttgagggccaagggaagaagggctggccccagggtcccagagccaagccacagggtcctgacagcacccacagaggccaagcccagcctccgctggccagcaggagcctgagactttgtgagctgaggattcttggcactctgggccttcagcagctctctctggaccagcattttcaccttagctgggctgcagtcttgacgatgtcaggccttgggcagatcaaagtcagtgctcctgtgcattattcacttggctcatgctgagcctccatggagtgtcaggcccgaacaaataagagagtcttgctgtcaaggagctaacagttcaagggagacagacgagcaaacccag

SEQ ID NO: 72081 - DNA, 1035 bp, Homo sapiens
tctgctttcccaggtctgggttttgttctttgggctctgcttttgccacttgccagcagagagaaaaatcgctcctaacagtcttttaatggccctgcaaatgcttccaccttcactggaggtctctccactttgaacgtctctgagggtttccctgctgcctccaataatctgggcttctgaaagagaagctcagctccagagtacagtgtttgttgaagaagatggaagggagggggagtagggtcataaaataagaaatccagccagccagcctgcccaaggcatggggtccatgatgccagctcctcctcttggcctgtgggagggtgggtaatggtggagggttcagagctgttcttgggagaatacagggaggtgggcgggtgagaggatggagacccagcctcagaagggcctggagcagcatgcagggagctggagacacatctcagccacctgactttccctgagtccccactgctcagaggctgtagcacgcctggccctcatgcagggatctcgggtctacaccgtaactgtgcctgggaggtgccttccttcattttccggaggaggaagctgaagatcagctcagtgaggtgaagcagcggtagtaatcacagcggcagcaaaacactgagcacttactgtgtgccaggcatggtgctaagcacttgctttctttagctcatcgactcttcagccattctatgaattaggtaccagtatccactttcttttttagatagggaaaccaagtcccagagaggttaagcagcttgcttgagtgaggcctcatagctgggaaatggaggaccacatttcagaacctacctacctccaggactcctcttgccacccagttccgtggcctcttctaggctacatggctttccaaggggcacactgggacaaaggggagaaatggcacttggactgtgctcatttcctggcgttactgggctgattccagcctgattccggcctgatctagttgccaggttcctcccatgcaagctgtctttaaaataa

SEQ ID NO: 72082 - DNA, 1039 bp, Homo sapiens
ttactgctgagataattgtgggccaggaaagtgtgcccttccgtcccacacaaggcaggactgaaatccataggccctcatttccagcctgtccccaaatgctctgtgccatctcctggaagccctctgggattagcatgattcatatgtggttccctggggtcctcactgtgccctgtgtgtgacacattaattcacaagtactactggcctgggcgacttatcgagaccccatctctgcagaaaattttaaaaattagctgggtatggtggtgtgtacctgtagtcccagcacttgggaggccaaggcgggaggatcacttgagcccaggagtttgtggctgcagtgagctatgatcgtaccactgcactccagcttgggcaacagagcaagacctcatctcaaaaaaaaaaaaacgcaaaacaaaattcacaagtactagcctgccattcagatggtatgcaggagtgtgcatgttcatgtgtgtgtgttgttttccccgtgttcctctcccctctgtttcctctgtaggcaagaactctatgcatttttctgtgtctctgtgttcccccagtacaagtacccagcacaggactcattatgctgggttgtgggccagcctcagaaacataaatattaggagatctactaaaagaaaaaagagaaaaatatacaaataaaacaactactgtgctttcagttgatgccagaaaagcatttgataaagttcactatccatttaattttttttttttcttgagacggagtctctctgttgcccaggctggagtgcagtggcgcaatctcggctcactgcaagctccgcctcccgggttcacgccattcttctgcctcagcctcctgagtagctgagactacaggcacccgccaccatgcccagctaattttttttgtatttttagtagagatggggtttcaccgtgttagccaggatggtctcgatctcctgacctcgtgatccgcccgcctcggcctcccaaagtgctgggattacaggcgtgagccaccacgcccggc

SEQ ID NO: 72083 - DNA, 1026 bp, Homo sapiens
ttggctaacatggtaaaaccctgtctctactaaaaatacaaaaaattaggtgggcgtggtggcacgcgtctgtagtcccagctacttgggagactgaggcaggagaatagcttgaaccagaggcggaggttgcagtgagccaagatcacgcctctgcactccagcctgggcaacagagcgagactcgatctaaaaaaaaaatggataaagtagctcctggttggagatattccttatattgttgaaatctttgcctatccctcagtctctatgtttttcagagtaatgaggctggggccggatgcggtggctcacgcctgtaatctcagcacttgggaggccaaggtgggcgtatcacctgaggtcaggagttcaagattagtctggccaacatggatctggggacatagagatttgagcaaactttttcgtgtacagtgagggaggagcgtgtgtgtgtctgtgtgtgtgtgtgtgtgtgtgttcattaataattgtgatgctaagattgccttcggtagttcatctggatattttttccacattcctcatgtttctactttttcctgtattttggattctccatttgaaggcagggaaagaggaggaggttgaagggaaaagtattctagtcctttccaaacattatcatggaagatttatcaagggagatcgaaacagtctcttcttcccaccacctactatcatcccacagagtttaagaaaatactcaaattctctctcttccattggcatcagattcacagccctgcctgtggtgggaagtgactttggtgcattggcttcattcccacagtggacataattgaggctctgagtgatcaatgtatttgttcagggtcacacagccagcagacaccagagctggaactagaattggattttcctgactctacagccagcattcttctttctgctgctctgtacacaatggcaggaatgaagtaggcagatggcagggatttgccatggagccatatctggggctcttatgggacttgcctc

SEQ ID NO: 72084 - DNA, 1638 bp, Homo sapiens
cgctgaagcaaagttttgaagtggcttacttaattggtccagagcacgatttgtattaacccagcaaggaaaatagctcactaatttatatttgagtgtgaaatagcttatgcatttgctgctgggagtagcaagggatgcatttagcggattcttgccattagtatgcagctgagctcctgtcctgtactgtgatagagagtattagtttgacttcagttcccagccttgggtgactcaccagagcattgtgagttcacggtagtgactgctgaccggtgcaatttgtcgtgcactctttgaataccaagattttatagtacctgatttcacccatttttcattttacttcaattattcctccccaccacacccccactaaaagttctctttcctgaggaatgttctgtctgactttccagcaggggggataaaggaatttagaatcaaacaaataggagagccagaaggagcactggaaaaaaccgagtccaagggtttgacctttccacaaaggggaatgactttccatttccctgaaaccctgagatcacagggctgggtgtggggtgttggcagtggagcgggattaagactcaaggacacagctagtgagctggaggccggctcataaaatctgggacgtgcagctcactcaggtttgtcttggtggcctgggagctgcaggactggtgcttgcagggttcaggccagtggctcctataccatacccagcctcgtcgactctgtgttatgggcttttctggtgcttaagattcctgctccaggagacggctgctcttccctctccaggagacggctgctcttctttctccagggaagcctccaaaccagaggcatccctggcgtatcccagctgcttctcaggctggggggatcttagctatttgtgtttgagttgctggtgccaggcccagtggcatggtagtgatccagcgtctgtggattgttcttgcagaggcagtggctggaggtgcagaggggaggggcctttcccgcttacccaccttttgtctaagacaccgcagtgcatggcatacttctgcccattgtgcttcacaggactctcacaaatgttgctgtgcccattttacaggtgaggaaactgaggctcagagaagtcatggtatggccctcagtgctttcattttttgtgtctcacagatggggaccctaagactcagagatgtcatgacttaggcctcaccacacagggagttaactgctggctggactctagacctgatccctcatgttcatgcttgtgtttggtcatgttctgttacacagcctgtgctgttgttttaaaaaatccatcagtatttcctgatctagttgagtctaagcagtacaaagtacctttcaatttgggtttgtatggggtttttttttttcccttttcttttttccaagaggaaaacagaattcctcttctgtttgttctgtagcttttccttttcaaagaggccaaagggatgcatggacttagagcagattcaccaagacaggattacatgctctgggatcacatctgtctatgtgactttgaggccaaatttggacctacttgtgaagttgtccagccatgcacctgtaggctggaggttagagagcagg

SEQ ID NO: 72085 - DNA, 1028 bp, Homo sapiens
tggctgggcacagtggctcatgcctgtaatcctagcactttgggaggccgaggtgggcagataatgaggtcaagagatcgagaccatcctggccaacatggtgaaaccccatctctactaaaaatacaaaaattagctgggtttggtggtgtccatctgtaatcccagctactcaggaggctaaggcaggagaattgcttgaacccaggaggtggaggttgcagtgagccgagatcgtgcccctgcactctggcctggcgacagagtgagactctgtctcaaaacaacaacaaaaaagacaccctatttaatatgtatcattgattcattaacattaaactcctggccatcaacactgtgactcatgtctgaatgaagcttctctaacacaagagattttctctgcacatcataatcatcttgcacccaagaactagactgcacctcagcactgtgattgggggccattccaaacagcaaaatcaccaacacaaagcacacaagtgccaaaaatgtggcactgcacagaccacaaaaaggacacgtgtttccattaggagagctgagatgggaagatagaggatgtcccctcgttcaacctcagcagggaatgtgccatcaggcaactcaaattttttgccaatttgcacaaatttgaaaatgaatttgaaagcaccatgagcattgattttggggttacagataaattttagtgactagggtaattcacaaatatggaatccatggatagtgaggatctgccacctttggcatcatgtcagcccccacggtgtatccagcctagctcagggcacctcacaatgctgatggtacttaatggatgaagactggagctgcgggatgaggctgtgggcagattcttgtgtttgcttgtcttaggtgctacagaaagacaagctgtcctccctcagccctgctgtagcttcttctagaagggctgctgccagcagaatggtgcccatctctctctgctcaagtctacaggtaggagggaccctgtactttca

SEQ ID NO: 72086 - DNA, 1123 bp, Homo sapiens
tcggtagagacggggttctcaccatgttggccatcctggtcttgaacttctgaccccaaatgatctgcctgccttggcctcccatagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttgtttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagacacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaa

SEQ ID NO: 72087 - DNA, 1013 bp, Homo sapiens
ctgtagtcatagagatgacatggtacataatgtccagcaaatgcacatttatggcttgattcctcacatatctgaggggtctatggaaataaagtacaaatcaggcagaaaagacttagtaacacagttcctaagaatactggggtagtagtttattatcaaactaccatagagctcttggcagggcaggaaattatttccagcaaaatttgtgcaatatagtggatttaatcaaacctgcaactgtcaaccatacatggtccctcatgacaggtaaatataatctacctgtctgaatggtaaaaggctacaggtgtgcatttattttttaaagcttcttaaagactcatagcacaagtggcacattgaaatctagtgaaaacttgagataatctaaaaattaaagtgacaaaagtgtctaattttactacatatgtaggtgcagagttcagatttcaagtagcgtccagcaaagcacgtggcttttctgggcgagaaggggatagcttttggttggctatcacagactccacctacatctcctaacacccactggcaggcacttcctgtgcatggttctgcccacaagctgtcacctttagatgaaacatttgaaggggcaattatttggaggatactggcaataatttttagaaaaacaacctatatttataccaaataacccccaagtcaccaattaagaccaaagtgctttctgaacttacacgtgacaggttatcaaatttgttaaatttttggtggctaaaaaaccaaacacaccagagggatgcttaatttaaactccaaaaaagctcatttttttgcaaagcgtgaagagaacatcttagaccacctaacaaatgtcagtccaaggcagtttttaggtcaactgcttcggacataatctacttttttatttcagaaagtatgctacctcaaggctgggcgcagtggctcacgcctgtaatcccaacactatgggaggccaaggcaggcagatcatttggggtcag

SEQ ID NO: 72088 - DNA, 1045 bp, Homo sapiens
ttgtaattttagtgtttatacttgctcttttgctaaaagaaaggtcagtttggtggtgattatagaacttggtatagaattctaattaaacttttcccattgttttcacctaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatggccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcgtatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggagggctctcagagtagctctctgcccattgttctgaattaacttgtgtcccaccctggacaataaatggacagataaaccctttgaaatacaagccaccaccccgtgagggattaagagggcagcctggttttcttagtgtgca

SEQ ID NO: 72089 - DNA, 1029 bp, Homo sapiens
ggtggaaagggtgtgagatagtcatgtttggagaactgaagcttgctggttacagaaagtcatgttgccggccgggtgcgttggcgcacacctgtaatcccagcactttgggaggctgaggtgggcggatcatgaggtcaggagatcgagaccatcctggctaacacggtgaaaccccgtctctactaaaaatacaaaaaaattagccgggcgtggtggcaggcgcctgtagtcccagctacttgggaggctgaggcaggagaatcgcttgaacctgggaggcggagcttgcagtgagccgagatcacgccaccgtactccagcctgggtgacagagcgagactccgtctcaaaaaaaaaaaaaaaaaagaaagtcatgttgccaggcggtcaggcggtttggggtgtccgcttgaggtggtgatgagtctgcccagctggtggcttttttccagcaaagctcagtggtaggagttgagacctgaagcgcggcctttgtagtcagccagtcctcagattttgctgccagtcaggtgtggtgaaaggtgagagagaaagtatcgtgagtgtggacttcagggtagatcaagaggacctagtcagactaggaggggttgataaatggaaaatggagaggccaaggatcgtaggtcacgttgctgaagcttgagggcgggaggcagaataggggcacagtctttggagtattggtttcttaaggggagtgtgttctctggttttgacaaaagccagcaagtaccctctgaggtggctggctgaggagtagagggtcacctcactggagagagtggtcaggaagttgcctagtgtgagaacaggcataggtgtggagaaaacaaggcaggctctaaagtctggggaatgactgggggttaacatgatggtgggaacctcagatgagctgggggagcaatgtctagaattgcgctgttcagtacagtcctgccaacagccactattactatttaaatcaatcatgtcaacctaaaatcagtgacagagactgac

SEQ ID NO: 72090 - DNA, 1372 bp, Homo sapiens
ttggtaggctgaggcaggtggatcatgaggtcaagagtttgagaccagccttaccaacatggtgaaaccccgtctctactaaaaatacaaaaaaattagccagatgtggtggcacgcagctgtcatcccagctactcacagggctgaggcaggagaatggtttgaacctgagaggcggaggttgcagtgagccgacatcgagccactgtactccagcctgggtgacagagcgagactctgtcttaaaaaaaaaaaagctgggtgtggtggttggtggtacgcgcctgtagtcccagctgctcgggaggctgaggtgggagaatcacttgagcctgaggggtcgaggctgtactgagccatgatcatgccactgcactttagcctgggggacagggtaaaaccctgtctcaaaaaaaaaaaaagacatttaaaaatgtgtattaatacattatgccttctgtgtaattaaatatataaaaattggtcttataattaaaaacaaattttgcaagatcgggctgggcacgtggctcacacctgtaatcccagcactttgggaggccaaggtgggcagatcacttaaggttaggagtttggccaacatggtgaaaccccgtcacttctaaaaatacaaaaattagctgggcacagtggtgggcccctgtaatcccagcaactgtggaggctgaggcaggagaattgcttgaacctggtaggcagaggttgcagtgagctgagatcacgccactgcactccagcctgggtgacagaggaaaactccatctcaagaaaaaaaaaaattggcaagatcttagcatttattaaaactgagaatgggtgagtagatgcttgttatagtattctttgtaattttccaagaatgtttgaagatttttttttttttttaagacggagtctcgctctgttgcccaggctgaagtgcagtggtgcaatctcggctcactgcaaactccgcctcctgggcttatgccattctcctgcctaagcctcctgagtagctgggactacaggtgcccgtcaccacacctggctaatttttattttgcatttttagtagagacggggtttcaccatgttagccagggtggtctcgagctcctgacctcgttatctgcccgccttggcctctcaaagtgctaggattataggcatgagccactgagcctggccctgaaatagttcttaatttaaaaactgggccgggcgcagtggctcacgcctgtaatcccagcactttgggaggccaaggtgggtggatcacgaggtcagcagatcaagaccatcctggctaataacatggtgaaaccccatccctactaaaaacacaaaaaattagccgggcgtggtggtg

SEQ ID NO: 72091 - DNA, 1041 bp, Homo sapiens
tcataagaaagtccgggttaaatgtcattacagaacttaaatgtgttagattaattactgaacattgtaaaccctcttatgcagaggcatttgctaaaatgaggaaatatcttaggatcaaattgggatccttggaatgtattttgttctttgcccagctgtgtgaccttaggcaagtcacttaccttttttggaattcatttttcttatctgtaaaaataaggacaaggggctagaacatctcaaaaggtcttttagccctaaaatttcagacattttattcctatgttaatggaaggaactatgaagatggatcttcattaggttgtatgggttttctttctagtttttttagttctttcagaattagcttggctataatctcaacattgtcttggtgatacccttacagaatacattatttttatattagatctgaattttattatgatttgggtgtaaataaagaatattaataagtaaataataactttataatgacatttattagaaaaatgattttaaattgtaatttgtgacccaagttgtaattgtcaaatgaggagctttttctagggccgggcacagtggttcacgtctgtaattccagaattttggaaagccaaggtgggaggatcgctagagtccaggagttcgagaccagtctgggcaacatggcgagagcccatctctataaaataaaataaattgtaagagaagatttttctaggtctttgttaattaatcttagtagaacataggaaattctttttttttttttttttttaaagaaaagatgtaagtaacaaattgaacatttgagagagataaaagagagagcttcgggttggggaccagggaaggcctttctttagaggaggctcataagcagaggagtcacctgtgcatagaattgctggagcaggaggtgtggggtgagggatgggagggtgggcagggtggggtgtctgggaggtggtccatgcagagaaattgccttggtaagtcctcaggtaggaaagagcttagcatatttgaaga

SEQ ID NO: 72092 - DNA, 1047 bp, Homo sapiens
atttcattgacttccttggaagatcctgtgatattgtctaagtatgtatttcagtgaatggcttgtaatgttaatagattttctgtgatatctgattgaaaatgatctttattgaacttcagtattgcataaagtcttagagatttagcatttttaagatggagcatataaaaactttttcacttgattgttaactttttgtgtattaatctatatattttgtagtatgcaaaggaaatatgctatatttttgcccatgagaatcattgtgttcttggtttctcttgtgggatggagactgaagatagctttcctaatatatattttttattctcactgaataaggattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacaggtaaaatttataatttagctgtgaagttttctccaccttggatgtattattttcacagaagtataatgtgagaaaacactttgaaaatactttggatctgaaattttaacagtcatgtttgcctaagtatttttgaagctaaacccccctcttataatacactaataactgacgtggagccatttgtttcacatgggcaaaatactgaaacagttgagcgaattttgtatatgcagagtaatgtcattgatgggaggagcagtactatggactttctaataagtctatggcttatgtcctgtggcagttcttcacctttttaataggcccattccaaaaaaacccacaaagatatgcaggggagaatggccttatattcaggatagcttcatacctattttagaatcacttagaaaatctgatgctttcactactagtattagtagtagagtccttgcaacatactttaccattaaacgggacttgatcaggcatggtggctcacgtctgtaacccagcactttgggaggctgtggcaggcagatc

SEQ ID NO: 72093 - DNA, 1020 bp, Homo sapiens
gtttcaccgtgttggccaagctggtcttgagctcctgaccttgtgatctgcccacctcggcctcccaaagtgctgggattacaggcgtgagccactgtgcctggccaccagcctcaattttgtttataaactaaagataaagtatcacattatctttagaataatatctcatcatattttgaaacatgatattcttgtaacagtcataaaaatatgatgtttaatatactttcttacccaaatctataactttttatttccagcatatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaataggtaagtagaatttctatcatttgaagggagtttattacatttagaatctagtgttccttttaatgcactataatagaatgagatgtatttgaacatttatcagttcattgcctgtagaaaattgaaataaacaaagcacactatattctaatgacactgactttcttcccatctgtaatgttataagactactaaactcttaaggtcggaagctttgccagaaaatagaaaag

SEQ ID NO: 72094 - DNA, 1123 bp, Homo sapiens
aacaagatttgactgtcatttggggcagtggggaaagaatccccactgcacaatgaagggctgttctgaaagttgggggaaataatcctctggaatagctgagatcagagaagctggaaattaatcttattgtttagcacagactttttctattttctgccgatcctttggagtgttctctcacttctggagaaggtcttcttgttgtgttcttaaaaagagtacagtgcggtctttttactggccgtttccttttgtggagcaacttgtgatcagattttgaacaaatgaggtgccattagaaggattaaatgtcagtggttttgtactgctctgctaaatcttgaactgctgaattattcaacactttgatagaatgaagaaaaccatttgaattatttatgtttcaacagaagtagtccccaccttagtacaaatggggtatcctctttctcagggaagaccagaccatctgtaattcaaggtacagttgaagtcctaacttctttaatgcaagagctacaaaacagtggaaagactgattcggaactttggaaaaactgtgaggtatctaattttgttttatttttggaattttaaaataattatgttaaaacatacctctactaaactctaaattattagaaatttatgtcctgaagagcatgacacttttaagttaatgctaaagtggtcaagtatattaatttgggaatgatattgaatgaatgggaaaaaggtgatcaaaagtattttttaacaatatattactgattagacatactaatttgtatattaaatatgaactaaaacattgtcttggttcagagacctgagaatcccaaaattattaaaattgttactaattgtaatgttgtcagtaacttatatggaattgtcatcattttgaaaaacctaaatccactttgaaatattttcaatgttctaattataaattgaagcttctatttagtaccttaccatattcagctgtgatacattgcattatattgttttcagatcagtggttctttctttggttcataggttaaattgtgatataaaaatgtaacagttaaaagaatacttacatggccgagcacagtggctcacgcctgtaatc

SEQ ID NO: 72095 - DNA, 1046 bp, Homo sapiens
atcaccactatctaattccagaattttttatcaccccaaaaagaaactccataccagctgcactcactcacattctctccttccccagctcctggcagccatttgtctatgaatttgcccattcaagatatttcatatcaatgaaatcatatagtctgtggtcttttgtgactggctttttttacttagcatagtatcttcagtgttcatgtatgttgtagcatgtgtctttttatggctgaatcctatcctgttctatgaatatgcttcattcgtttatccatttatccattgatggacatttgggtggtttctacattttgattattatgaatactgttgctatccttaatggagatctgtatgaaagcagttaaggtttccaaagttatgtaaaaacagttgctagctttggtggctttttatagtagtatttttttcccccattcattttcagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgataggtaagaatgggatttaaaaaaaatgtaccaaatcagaataaccttatttgcatacgtttatcaacttatccaaatagtgtcatagttactgatttgaattattattattttttaacctatcatcaagaatgttcagggaggctgggcgcggtggctcatgcctgtaatcccagcaccttggtaggctgaggcgggtggatcacctgaggccaggagttggagaccagcctggctaacatggtgaagcctcgtctctactaaaaatacaaaaattagccaggtgtggtggcacgcgcctgtagtcccagctactcaggaggctgaggc

SEQ ID NO: 72096 - DNA, 1071 bp, Homo sapiens
tgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaattcttacgtgctgttttatttttttgagacagggtcttgttttgccacccaggctggagtgcagtaatataatcttggctcaccgcagcctcaacctcctgggctcaagcaatcctcccatctcagcctccctagtggctggaactacaggtgtgtgccactatgcctgaataatttttaaaagactttttgtattgaatgaatgggtgtgtgatggaaaaaaaattttttttgcagagatgaggtctcactatgttgcctaggctggatcctgggctcaagtgatccttccaccttagcctctcaaagtactgggattataggtgtgagctaccacgcctggtgtaaagaagtgctattttaaataatctctcatgaaagtgtttgaaatgcttgttccccggtgccgtgaagaaatagcacttgaacataaatttaatttact

SEQ ID NO: 72097 - DNA, 1004 bp, Homo sapiens
tttgagaggctaaggtggaaggatcacttgagcccaggatccagcctaggcaacatagtgagacctcatctctgcaaaaaaaattttttttccatcacacacccattcattcaatacaaaaagtcttttaaaaattattcaggcatagtggcacacacctgtagttccagccactagggaggctgagatgggaggattgcttgagcccaggaggttgaggctgcggtgagccaagattatattactgcactccagcctgggtggcaaaacaagaccctgtctcaaaaaaataaaacagcacgtaagaattcaaggaacccacattttaatacaaattgttaatgaaaataagctttattacatcaagtaataaatacatacaaagatgcaaacagttttagtcattttcttccagatgtttttatcaacttacaataaacgcagaactgagatctacttacagtcttagtatgaaagtgttcgggggtccttgttaggtttggtgggttgctctttcttctgtatttataacttgtgcatttttaaaaattgactttgaagcactaatagtcatgcaaatgcttaagcaaaaaagaagttacattaagcagaacctacattgtatggcaaatgggaaccggctactaagtaaagcgtgctgtcaatatgcgttcaaaacaaaatccctacagtggtattagcttatgaaaaggaacaaagaacaccatgggtaacaaatgtatacaaaagagaagattaaagggagacaatggtgtcttggaggcaaactacagtttgctgtaagataactttccgtgcatcttttaaatcaatgcttaaaaaacaaaaaaaacctgggcagttcctaactacttaaaatgcaaatcctaattaactgcaaaatcttttctcaatctttgagactgtaggttcagagccaagtgaaccatgggaggaaaaacgaaactgtaaccattttgaaaacaagggtttcatctgaacag

SEQ ID NO: 72098 - DNA, 4005 bp, Homo sapiens
agtggcacggtgctctgcccagttcaggatccaagtccacgtttgcagttccagcccaagctggagcataaccctgggctgcagtggcagcatccagggctggcctgagactcaggagacagctcggaacggtccccgttctcggagagaggggcaggtgccggggtagctggctccctgctttggtctcctctatgctgtgtgccctggggccaccccttcaggtccatttctctaaatcgaggggcctggagccagggttctccagtgctcctcccggctcccccagcttgaggccctgaacttccttcctcctctgcccctcccctcacccacaccaagcgagcagctggtgggtttggccagcctggcaccagctgtctgtccccgaggccaagtctgcggcgcccactgtgtgtgtgagagagagaccgtgtggctctgggggcggcaggcgggcagctgccgaggaggactaggtaaattctccatggttaccgctgtttgtcattctgcaggatatcctttacccgctaatggccactgggacgccattgcggggccgcgtgctcctagccacggactcccctgccagatccaggaggctgcgttctgggctgggccctgcttggtcactgactgcagctctggacaggccccaatgttgcatcccatatgtggggcctcaaccctcctgtcttgggatacagagcccttggggcatagactgctaagagtctggtcccctctttggggagggggagacaggcacagaggggttgaggggctttatctggggcacacagaggccatggtgttctctagatttctgatttgatgtccagcgtgcctgtctccagccagggttgggtctcaaatactccaaggccttcctgtcttccctgtcattgagcacagcagagatttgagcgcatagaagcaaaaaggcttggaagctcagcctggtttcgaccagcctatgtggcgctgtggtgtgatgtggcctctaggttctcagcctctggggaccaggacacagggagaggggatgggcagagttcaggccaggagtggcaataattttatctttgggagcagccctgctgcttggaaggttctggttggatgggatggagctctgtgaggaccagcggctgctgcagagctggggatggtcaggtgccttgtagctacatttcattatccatcttatatgctggtcaaaccggaggtggagagcagggttctccatcctgctacagttggtggtgtgggtcctgggcaagggctgttgcaggacccggagtccttgccttggtacaactggctgagctgactcctggcctctctctccccaccccacagctgggagtgtccactcgccttccaccagcatggcaacgtcttcacagtaccgccagctgctcagtgactacgggccaccgtccctaggctacacccaggtatgtcaatgggggtgatggcatggtgggagggccagggggagacatgcttcccaccatcagaggagagaagttggtggaagagacgaaggagcagaaaggatgggacggagctttctcagcccaaggccctggctgcgctcctgctcagaacacatcagagtggagggcactggggactgtgcttcgcggggacgtgtgaggtggaggggacaggagagcaccaggaaggggcagcagcccaagctgtgctgaggctcccaccccacgcgttcctccagtgggcctcctcactcctctttcttgggcaagtgaggcctgaccttgatgctggctctccaagctgggacagaagatagggtcagttcccacttgctctccacgggcgcgggcccagcagagaggaggtggccctgtcttgagagcccagctgccttttgtcgagggccagtatttgagagtgtggcctgggcgaggccgctccctggttccaccactttccagactgtgaccccccacttggtaactgcccaagacccgggctcctcatcagcccaagggtgatcctagtacccccagcccaggctggcgaacagcaggaatggggccgccaccatctcagctgcaccctacatctccaagggatgagccgccccggggaaggtcccagcgggaagatgctctccctggctgggccccagcaccagtgttctgaggtcgctatggagcctgttcctcgccaagtgggcggctccccggccatgccccaccaggctgccctgccccaggaggagaagcaggtgtgggcctgtgagcgggaccggctgaagaagcggtggctgtgggaggccaggcagaggggcagccgggagttggcagtgccacgttctggccatgcgacggcggcgccaggacaggcgggaggcccgtgaggcctggaggcagtgccgtggggaggcagagcagccggagcaggacgaggacaggacagagcgcgaggccaggggacagaggcggtggtggaggaggggggaggcaaggacctcgcccagggagctggcgtgtctatgggaggaggtggccaaggggaggtagcctgggcttgtgggcttgcgggcttgtgggcttgccggaagcccagcctcgctgatccgggtgcttgctgtggggctcccagtggtggtgggaggaaaggttttctgggggttgggccctgttggtgggaggatgagagaagggaatgcattccaggctctggctgggccatggcggatcgctgtggtcctggtggcccaggtgtggcctcttgtctccccactggcttggaggcttggcacctgggatgtgccctcccatccatctgcatcctgggaaatgctgtttggactcttttgtgccaaaatgagctgtttcccctgttttgttcattggagataataaagttgcttcctggagacgactgggtggcctccctgagtgtgtgaggataggagggtgaggaccatctccctaacttgtagttgtcccctagaatgggacgtgccttggcccagctgaggtggctgccccagaagtctgaggctgggctgcgttccctatcctgaccggcccggggccctctccacccacctgcctgtggccttggggtcaggctgctgaacccttttttttttttttcccccgagatggagtctcgctctgttgcccaggctggagtgcagtggagtgatcttggctcactgcaacttccacctcctgggtccaagcagttctcctgcctcagcctcctgagtaactgggactacaggcacgcaccaccacgcccggctgattttgctgaacccatttctttctgattctagggaactgggaacagccaggtgccccaaagcaaatacgcggagctgctggccatcattgaagagctggggaaggagatcagacccacgtacgcagggagcaagagtgccatggagaggctgaagcgcggtaagcccggccccgctgccctgtcggtgaccacagtgctagacctttaactctggaaagacttttggggaaaatgtgggaaggtgggctagggatgaggctcactcatgggagctcctgtcttgttacagagttgccgtctgtggtggaggcctcaggcaggcgatgggtctggtagcgaggggcctggggggctggatgtcttcagaggggtcttctgggaagggcagcccaggcagggagcccttcttaccctgtgtgctgccagggggtctgctggctttcaagggtgtgttcgaagtgccccctgcccccgaccctgcctggtctgctcctgtgggccgacactggtcctagggaagccaagctcagggttcatcggtgcctgcactgccctctgctgtcacctctttggagggagacccaaggaagtgtgtgggtctgtgctagggtctggggagggaggctgagagcactttgttctttaatggttggagagggagggcaggcaggagatgacagagcacaagggactcgtgttaaggtgtgactg

SEQ ID NO: 72099 - DNA, 1004 bp, Homo sapiens
atcgcgccactgcactccagcctggaggacagccagactccatctcaaaaaaaaaaaaaaaaaaagaatggctgcttgtagtggctcatgcctgtaatcccaacactttgggaggccaaggcgggtggatcacttgaggccaggagtttgagaccagcctggccaacatggcaaaaccctgcttctacaaaaataaaattagctgggcatggtgccacgtgcctgtagtcccagctacttgggaggctgaggggcaggaggattgcctgagctggggaggtggaggctgcagtgagccatgattgctccactgcactccaatctgggtgacagagtaagacccagtcttagagggtaaaagatgaaagcaaactttggatcgtgcctccgccagcccccttgtgtttttctgttagaattccaggctgctttgaccttccttcccttggggttttgctctccctcagtcttgtttttgcttcaccttgggttggcctgggccctgttgacatttgagccaagtcattctttgcagtggaggtatcctgggcactgtcggatgttgaacagcatcactggcctccacccacagatgccaggagcacacatcatccccacatttttaacaacccaaaatctctccagacgttggcaaatgtctcctggggggcaaaatcaatcctggttgagaatcactgctctaggcaaattagtcatagaggagaaagctggttgtgtgtgtgtgtgtatacatgtgcatgtgtgctttttacatatgaacaaagggcaccacccccgagatacagaagatacaaatgttaactggctgggcgtttggagtatgtacaatacaatttccataagtatgaatatttatcagctagtcatttgagagcatgatgtaaagaagccatctgtggaggcctttatgagagagaagaggctaaaagaaatgtgccgaatgcttatttttagagtccgattctcagtaagttggctccatc

SEQ ID NO: 72100 - DNA, 2426 bp, Homo sapiens
acctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcctgtagtcccagctactcaggaggctgaggcaggagaatggcatgaacctgggaggcagagcttgcagtgagcccagatcgcgccactgcactccagcctgggcaacagaccgagactccgtctcgaaaaaaaaaaaagagagagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtcacgggttgtgctttctttgcgcgctgtcttcgcagatctcatgaacatcttcatagtgtctttataaaatgtaagtgctgtcaccgtgcctttgcagatggcacaggcactgagtcagggagccagccagggtggggcggtgcccagcccaggtgcagtgtgtgggcccggagtgggctgctgtcttggactgctgcggaaggcggtgggagggagaaagggctgggatgcgagtgggaatctgagcagcgtttagtgcatggcttgtctgggagtttctctgtgattatttcaaatacttgggagaaggatgttcaaattttagcttgaaatgcgtaagggtattcgatca

SEQ ID NO: 72101 - DNA, 5272 bp, Homo sapiens
atatatatgcatgcaatttatctggaacattgagccttcaatcctacatgcaggacttaaagttcccttaaccagcacccagagagtatcctttccagtttgctagtatctgctcttctaagttaacctgtttcggttagcatttgaatttgcaacttctgttctgtagtcttttggtgcattaaaagataatacatagaataatagatattcttaacctcctgttaaaaagagaataatagatattcttgacttcctattcctccaacaagatagcattacactaaacacatgcatatgcttgggtatttgtgggaaatgctgtggaagaatcagactacatctcaatggccatttcatttattaggtagtcgtttaatttttgtgtgaacttcttgtccattacgcttaatattatgcctcatttggaatctgctgtgaagctgtacagtgtggtttcttctggacacaacttgataaattcttgttactaattacaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagctgcaagatgccaaaatcttgtagatgtcaaataaaaagttattatactaacaagaagtggactcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaaaaaatgtctcattgaatgccagttgtctgatacaaatgcagtgtcttttaagtgacagaaacacacctaaatacctgcaactcaagctcgctagcattttttttttgagtacttgagataaaatccaaaacccaccctctaattttgtgctgtatttatatatatgtacataaatgtatatatagagaaatgttgagttcttctggattctgaatgtaaataattcttgtaaattgggactctgcccacctgtttctcccttttccctcttcccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacct

SEQ ID NO: 72102 - DNA, 1066 bp, Homo sapiens
tcccggccctttgggaagccaagggtggatcacctgaggtcaggagtttaagaccagcctgcccaacatggcaaaacaccgtctctactaaaaatacaaaacaacaacaacaacaaaaaaaagtcccagttactcgggaggctgaggcaggagaatcacttgaccctgggaggcagaggttgcaatgagccgagatcgcaccactgcgctccagtctgggcaacaagagcaaaactccatctcaacaaaaaaaaaagaaaagaaaagaaatttgagttgaccttgtaaatcttttagaaacgtgtctgtgtgcatatatagacactcatatgtatttctttcccatttttcttaggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtgagtctaatttttgttttggtttgagttgcaggaaaaaatcggatccgacttttttctcattgctaatatcttagctttattccacatgcatctaacatctcttccagtagtgggtatgggacccgttttatatttcttacaaggttgaacagaagttaagccttcaaacagacattgttggttctggttgaagttatgatgtggtcatctctttgatgctgctctcagctgctcttgctctccttctctactcttggtggctgtgcaggctccctggtgtgtagacagttcagcctcttgcccaggagttctccattgagctaacttaagactctggaattcaaaagccactgtgcacagagaatggcttggtgtcctgcagggagcaagggtagactaggccagctattctcaccgtgtgctcaactacaggtgtccaggaagcagggcagcaactggactctgtttgcttatcttggtttcgcttacagcagccttcctctaccacggattg

SEQ ID NO: 72103 - DNA, 1015 bp, Homo sapiens
tttgaaacagcttatctcttcagtaaaggaagcttccagtgctaatcacaaaagttagaatgtttaaagcccttctcactacctcttagttttattgtgaggatgcctctatgtttatattttgcaatgatttatagaaaatgttaagcgaccacttttcctaacatttactattaggttttattttattaatattaccttatattattatttgtagccattctgatttgaaaacaattatagttaagtagttatttgaaaaatgtattacataagaggaaccagcatgacagagcttttcaaatggcgttcagattcagttaatagcaagggttaggctttttgtgtagagattattttaaattggctacctctagaattacagaccagactaggtaaccagtttatttaaagcaatactgttttcaatgaaattcttctcatttttacaggtcgtctcagatgatgccctgatgcactggttagatcagtataattcatctgcagatacttgtactcatgcttattggttagtattttcgtgtttcctaccaaattttccaaaatttaattgagatttaaatacaccttcactctttatcagtatgtcctcatgaattaactaacagattaagtattgtcaggcgtggtgtgttccatcaggaatatttactggacagttgtagactagaaactgtttagtttatgtacctccttactcttcactgatgctttcttatttccagccaactgttgtctggcagcatgaccttaacagttatccttcatattagaacttgctttttcacggctgggtgtggtggctcacgcctgtaatcccagcactttgggaggctgaggtgggcggatcacctgaggtcaggagttcaagaccatcctggccaacatggtgaaaccccatctctactaaaaatacaaaacaattagccggtgtgatggcaggcacctgtaatcccagctacttgggaggctgaggcaggagaatcgcttgaac

SEQ ID NO: 72104 - DNA, 1225 bp, Homo sapiens
ctgcagtggtgctaattgctagagagagaaatgggcagattacagccttgttgtgaggacagtgtaagagttaagaaggaagacttttagaagagaaagtgggacttgaactaagcctagatgaataaaaaatttttaattatcatttgcatgaaaacgtttatcttttgtcattacagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttaggtaagtagggaaaatttcccccccacaatgtccccagggaaaatgtggagtggagaaattctttaaacgtgtgtacctgataaaaatgttctttttacatttacatgtttctttttcttgttcaagatcttggttctggagatgaaaaagtgcggaaaagtgatgttaaaaagtttctgactccaggatattcaacctctggccacgtagaattatacacagtaagtttagaaaatgttgtgaagtatcgtcttcccatgagatgcatttacagaaatgagtttaaatttcgttgtttctcttacagattagtgtagagaggggaatgtcatgggaggaagctaccaagatttgggctgagctgacaggaccagacgatggcttttacttgtcattgcaagtacgacttttcctttaaattctattcagatatataatactttttaatggccagcattgtaattgtctcttcactttgtacctgtttcccagttgtgtttagctttgtctattttggtaatttatcattgtaattgtgtgtttgtccatttgtgttatgtttttacttaatgcattttaaaggatgttattaggtgtgggtttagaattgttacattttcttctttttttttctttctgagacagagtttcgctctttgttgcccaggctggagtgcaatggcacgatctcagctcacctcatcctctgcctcccgagtagctgagattacaagcatgtgccactaggcctggctgacatgtatttttagtagagacggggtttcttcactttggtcaggctgttctcaaactcccgacctcaggtgacctgcctgcctcggccttccaaagtgctgggattagaggcgtgagccactgtgcccagcctaattttttta

SEQ ID NO: 72105 - DNA, 1050 bp, Homo sapiens
cactttgggaggccgagccgggtggatctccggaggttaggagtttgagaccagcctggccaacatggcgaaaccccgactctactaaaaatatgaaacttagcctgtagtcccagctactcaggagactgaggcaggagaattgcttgaacccgtgaggcagaggttgcagtgagctgagatcgcgcactgcgctccagcctgggtgacagagtgagactccgtctcaaaaaaaaagaaaagaatcttaacatgtataatgaagagagttaatacagtccccttaaccctccttccattctcaccttcttaggtcacagatgacagagtgaacaagggcagttctctccacattttctccatgtttatataaatatcaaggtgtttttttaaaatggcatgatactacttacaacatacttttctcacttagtggtacattgtagacatcccttgtaatttatgagtcagaattgatcctgttcttacagatgttcgacaaggactgataggcgttggcctgataaatgtagaagatcgctcgggaattcttactctcgataaaggtactactattagctttgtgtgggcatataactgttgctatagtattaaagtccattatgatatatgcttttgagctgaaggggaagcttcatgttcttaaaacattctgggtggttttggctgctgtggggtatgtgtaaaagatccatgcatagagaagcagttttcagcactggctgctgatatgatcagctctcaagcttttaaaaattactgaagtctgctgggcacggtggctcacgcctgtaatcccagcaccttgggaggctgaggtgggtagatcacaaggtcaggagtttgcaaccagcctggccaatatgatgaaaccccatctctactaaaaatacaaaaattagccgggcctggtggcgggtgcctgtagtcccagctactcgggaggctaaggcaagagaattacttgaacccgcgaggcagaggttgcagtgagccgagattgcaccactgcactccaacttcggcgac

SEQ ID NO: 72106 - DNA, 1026 bp, Homo sapiens
tatctcgaaatctcagatcttgcatttaaggagtgttatatatatactttatagtatatgatgcattgtggattcattttttgcttgtttacaagttgtaaaaaatatatatgtggtgggaatttgtggggttccaagaacagggttcctcaaggagtgtccttataaaacttaaggatgtattaggtccatatcagagaagctgctacttctatatgtgtttccaacctcagtagcttcaccaaaggcccatagctcctccctccatcttcatgttcttgtgaccaatgatttgaaaaacaattttgggaaaatccagagtaattgtgcatcagtaacatgtggttaagcaaaattggggtagcaatgctaatacttctgtcattgagcagttttatgtgtgttatggtaattttacattatctgtaatttttattgtttagtggtttcccaataccagtttagtgttaaatgctaggaatacatctcagaatattctctgtccagcgaacacaatcaatgatctttaaaacaaaatttcgttgcaggacgtactcatagatcaaaccaagttactgctcctgagtatgtctttctgatatctgaactggcaggagaacaaagatttgcatctattgttgctaaaagacttgagagtttggtgagttttggagttgtgtggctgtgtgtaaatgatgatctattgtacctgttttctggtaaaaggttacctgtgccttgattgaaatttttgtttttaacagggggcacttacacatggtgatagaagggcaacagaatctagagatctgagcaggttcaactttgataataaggtacatttcaattttcagtatctctgaaaacttgtgatagtgtatggtgtctttcgggaacacaaaaggaaagtagttactgtctaaaacaaaactgcctctcctatgcatttgctttaaaatcatggcttcctataagacagaatttcacatgtatgttagatcgcatgttaagtatcagtacagcaat

SEQ ID NO: 72107 - DNA, 1062 bp, Homo sapiens
tctctcatggacacatttgggtaggtggagcagggcttgtatgccctcttgaagtccaggcatcttccgtgttgttcattaaattatgtgggcctccatttccaagttacctttgtattccaagatacctgttccagactcttgtcagtacctctacattttacctaacagagaggagacaaggggatgagaagggcatgtcgcctacttttaaggacatttcctgtgcatcatacattttacctacaccttgctggctggagaatgttcacacttagccgtaagggagactgggaaataaaactggaagtcttcattattgagaaagaaggagagaataggcagtctgctgaaggacttcatttaaggcactggcctgcttgttcttatgcaaaagtgactttatttttcttatatttgacacagaatattgctatcatctcagaagctgccagctcgggtatttcattacaagcagataggagagctaaaaatcaaaggcgaagagttcatatgactttagaattaccttggagcgctgatagagcaattcaacagttcggtaagttcctacaaactggatttcacttaatggatagctaggaatcattggggtaaatttgcgcataccaaaacctaggtttaggccgggcacagaggctcacgcctgtaattccaacatttcgggaggccactgtgggaggataacttgagtccgggagtttgagaccagcctggtcaacgcagtgagaccctttctccaccaaaagaaaagaaaaacagctgagagcagtggctcgtgcctgtaatcccagcactttgggaggctgaggtgggtgcatcacttgaggtaatagtttgagaccagcctggtcaacatggtgaaacccagcctctactaaaaatacaaaaattaactgggtgtgttggcacacacctgtaatcccagctacttagggtgctgagacgggagaattgcttgaacctgggaggcgcaggctgcagtgagctgagatcacgctattgcactccagcctgggcaacatagggagattccatctc

SEQ ID NO: 72108 - DNA, 1797 bp, Homo sapiens
gattgcgccattgcactccagcctgggctacaacagcgaaacattgtctcaaaaaaataaaatttcaaaggttgtttcctttgaagattctgtacttgttttaacaaatgatttgacatgtatctttccttaacactcagatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccaggtatccatacagaaacttcctttttgaaatactgttttaaacaaaaatatttaaactttgtactaacttttagcaaatgttctttatctagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgaggtaaataggcctgtatctcttggtgacatttttgccatttgaacccctgtaaaatgagttgtattttgactgtcttcacataataatctaaatttcttagatcatagaattcttgttctactttagttgccatcctacatccaatgaactgctgcctgcagtatctgagtgtctgtcccaagccactggtcctagttactgcacttatcacgcatcttttgtgatcgtggccatgtgtcaaggtttttccagggactctgttgcagtgttctgtatccttcagtgtgtggtgcagcacagcctgtgctcttatctcccaagtgtcttcaaggaaagaggcactgagtccatccaccgcagtcagataccttcattgtaatgacattgtttggcttctcagatgactggccgcaagggacgggttgtgagcaatgatgatggaagcatatcttatgagtcaagatctgaacttgatgtgcctgtggaaatactaaacatcacagaaaaacaacgatttatggatggagataaggtatgttttactgagatgcttctcagtgaaaagaacaatgcctgtatatttagattaagctttagaagagtctttttccttttaatataagtcatgtccattgagtattgtcattctgtattttttagtaattgtacatactgaatattgtacgtgtttttattattttatcattgaatatagtaagtattggctgggtgcagtggctcaggcctgtaattccagcactttgggaggccaaggtgggcagatcacttgagctctggagtttgagaccagcctgggcagcatggtgaaaccccgtctctactgaaaatacaaaaatttagctgggtgtggtagtgcatgcctgtagtcccagctgctcagaaggcagaggtgggaggatagcttaaccctgggctatgcaggttgcagtgagccgagatcgcaccactacactccagcctgtgcaacagagctattacacaaatttttttagtaattgcctttactcactgaatattttgcatgtttttattattttatcattgaatataataagtattgtgtgtaatgcatagaatcagatatggctcttgagtgctttggaggcttttgaaatatttaatcatgatataaaaatactgtgttttctccaggcgtggtggctcacgcctgtaatcccagcactttgggaggccgagatgg

SEQ ID NO: 72109 - DNA, 1084 bp, Homo sapiens
gccactgcactccagcctgggcaacagtgaggccctgtctccaaaaataaaaaggttttataaattgattttctattgattttctaagtattccatgtctataaacctgtaattattaggcctcttctcaaatctgatacacagtcaaattgtgactatgccagaggttctgcttttactctgttgtcctgaatatgttttgaaacttgtgcacttgaaggcagtcttgacttagtacttttgtatccaatttcttcttcagaataaatgtttataaccttattttttatgggagtccaaaaggttagtgctggtttgtgaattctgtttgttttttgacttaacctaaatacttttcctctgcacttttcatttgaattaattcatgaactaaatgtgatgtactggatcttaagaaacattgaatttgggctgactctcttgtttgtggcggagggtaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatggtaagttcagtatattaaatatacacgaaagcatataatatttcagtatatttgaaaatgggatatgaaaccttttcttctgtacagtacaaatgatcacacagattataatctttgcttggtggaaagctccaggcttatctaccttctggaagtttgagcctcatatatgtgagaagataacctcaattttgtgcagttatttttaacttgaaaacatggatttgtaccccatggtgtatggatgaaccaatgtaggtggtgataagttatcagttaacaatataaaaaatttcatccaggcgcggtggctcatgcctgtaatcccagcaatttgggaggctaaggtgggtggatcacctgaggctgggagttcgagatcagcctgaccaacgtggaaaaaccccatctctactaaaaataca

SEQ ID NO: 72110 - DNA, 1060 bp, Homo sapiens
ctagccaggcgtggtggcgggcacctgtaatcccagctactggagaggctgaggcaggagaattgcttgaacccaggcggcggaggttgcagtgagctgagatggcaccattgcactccagcctgggtgacagagagactcggtctcaaaaaaaaaaaaaaaaagaaaaaagcaagacatacacctgctaatctatatttttctgtacataattgcctagaactaccgtgtccagaatggcagccgcttgtcacatgtggctattgagcagttgaaatgactggtccatattgagatgttattatatgtgtactgagccaggtttcaaagactccttaagagaaaataacataaaacatatgtgttgacatggtatattgagttaaaatgtattattaaaattagttccaccagttttatttattttttacttttttaatttaagctaccagaaaatacaataattgtgtatgtggtttggcttgcattcttattatttagttggacagctttgggctagaaaattaaaatttatttgagctcgtttatcagtattttgtaaaactgaacaaagtatatttcaatatatttaataatactttacatataattattttgtcaactgaagcagtaattgtcactgtttctctcctacagaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgagcactttaaaaaagaaaaaataggccaggtgcggtggctcacacctgtaatcccagcactttgggaggctgaggtgggcagatcacgaggtcaggagatcgagaccatcctggctaacacggtgaaaccccatctctactgaaaatacaaaaaattagccgggcatcgtggtgggcacctatagtcccagctactcgggaggctgaggcaggagaatgtcgtgaacccaggaggcagagcttgcagt

SEQ ID NO: 72111 - DNA, 1029 bp, Homo sapiens
gtgatacattccttaactcattccatttagatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgagtatttatttatttaaaaatatatattgtaggttattttttcaactataatatatttcatttgtgggattttcaggtgcttctgaaccacgcaacatggcctatatgaaccgtcttggcatatggggtgagggtactccatttagagaattcagtgattttattcaagcagtagaacggaggtaatgcagtttacggtatatactcttctcagtagcaatctaagaagtgtgttattcctaaagcccattctctgtatgttaaaattctactgtattggtaattactgtatgttttaattttattcagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctggtgaggaatttttcttaattcctagtgtttatttaatgtatctgataatgtttctgttagttttggcgattgcgatgcctcctgcccatgggaatgtatttctactataaaacaacagatgaagccaggcacggtgtctcatgcctcagcactttgggaggctgaggcgagcaggtcacctgaggtcaagagttcaagaccagcctggcctacatgttgaaacctcatctctactaaaaatacgaaaaaaaattagctgggcatggtggtgtgcgcctgtagtgccagctacttggggaggctgaggcaggagaatcgcttgaacccaggaggcggaggttgctgtgagccaagatggtgccagtgcactccagcttgggtaacagagggatactcc

SEQ ID NO: 72112 - DNA, 1003 bp, Homo sapiens
ggcgggcggatcacgaggtcaggagatcgagatcatcctggctaacatggtgaaacccgtttctactaaaaatagaaaaaattagccaggcgtggtggcgggcgcctgtagtcccacctactcaggaggctgaggaaggagaatggtgtgaacccgggaggcagagattgcagtgagccaagatcgcgccactgcactccaacctgggcgacagagcgagactccgtctcaaaaaaaaatccaaaactctatgaaatttatgtaaaaataaagtcacaaaatacatatacaaaacaaaaaacataacatattcctactcctaaaacagtgtatgaaagattgatcaccaaaatatctgaaggattatattaattaccagccttttgtttttcagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtaagtgtttaaaaactggctgtgggccaggcgcagcggatcacgaggttaggagatcgagaccatcctggctaacacagtgaaactccgtctctactaaaagtacaaaaaatcagccggtcgtcatggtgggttcctgtagtcccagctactcaggaggctgaggcaggagaatggcgtgaaccctggaggcatagcttgcagtgagccgacattgttcctctgcactccagcctgggtgacagagtgcgactccgtctcaatggaaggttttgttagtaattactttagcatgtggggatgggatccgccttccccatctagacaggatctttgtcacccaggctggagtgctgtggcatattcatggctcactgcagcctctacctcaggggctcaagcagttctgcctcagcctcttgagtagctgggactacaggcatgcactaccatgcttggctaattttttgtagat

SEQ ID NO: 72113 - DNA, 1029 bp, Homo sapiens
caaaaataaataaataaaaataaattagttataggcagattgacattctttggtttttgaaatatgtaaacttctgggttttttatttttatttttttagacaaagtcttgttctgtcacccaggctgaagtgcagtggtgcaatctcggctcatttcaacctccacctcccaggttcaagcaattctctgcctcagtctcccgagtagctgggattacaggtgcccgccaccacgcccagcttgtttctgtatttttagtagagatgcggtttcacaatcttggccaggctggtcttgaactcctgaccttgtaattcacccgccttggtgtcccaaaaatgctgggattacaggtgtgagccaccgcagcagccttaaacttctggatttttaaataatgggaaaataagttcagaattttcttctaaatgtaatttgactttttcctcctcagctgatgtaagcaatggtacagtaaagaaagagtcttctaataaagaaggagctagaatgtggataaacgacatgaagatgaggagtttttccccaaccatggtgagtttcaaataactgtgtctttatttttgtgtagtatgagagtgtactcaactaaaagtgttctatatggaacaaccctcagaaagctgtttttgggttgggaagaagctatacaggcgtgggaactaatggatatgcttaaacctcgctggagtaatatagatactaaccagggtggttaaaacttgcagattgatggagtgtggcactaacatgcagtactgatatcttactgttaaaaatctcatctgagcagaaaaaaagacaatgtggggttaacgaaaagtatttgataactgtgttcattttaggaccgaacttgaatagaaagctcataatgcattgacagatcatataatgatctggttatgagtgattcttttttttttttttttttttttttgagacagagtcttactcttatcgcccaggctggagtgcagtggtgctatcttggctcactgtaacc

SEQ ID NO: 72114 - DNA, 1221 bp, Homo sapiens
aatcaaatcagaaatgaagtactaatatttaggcaaggctgggcacagtggctcacgcctgtagtcccagcactttgggaggctgaggtgggagaatggcatgagcccaggagtttgagaccaacctgagcaacatagggagactcttatctctaaaaaaaatttgccgggcatggtggtgtgcacctgtagtcccagctacttcagaggttgaggtacaagaatcacttgagcccagttgggcaaggctgcagtgagctatgatcgcacttcagcctgcatgacagaatgagactgcttcaaagaaaaaaaaaaagcaataataaaagtgcattttagatttttagttgtccttccaggtttgtggatataagcttcattagagaatgaagcatttttcagtggtgtgttttttgttttctatctagcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctagtaagtctgttttcaatagtatcaactttctctctctggtaagctatgtcagcatgtttttttaaacgatttgcttgggtttttaaagaactggccataaaagggtgttatatgcattattttgcgtacttacagtctttaacacaattcaagggaagcaaaagtttagatgccttgggtaggttgtttagctttgaaatgtgatttctaggatcatcaggtagctacgttagcaacatgaaatcttaccagttttatatattataggtagtcagttaacatttttcttaatcctttacaaatcctttacaaatagctgtttacttgtgactcatctgtggatcttgtttgaaagcagaatctgattctcagtagagcccacaattctacatttcttttttctttttttgagacggattttcagtctgtcacccagactggagtgcagtggtgcgatctctgctcactgcagcttccgtc

SEQ ID NO: 72115 - DNA, 1091 bp, Homo sapiens
aggtgatccacctggctttgcttcctggcgtgctgggattacaggcatctggcctccagccatagtttttaaagtgtgtcaaattctttcatacctctatgttttgaatgcatagtcgagaggatccttgtccacctgatgattccctgatgctctgctgcattgtcatctttataacatctctgcttccacaaagttcattatttccttctctgttcccgtagccttttgtagatgcatacttgtgctatgatttatgtacttctctatcctttctattttagagtgagcttgggatccaagactatttctcttttatcctctttgtctgagacatggcaggttcttcattaatactgaatgaatgggtctaatagagattgttggattgtttatatttagaggggagttaatatttgtcactttttgttttttatgttaatatttaatatttccctttaaagatggtggagccagggcaagatttactgcttgctgctttgagtgagagtggaattagtccgaatgacctctttgatattgatggtggagatgcagggcttgcaactccaatgcctaccccgtcagttcagcaggtaagagttttccaaagcctctctttcttagtgatttccgcttacagtatttttttttaagatagtctcactctgtggcccaggctggggtgcagtggtgcagtcatggcttactgaagcctcaacctcccaggctcaaaccatccttctgcctcagccccccaagtagctgggactataggcacgtgccaccacatcccgctaattttttgtcttttttgtagagacagggtttgccatgttgcccaggctggtcttgaactcctgagctcaagcgattgccaacctcggcctcccagagtgttgggattacaggtgcgagccaagcttggcccaattttaaatatacatgtgaagccttaattttaaatacatgtgttaatttttttttttttctgagacggagtcttgctctgtcacccaggctggagtgcagtggcgcaatctcagctcactgcaacctctgcctcctgggttcacaattctcttgcctca

SEQ ID NO: 72116 - DNA, 1019 bp, Homo sapiens
tatttttattattttttattttattgttaagaaacagggtctcagctgggcatggtggcttatgcctgcaatcccagcactttgggaggcccaggcgggcggatcacgaggtcagtagatcgagaccatcctggccaacatgatgaaaccctgtctctactaaaaatacaaaaattagctgggtgtggtggcacgggcctgtagtttcagccacctgggaggctgaggcaggagaattgcttgaacttgggaggtggagggtgcagtgagctgagatcgcgccactgcactccagcctgggcgacagagcaagactctgcctcaaaaaaaaagaaaaagaaacagggtctccctttgttgcccaggctggtttcaaacttctggactgaagtgatcctccttccttagcctcccaaaatgctgggattataggtgtgagtcaccgcacccagctttcaaatgtatttatgataaaaattgaactcttttttttgtccattgtttgagagagagaccttccgtggttagtaacttgggtttgtcagactgctccatggtaaatgtcatctgaggtctatgaattcctttgtagacacactaacacagttctcttgtacctaacagtatttagcatttatatggtgctttgtgacttaaaagtgaaaatgtttttcctcctatgaacaggtcttatttgtaaaatgaggaggagattggctaatacaagtttttaagggctctctcagtttgagcaccaaaattctgtgagtctataatagtttctgaatagaaatataattacatactaagggttttgcctaatggagttagagaatgggatagatgttctctctctgtcccctttccctccttcaccctgcaaaaaaagaacaaatagagaatttgtgcccgtttggctgagaaatgatccctagtattccatttatgtataagatatatattaggattaaaatctctttcattagtagcttgtaaaagacagtgtcttttacagacgt

SEQ ID NO: 72117 - DNA, 1038 bp, Homo sapiens
gcttactttgagagcgtttggcataacgagcatccagagttccccaaagcagtggataccggtggtttcccagaagtggtttggggtcggtttaaccgctgaggagatttggatgttcctaaacccttctgattgtttctttcctgaccctggcatccagctcctccccttcccacccctgctttgtgcttctgtttggttaatgtttgcggaccactaacttgatcctcgcacagagaagctctttttatgtgcgtgctcggtttactgtgggaggcttttgttttggggagtcgctggttgagaaacgtgggaaaagaacgggccagaaaatgagagacaaataaagcaacgtttttatccattgaattgcgcagccaattgtaagtgcacccggaagtttgtactgaacacgtgttgagggaaggttataaactggtcccctttgacctttgaaagttggctattatcattttatgttgagttaaatgtttcatatattctagacagccagaattagggatggaatatggtttctaaagagtcatccagaagggtgcagagaactgtcatccggagtgccctagcaggaattgacttaacactttcagataattctgcgagctgacagtacagagggattctattttccaccatattttctagcaatcagaattgattttcataagcgtagggaaagctatcatcgttgcacagaagatagcagaatttcctactggtgacttgagtgggacattaattttgcaagcaagggaacattttctctcatcttttaaagaagttgtttccaaaatttttccgatgggagacgactttactttttttctctggcttctgctttttatcttccattccaacttattccatataattgcgtttggaatatttatgctatttttaaatttttgagacagggtcccactctgttgctcaagctgaagtgcagtgacgtggtcatagctcactgcagcttgaactcctgggctcaagcgatcgtcccacttcagcctccggagt

SEQ ID NO: 72118 - DNA, 1048 bp, Homo sapiens
ccctcagcaccaagtggttaatcaggttccccggggcgtgtttctgtgctgagtccctgcggctcctgccagggcagtgaactcctaaagatagcctagctcttcacatgcccaggtccttttgacctccctgttgcgggtaggctgtcttcttcctatatagaccttgggttgcagccgactctcctgctggccagctgtccccttagtgatttagagaccagcgcgtttaggaaacgtttcactggacctgggattctaaacctgccagtgctctcctgagacaatgggggctggcatcccctggtagcccagtttttgaaaaacggtgttgtctgattttcatcttttgtattcctcctcctcgtgaatgctctaggatcttcttcttcaagcctctttcagaatatgcttttgtctttttaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaaggtaagcttttgaaatggcctcgttctgatcccagctggtcgggttgcagaagcctctgtcctctgcaagaatgcacatatgtatttatccaaccttttcagtctcagattcgagaggtttgagccatgttctgtcttgctgctgaaagaatggcttgtcccagggtgtgtgccctgttggtttgacaggttttccctgctttcacaagagttagcatatccttcaagcttgattgtcttgcttagttgcaaaaataacatacctgacccacaattagagaggctcacaagtgctgaaagtgcagaagtcatgaattcaggttgtacagaccaggcaattgcagacctaactaatgtgttcatgtagggaactgacttccttcccttttatgagctggccttgaccccatttctttttctttttttgagacggatttccgctctcgtccctcaggctgaagtgcaa

SEQ ID NO: 72119 - DNA, 1044 bp, Homo sapiens
tttgtcaccttactcctgtcccctaatgctgtcccagccttcaggaatggagcttttgatctgagtctgcaacctgattcctgaaagctattgatcaagcaccctgccagcgtctccgtctctggtgcctctccctcacaggctctctatctcccacgtcaagatgcaaaagcctaaaacctctgcccagtgtcttggtcaaaaaatcgagctggagctaggcactccccctgtcatagcccatagcggacacggggcttaacaggccaagggcactcctgcctgacaaacccaggatcctgtcttctcaaagcttgtcttagaatgcagctggtcgtctggaaattgagagacagtacagaataaacccgtctttcccccacctccgcctgcagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaagtaagtgccccattcagtcctcttcctaacgtggagcagtttggttcctctgatgccagggaagcctgctcaggtgcccatgggggttcagtggccacctctcagcctctctcatgtcaaagactcagatgccccgagtcatcagcagggatgccactgtttgtcagtttctggatctggcatgggtccagagttcaagagcctctccttcctcccctccttacccaccccagcataagcagcctttgttttttaaatttattttttttgtttgtcttttttggtgattggtgttttgtgtttttttttttttttttttgagacagagtctcttgttgcccaggctggagtgcaatagtgcgatctcggctcactgcaaacaccacctcctgggttcaagcgattcccctgcctcagcctcctgagtaa

SEQ ID NO: 72120 - DNA, 1071 bp, Homo sapiens
ctagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgctttttttt

SEQ ID NO: 72121 - DNA, 1075 bp, Homo sapiens
gtgtgaacccgggaggaggagcctgcagtgagccgagatcgcgccactgcactccagcctgggcgacagagcgagactccgtctcaaaaaaaaaaaaaaagtaatacatggtgggtcagggatggagagaagcgaatgaatgaggtgtgggggaggtagaggctgtcactgagtggtcagaggaagggaggcctctgtgaagaggtgacatttgggctgaggcctgaaaaatgaagcgcgccagccacagggagatgagaaggaagggactgatgggcaaggaagaggcctcaaggtgggaatgacctcggggggaatcaaggaatagaaagcaggcaccggggagggcgaagggcgtgagtggagagtggagaggatgaggctggggaggaggccggggggccactaagacctcagtttcatcctcagcagaagtggtggatgatttcaacataggagtaaggcgggctcacctgccggtctcacttgcccacccaggcatgtcagagcgggagcgacaggtgatgaagaagctgaaggaggtggtggacaaacaacgcgacgagatccgcgccaaggacagggagctgggcctgaaaaatgaggacgttgaggctgtgagtgacacacccctgacctgcgtccaccctcccagccagtaggtgccagccagagaccagaccctccactcagcaggccccttctctccctcactctcattcttggggctccgtggggtgtggatcctgctcatggcttggcgggcccagcctggaaacttcaagtcttcactggcagagcaggaggaaacgtggcactgcccggtgagcaggctcctcccgcctcctgggaaggtcccgaggcctgggcagactttgctctgaccccaaggcctcctccagccccaccacttcatgcctctctgtgagcagacttagcagggtccagcgtgctccaggaacccatacagtgtctctgtgtaaatcagaaaaaaatgcccctttctgaaggcatgttacttccatttgttgggaaattttcataatgtattaattctagcaagacacccttccat

SEQ ID NO: 72122 - DNA, 1030 bp, Homo sapiens
ggcgcaggcggaaggggcggagcttaggcggcggtggctgagaaggcagcggggcggcggcggcggcggcggcggcggctgtggaggccgcagtccgggtcctggcttcggcctcagccccaccatggtgacgcttgctgaactgctggtgcttctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggaggtgcgggctagctgcccgcagctgaggcttggtcgcgtggccactcggggattggtggcacctgggaccggcgcggggcctgtgtggggagtgggcttggaagtcgctgtccgagtcctggagaagcccaggccgccaccccccgccccgccccggccacggcgacctcctaacggccccttttcccgcgacttgcctgggttccgggatcccttgggggctccttcggcatgcttggttgctttgggttttctccttgaacgacgggttcctgttggaacctctcgctgagctttgtgaatcaggcgccgcgtgtcagtccgggccccaaaggcgcttctcagtcacagttagctggtggcgggtctctatccagttagcacctgccttctttcgtgttacggattaatgctggaacgtggcacggaaacttttccaaaaaattgattaaaatcgattgaggattaaaaacctattgagtgctaggcatactttcgcgttgtgtttatttttcatagaagcaaccttaaggttctactctttacgcctccagctacctcgtttagtctcttctgccaaggagagatggggagttgggtcatgcgttttaggagtaagcagtgcagtgaagtatcaggagaagacaggagtttaagaaaccagcagtccctaaatctccactcatgttttgtaaaccaaaagaatgatgtgttgctagtttttatt

SEQ ID NO: 72123 - DNA, 4506 bp, Homo sapiens
acgatctcgactcactgcaacctctgcctcccgggttcaagcgattttcctgcctcagcctcctgagtagctgggaatacaggcgtgcgccaccatgcccggctaatttcgtgtttttagtagagacggagttttaccatgttggccaggctggtcttgaactcctgacctcaagtgatctgcctgccttggcctcccaaagtgctgtgattacaggcgtgagccaccatgcccagccatattcttggtgaatttcttactgccattagacattacttataaagtctatgacttaatcttttgtgacattttatgcatttctctcttgcctccagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaaggtgagatgaacattcagaagatttacatcacattccaagagctaattttagttctatacatttttacctgtctgagtggagtacttattttttttaaatttcttaaccaaaacctttttgtgaaatacgctttttattttttgcaagtctcctaattaataaaaaagtttcttgaggctagtgtttgtttttttgttgttcttttttcttttatttatttattttaagattgtgtctcgctctttcgcccaggctggagttcagtagcgtgatcttggcttactgcaatctccgcctcctgggttcaagcgattctcccaagtagcgtcaggcgtatgccaccatgcccggctaatttttgtatttttggtagagacggggtttcaccatgttggccagggtggtctcaaactcctgacttcaggtgatccacctgcctcggccttctgaagtgctgggatttttttgttctttacatttgtcccttctaacagattttcttagtcattttgtgctcttgtgagcatgtaggttccatgtgtcttcagttattttttctgtttatttgctaatcctggcatatactttatttgctcatttgtatacatgactagtttagctaaactttttgttggttctttttgtgttaagatatcttaacttttctttaggtggtggagatacctgggatggtatgtggattgctttttgacagcatcctttttgcatctttttgtttgctaatgtctaatttctgctttcttttttctaacctcagtttgttggcatgagagtgtttttttctcttaaaaaacccctacaactaattggattgatattttttttggtggttttttatttcgttgacaggaggtataggttaggttattttaaactaatagcactgaaaacacagttgacattttagtagtaacatctttgttctttaagatgaatgctaaagagtggaaattcaatgataaggggacagaagtcccaattaaacatagctcatagcaaatggtgcctttgactttgtagaaagtcattttgtagacttcttaacctgaagcttagttggatatgaaatgcagttctaggagccatatgttgatatgaagacaagagttcttttagccatatgttgcagttagagtgttcattgctcaggttaccagtaataaaccctgattggttcttggtggttctggataaattgcttaccgggagccagcacatttggtggtgtttttttttgttttttttttccccacagtgcatgccagagtttttgaagctagtcattgtttcacacatttcatagtatactattagcgtggtaacatttctcccagatattcagtatcagtagagtgttaacatcataaagaagctgagttgtttggttggattttgaaatctatagaatttagagagtcctactacttagtaattcctgcactcatttttcagggccacttatagggtaggacttgactaattttcagggagaatgaggagttctgaaaggcttttttggtttattttctggagtttgatcctacttaaatagtttgaaaatgttggttgatgaatgtgaatattgaacttcttagataattttttaacatatatccaaaattcttgcttttgcttgttaatgtcagtgaatggcagctgtcaaatcaagccttcctctaaagcagtggttctcaagtgaggatgcccaggggatatttggcaatatctggaggtattttttattcggaagactgggggtaggtgctacaggcatctaggactggaggccatggaggctgctaaataccctatagtgcatcagatagcgccccacagcatagaaaagcatttggtccaaaatggagacaatgccactgctgagaaaccctgctctatcagttccatgtggtgcatggggcttccaaagggaaatttcgagtgagggacggtttgacattccaattcaactgccttcaatggtagaggcccttggtttctcctaagaaacttggggttgtctgcgagaatctggaatcccagaagagacccagtcttgggcagggatgaagagatccccctttcccaggaaggtttcctggtgctgtttctctcctgcctgtctgttcattctcataacgtggcactacctagaagcacatgcttactcttcagaacagtgccttgtgtgtatttttggttcaagagggatgcctggttgaaaacttgtgccgctaagggcttgtctctctacttacattgcctgctgttccccactatagtgaaactattactttgtcaaagaagaatgtttgagttggtgtggattttcctaagagcgttttaatgtttttctctgctcagctttatagagattaagagtctgttttggtgctgctcctgcttcttaattaatattagagttacatgactcttagactttatttgtaggattacattttaaaaatacaggtatttattttgtgctcttagtcccctctcctcagtgttttactacttttgctgtagttaatagtcagtatagtgaacttcacataacaacattccattagaagaaatttcctggggttgttttcctttccttagtaagcattatatagtatgtttcctaccctgaaagaggtttctctactgggaagggacttttaaaaatgctttgagaattaaattgacatgattcatatcagtagtccaaattgatgtttgaaccatttcaaaagtagcttcttttgcaggccttctctgaggattttgaaaagttattttatattattttatattttatatttattttataagtgtttttcaaaaagagattgccccagcctaggcaacatagcgagaccccgtctctaaaaaataaaaataaaatggtagtcaggcatagtgacgcacccctcaggaggctgaggcaggggattgcttgagcccaggaattttaggttacagtgagctataattgcaccactgtacttgagcctgggtgatagagtgagatcctgtcttgaaaaaaaaaaaagatggctgggtgcagtggctcacgcatgtaattccagcattttgggaggctcaagcaggtggatcacctgaggtcaggagttcaagaccagcctgaccaacatggtgaaaccccgtctctactaaaaatacaaaaattagctgggtgtggcagcgtgtgcctgtaatcccagctactctggaggctgaggcaggagaatcgcttcagcctgggaggcagaggttgcagtgagctgagattgagcaccactgcactccagcctgggcaacagagcgagactctgtctcaaaaaaaaaaaaaaaaagacattgacaaatgtgttttgttttcaaatccttctatagctcaccagaacaagctagaagaaatgatcaatgagctagcagtggcgatgacagctgtaaagcacgaacaggaatacatggaagtccgggagagaatacacagagccagtaagtgaatgccgtcactttgcagcagtgtctgatggtgaaggttgttttactcaacagcttgctcgtattttcctcatttggaaactttgcaaattttatgtgaaagcattgactttaaaagtgtacctacacgagatattttttgagcatacacatgtgtggagctttgtagtttattattgggacattcattgtaaactagaaaatgctattaagatttagtacaagtttttaagagtttagttttctggccgggcatggtggctcacgcctgtaatcccagcactttgggaggctgaggcaggcggatcacctgaggttgggagttcgagaccagcctggccaacatggtgaaacctcgtctctacaaaaaataaaaaaattagctgggtgtggtggcgtgcacctatagtcccagctactcgggaggctgaggcatgagaatcacttgaaccgggaggcaga

SEQ ID NO: 72124 - DNA, 1059 bp, Homo sapiens
gatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatattatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcctgggtcttaagtgtgtaaatgtagctggacagtgttttcccctagatggcctggtcagcttgcagtattgatgcaacaccacatcagcgtctttcatagagtttatttgaaaagatgctgaatttattcccaagtataattttaaaaagctgtttaggacccaaacatatttaaacatctcttacacatacagaatttcagtttacaaatattccagaaggcattttcttaagcagtgaaccatgcag

SEQ ID NO: 72125 - DNA, 1037 bp, Homo sapiens
aatgcagtagtgtgatcataacttactgcaacctcaaattcctgggctcacgtgatactcctgcctcagcttcctgggcagctggaactacaggcaagcaccaccacgcccagctaatttttctaattttttgtagagacagggtttcactatgttgcccaggctggtcttgaactcaaggcctcaagtgatcctcccaccctggcctctcaaattgctaggattacaggtataaggcatcacacctgaccaaattacattgtcttcatttatgtagatcaatctaaaaaagatttgactgaaactggactgcccattgctatgacttacgggaaatgggcaacaactcaataccatgatgaagtcctgaagtgaagcaggattagaaggaaccataatcaacactgctgtggtgtcctaggtcagcaagacacctccaagtcttgagcagggaactggggagaactgatgctcttaccttgttaataattcctccgttttcaacaactccttcagcaccaactatgacaagatctgctttctccatgatgtagctaaggggaaaaaaagcttttcatgctttattttcttggctctaacgagtagcatcatcatctgcaaagatcaatattccatttctatcaaggtaagttcctcccataactacctgttttttttaaagcgcacttaacacgcgatagacccctggcattgttaccaggggtgttttctggtcatgaccctacaatgagacatacacttcacactgccgcccggcgcatgcacacgtacatatgtgtgtaagtgaagcaagaatgtcctgacacagcagtcttccttccaagtgtggtatcctctactttcttttctacttcagcacaaaccaaacaaaattttaaaatctgatgagatctgaagttggacaaaagtgttatgcagttttaaaaatctttctttttttttttgagaccagatctcactctgttgcccaggctagagtgcagtggcatgatctcagcccaaacctctacctctta

SEQ ID NO: 72126 - DNA, 1046 bp, Homo sapiens
aggcatgcaccaccacgcctggcaaaatttttttttttttttttgagacggagtctcgctctgtcacccgggctggagtgcagtggtgccatcttggctcactgcaggctccgcttcccaggttcatgccattctcctgcctcagcctccaggtagctgggactacaggcgcccgccaccatgcctagctaattttttgtatttttagtagagacggggtttcactttgttagccagaatggtctcgatctcctgacctcgtgatccgcccatgtcggcctcccaaagtgctgggattgcaggcgtgagccaccgggcccggccaaatttttttatttttagtagagacagggtttcaccatgttggccacagtggtcttaaactcctagcctcaggtgatccgtccgcctcgccctcccaaagtgctgagattacaggcgtgagccaccatgttcggccaggaaagtcttctaatgactcttagaaatgtagaaagtgagagatgcatgtttgcctgcataaagtagtaatacagctccaagctcagcttctgccttcatttcagacctttcaatctggagagagctcttacgttgtcatgaaaaggatccctttcataagtgaaacagactttgaatcgagagtgactatgttatattgtgttaaccatgatgcgtaaatttcagtagcagttcagctttataagtgtttattaggcctccaccttgtgccagattctgtacagatgctacagggaatattccagaataaattctggtattagtattatttattgtgatcccctaattcagcaccctaaatgtaagcatctgggtatagcatgaaatcttgtataagcaaaataataatgcagcctttaatctgaagggcttgcctagagacacatgtctttaaggcaacctccagtgtcttcccattgttcttaaaataacatccaaacaaccttagcctcacccataccaccttgcagacctcatctgccgctgctacttaatgtctttccatgcctcagcctcccaaagtg

SEQ ID NO: 72127 - DNA, 1050 bp, Homo sapiens
tgggtgtatgtccgtgtgtgtattttgtatatgtgtgtgttttgggtgtatgtgtatttggggtgtgtgtatttggggtatgggtgtattttgggtgtgtattttggagtgtgtgtatttttgggtgtgtgtgtgtattttgggggtgcatgtgtgtattttgggtgggtaggtgtgtgtattttgggggcgtgtgtgtattttgggtatatgtgcgtatgtgtttattttgtgtatgtgtgtgtttgtgttttgggtgtgcatgtatatacctgcccatgtaggtgctctccagaatgagttcatcaaaccgttacgtggagcgggatttcgggggaaatgttactgtcatctttatactttaggtatcatttaacaatgataaatgggaagacaaactggaataatgttggttgtggttcgcagtatattgtgtgacattggtgtgagaggactggcatgtgcctgggtggaattaacatgactgtgatttttaggtgattaaggctgcagaagacagtgcgttgcagtatatgaacttcatgaatgtcatctttgcagcacagaaacaggtgaactgagagcctgccgtttaaagtatttgtttcataacgaaggagtcaatttcattttttgaatgctctactctgaggtattctgactacgtaggcttatgaatgggcaaggaatccagaatctgtattatgttctagtcttttctctattttgggtcctggaccacttgagaatctgatgcattcccaaaacaatatgcactcaaccacagttttgcatagagtttcatggtattcaggtaacctttagcccatccttggaccccatgccaagaatccctggtttgacagtttgctgtataaaccttgcatcagtttctttatcttgttgctgtggcgaagctgtaaaaattcagtatttttactttgcaaagagctgaaatgttcagatgaagtataatacattttcttctttggtgtgtttatgaagaaagaaaacctccttaaaatttcagttttaatgtaaaatgctgct

SEQ ID NO: 72128 - DNA, 1082 bp, Homo sapiens
aggttggagtaagccgagattgtgccactgcactccagcctgggcgacagagcaagactctgtcaaaatataaaaataaaaataaaataataataatctgcagtgtcatatcctcctctgattttgtaggcccaaggcattgctcatgagaacctcattcctctggaaaccctaggtaagtgcgagtttggcagcaagccgcctgtgtcttgcaggcttgtgacatcacgggaggactgtacctgaaggtgcctcagatgccttctcttctgcagtatttgctggtaaggagacagcagcggcgaccctgatgcctggagggaaggatgacctctgtgtcctgggaaaggaatggaagcaagatggctggtgctagtactcaggagaagggaataaatggaggccttggagttccaaggcctagaagggtgggcttcatgttatttttttcccatgttttaaataaaagtttcttttgtttgtttgttttacagtgggtgtttcttcccgatcaagatcagagatctcagttaatcctcccacccccagttcatgttgactacagggctgcttgcttctgtcatcgaaatctcattgaaattggttatgtctgttctgtgtgtttgtcaagtaagttaatgtacctagtttttcttttttttctatgttggggggcaggaaaacagtttctcagctgtgttgtttttcagccaccctattgtttctttttttttttaatttacagtattctgcaatttcagccccatttgtactacgtgcgagtaagtatctttgagattgtgtgggtggctaatacttcacagctctagaacattaaaaaatgttttcctctctgtaatttcaggacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatcctttt

SEQ ID NO: 72129 - DNA, 1084 bp, Homo sapiens
ttgtttgtcgagtggaagctgtctccccaacaagtaataataaacatttgtttgtccatttacttgtttattgtttgtctccaccaaggactgtcaacctctgagagtaagtaccttaacgcagtccttggcagtcattggcatcgataggcatttgttgaatgaacagacaagcttttcttgactgcccgctatgttcaggcactgtttttggtgctggagactcggtggtgagcaaggcagacacagtccctgtgttcctggagcttccagtgtgggaggagacagattaaacacactctgattatgagctgtgataagtgctaagaaggcaaagaacagggtgtggaagggagaccgtgaagcaagtacttactgactgaattgaaatccactcaggcgaacattttatttcctggccaccactttcatctcctgactgtttcccttaatcttcctaaggtgtccttaatttcaaaagggatcagccctacccgagatctgatatccattgatatcagatatctaataccagatcagccccataaggcagttgcaaagtcatggagagactcctgagtgacaggcgagggtgcaggtaagatgcagggcggttcctggttcctggagccacttctgcagttgtacccattcacctgatggatgctgcgctgagctgtgaatagcacccaaaacattcaggcaacagctgcaggtgcagcaggctcctacatttgtaacaggtagatgttttccttccggttagtactcaagccaagacacttatcacacttcagtcttacaggtttgagcaaacgtactaatcactatgaaggttccagtttcaataagcgccactacctccagtcatagagtgtacctgggatccttttcaactgaatgtcagtgaaaggagaagaaagtgctgttcatctttttccagaaggaagtaaaactaaggttgctgcgatgagctcttgtgtggtgctaggttttcagtgtgtcttcagcctgagtttcctactgactttgtggtgaccagatgggatcactgttagtaacccttgcaagggaaaggggggca

SEQ ID NO: 72130 - DNA, 1049 bp, Homo sapiens
ttaaggaaatcaatggttctcagattgaaagcatcaaaagaaaagcctgaatattgtttccttcttaaacttagagccacctttcaagttaagacaggaactttcttgagtgtcacctgttgaaggaagttaaagattctgttttgtcttgtttggtttggttttagatttggaacttggccacaaatcgcctcacttttctaaactctttcaaaatgaaaatgtccgtgattttaggaatcattcatatgacttttggagtcattctgggaatatttaaccacttgtaagtacagatttttttttaagcaatatttataaaccaaacttggcatttcttcaattttgcttcttgttggtgactgtatttattgggtaaggggcagccaatatgatgttgtatttacatgattctgttgaagttatttagattttctgtggtttcagcaattcattcagcaaatatgtatttatcgagcgcatagtagtgccaagtgctgttctaggcactaggagttcagcagtgaggagggcagaaaaaagttgttgccccagtggagcttccattcaagtgagggagacatgtgacatgtgcattcatgtcgatttccagaaggggtgcttgccatattccttttttattttacaaataaaaaatctttttgtttttactttattagagctagtatatgaagagtaagagatggtgtcatttttctctaactagacctgttcattctgatctctaaacataatttgtataatttgatgctgtagcttgaagtcactataacaggagtcttgaaaaacttgtaacaatgtaagacacagcattttggagccagattcactaatattgtgtagccttactttaaggaaggaaatgtttctgaataagggaactaaggaagaaagtttgagtgagatttgaccgcaaaaactgtagtagttttggccgacctcacgtctcttcctcgtagatgtatctggacactcagatgtatctggattcatcatatgagaaatgatgttattctgaaattcgcttt

SEQ ID NO: 72131 - DNA, 2025 bp, Homo sapiens
gtgtcagagtttctgttcacactgggaaagccagcacggggttgggggtgcggggcagtgtttagctaagtaaaaatatatgtgccaagaacatattttggaatgaagcaatttcagcacaggaatttttttttttaacttataaatgttgttttaaggaatgtgatttcataatcttccattaatacatggctttttttttttttagggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgccaaacgttatgttaaagttattttttcaaatacaggatttggggagagaagccaattttgcatggctagttgaaaatggtattagatacttatttcctttaaactttatttaaaacaaacaacagagttaatctgtcacctgaagttgccagataatattttccaacagctgaagtagggatagttttttaaaaaatttaatgatgggtaatcaaaacattcacatttattctgctggatttaaaaatatgtactttttttttttttttgagatgaagtcttgctgtgtcacgtaggctggagtgcaatggcacgatcgtgtctcattgcaacttccgcctcctggattcaggtgattctcctgtctcagcctcccgagtaactgggattacaggcatgcgccaccgtgaccagctaatttttttgtatttttgtagagatggggtttcaccatgttggccaggctggtctcgaacttctgacctcaagtgatccacctgcctcggcctccctaagtgctgggattacaggcgtgagccaccatgcctggccaaaatatgcaaatattttttatcctgtgctacctagaattacaagtagaggattgtttttacaattttgtcttgttttagtaattggggacaatgggataaaatgacatacaacaaatggttatcccacttgtatatttttttaaagactcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagtagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcagctgatttcaaggcatgagc

SEQ ID NO: 72132 - DNA, 1034 bp, Homo sapiens
tctaaacatcagaattttaattcaatagacatggataattctttttacatttgagtttcaaaacagtactttgaatgtagcaggcattccataaatgccatctgagcagacagagggatttgcggccagttgaatcctaagtgtttgctgaggtctgatactctgcaattgcctgttttaagttcagcatctttaaggttcagagacattcttttatgcagtaggccagagaactaagagccggaaagggcctctgagatgccccgatctccccacctcggggaggggaggggtctttccagagcccccacagccctgccttctgcatggcccccacagcctagacagggcccccaccagacaggtccgcctgccccataggcctcaccactcggcctcagtctaatgagttcttcacctgcttcctcggcttattcttgtaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgacc

SEQ ID NO: 72133 - DNA, 1086 bp, Homo sapiens
ttgatggcctaattagccatggaccattttttagcctcgtgaagtactatagatggtttcaaagggagaagcaggctttcctgtccctcagggctccttgctctgcctgcctctctagttgcctcccccagtggctcttctccagtgaaaatggaggatagaggtcccagaaaatgcttctatttgcttttatccttccctctttggaagtaattggaatttctttgctagctcatttccgtacttagataatattcaggaaatgccctagttggctaagtaaataatcttgaggtatatttatagaagtattgaccaatgtttacataaaaataatatagctaacattcattgagcactactctatgccaggcccgtcctggttgcttttagcacttaaagccaccccatgagttagacatcacaatgacttaggtgacaagatagggttcagatacagccccaagtacggtctgatatctcaagagtttgtccactccagtctcttttgtcccattgtgttaagcagatcttctttgggccttagtttcttaatcttgaaacaaaggggtgttggatgcctgatgttgaagatttcttctaccctcaatgttttctgactccatgaatctacttagaaaaccacctcactgctaggaatcattttatcctcctgttacatttaatcactgcaattgctgcctttgttctctggccagccttcattttcttgatggcaacgcttaagctatagtacaccagagcggtacagaaagtgcccacagaaaagcccccagaggtccttgtgcacaaacgtggagacactgtgccctgttaagggccaggcagtgctgccaggtcagggcctttcaaaagtgcacagagagggcagcagggctcccgttgttcatggtaggagagaaccaaatgtgaatgggtcataacttattcatgactagaatctaaaagagcttgttataactcattcacagctaccacctgagtgctagtgtgctattttttttagattctaaaattattaccctgtttccacaggctttgtgttcaactaaaagataacgtttg

SEQ ID NO: 72134 - DNA, 1043 bp, Homo sapiens
ctcaaactcctggcctaaagcagtcctcccaaagtgttgggattacaggtgtgagccactgtgcccagcccctagtggttttacataccttaaaaaataaggcatataaattagttgactgtgaataaacatattagcaaactgaacactagacaatactcgcactataatatttaagcttatttccttagagttgtaagttgtacatgtatttttctgtggcagcagcagattcagattagcttttatgtccttcagggaaaagggattgttactaaatttgcaggctgcatcagagttttaatattgagatttaatattttaatcatttgaataatgattgaatgatgtgatgggtaacattttaagatgtatgagatacgattaggggctttttatgtatttttctttctttcagatatatatgagtgcctgtagtgtggccagcaaaatcaacttattttgttctcttgaagcttatgatttgtgagggggattggaatttaaacacaatcacaactacacgtatgatcacaaactggtatctgctgtgaaagttaagaagcacctgctatgagggagtataaaaaaggggagaccaaattttagagtggagagaaggggcctaggaaagacttttctgtataaataagatttaagctgagatttgaagagtgcgtaggtgttagtgtggaggaaagtgggggataattttccaggcagaggaacagcatgtgggaaggcctcaaagtggggaaaaagctttgcccattccaggaactgaaagaatgaatgtggatagactatggaggtgaaggggaagagtggctaggccaggggccagatcaagtagggtcatgtagggcaggttaaagtggttgtattttatcccgagtgaaatgggaaaccatgatatgggttgggatttacgaagaggagtgacataatcagatttgtatctttaaacagccactctagtcgttgcatgcaagatgtgggggcgtgttgggggtggagagtagaagtggggagaccaggttggc

SEQ ID NO: 72135 - DNA, 1043 bp, Homo sapiens; identical to SEQ ID NO: 72134

SEQ ID NO: 72136 - DNA, 1043 bp, Homo sapiens; identical to SEQ ID NO: 72134

SEQ ID NO: 72137 - DNA, 1187 bp, Homo sapiens
aggcatgagccaccatgtctagcctattagttttttatatagagaggtagatttgtatgtactgacatagcctgtatggatgtctagaatatactgttgagccaaaaaagcaagcttaatctcattttttgtaagatacaaaacaaaataatgaagggtgagtgtgtgtatatatatatattctgaataagaattagaaaaagactagaatacctgaaaacatttaattctgattacttcatgggaaaagcctaggggagactggtttttcatatcacatgtgtttgcattgcttcagttttttttacaatgggcatttacttttgtaaggaagatgttacaatttctcaccaatttcatgaaggtctagatttagacaaaaatatacagtgcctagtacctaaaaggatgtggtaaaaatgacacactcttatgttacattggccatatgtgtcaagagtcttaaaattatttacatttcttgatggtctaggaaccatcaaaagaatatttttaaatacagagaaaagctttctgcacaaaatatgtatattgtagaattatatttatgggcacagtttgcagaatggttatgatacatcccctatatcatatatttagtggcaaataacattgccattaaaaacgtttatgaagaaaatatattaaaatgcttatgatagtgttaagtggaaggaaatcaggatacacaattgtatacctgatatgatgaaaacgccccaaaaaaagtcccagcagccttccagtaaaacctatgaatggcaaaaatatgtagaagaaattagatggaaatcttaagaattgtggaattcggtaggatgtcgggtgatttaaataatcttttttgtatttgccaagattacatgtacctgtattacatgtatgatggaacatttgatttaacaaagtatatctgggacatgatagctacatggcaaatagacatgagcacttttttttttggttaaagccaatgaataaatttggaatttacactgaaaatgattgggacccattgaaaacttgtgagtagggtaagaacaatccattttgcattttagaaggttacattagagtagataatggattagagggaagcaagactggaggcttttgtagaattccagggaagatgatggtggcttgagttaagttgagacaatgca

SEQ ID NO: 72138 - DNA, 1187 bp, Homo sapiens; identical to SEQ ID NO: 72137

SEQ ID NO: 72139 - DNA, 1187 bp, Homo sapiens; identical to SEQ ID NO: 72137

SEQ ID NO: 72140 - DNA, 2294 bp, Homo sapiens
tacaatttaattttgaagatgtagcagaagcattcaaaatgtaattttaaaaatataattcgtattgctttttaacgctaaaacatttctacacctttattctgattctgaaatacacagtgtctcttgtgtcacttgatacattataagaaattcagtaaagctattctagaactcatttatttttcatacccctgaaagttcataaaataatcataggttatttccatatcttattttgcagtgtgttctatgatattgtgacagagcttgtgaggaagcctttatagccagagcagacccctgtcccaaagatgatgaactctgccacttaggttaacaatacaacagttcatagaaataattggaaccatttttcttctgcagagtaaatcctgtatgtccctctggctttcaaaatatcacttttggatgtgtagttcaaatatgtttaggattgagcctgatgggggtttaagaatatttcattgattcaaagtactcggtgttggctagaaaacatgtcaagtttctcagttaaccgatgttcaataaattacttttaatactataactttacattgtgataggactaggaccttgtggtaagcctccagactcacagttagaatcagagaacctgcacaaagcgggttgcatgcattttcatgatgcttggcaactagaggtagtaacccattgtgacattgatttcaagtcctaactccttagtgtgaagagccgaggtttctgagcaggtgtttgagtgccctctggaggccttgtgaacagttgaaatgtggactcctagcaaagctttctttcacagccagagttgagaaccagtgggcgagatggttgaaactggtgtggatgttaggagcagaggagaggggagatggaactcatgggaatgaactagtgtttacaagagcttgcccggccaactgataatactgggtttatgcagtgagtgtagaacacagaggccgtagggtcacagaaggagccaagggagtgtggccagtaatgtccagtgggataaagaacaaaaagtgcccttggattggccaagagaaggccgacaatgagagaggaacctcggtggtgtggtgttggattgaggcatgagtgggaagtgaagcaatagaaatctggaaaaatcagtctttaagaggtctggatggggaaatggagggtggggccagggagacagggtagctagagaaggcctgggattaaatgctgtttttccttaaggttgggggagacttctgcattgtgtttaaatgctgaagggaagaaacaagcacagaaagaaaacagttgaaaggggtgtgggggccggggaggaggagagagttggtttcaaagttctttgcctgggagatctgttgagggaagaagttgccttttatagggactttgagtttgtcaaagtagtgattttcagtttatcgtgggatgatggggaaataattctagtaggcagttggagatacaggtaagaagaaaagactgtgttaagaaactgtggcatcatcatcatggaaatggtcatcattccagccaagcaggtagttgagctaaaaaatggagacaggacatactgtatggaggactcctatatttaggcataggcatgtgagatggcagacacaatcagcaaggccagaggaaaagtgagaatgtgcagggaactgggagccgaggagaccgtagactaggattcagggtgaggcaggaggaacggccccaagatttgactctgagagcagttttgtagtgggggtgggggtacagaatggtgtgtgggaggtgcacacagaaggtattatagatgctgtggaggagctcagtagtgaaagtgagaagagtgaattggtcttagtcgggggatggctccagagaacacatgtcacttatctgtgcatatgaaattagagctgtaatcaacaatgactctagaaaggattatttttgcttttttgtttttaacaccatcatctcagaatataagatctaagtttcatgtaacttttgtgccacttcctactcttctcagattgagaatctgaccagaaggaagaaaatgtctaggtctattcatgacatttgagggagttcttgcaggagagagtaaatgtgactgatttttgatttactattctgacacacgtcaaatgttaaatcctttaaatctatgagaccatttgctatcataaatgacattttaaaaaacttcttggtaaaactaatagtatggctaatagaagttatttggcttcacttat

SEQ ID NO: 72141 - DNA, 1104 bp, Homo sapiens
ttgtttgtggcactgaggcacctcctgggaaaacttcatcttaagggggagttgaaggaagtgttttagttagggattttttgttgcaaagaacagagtttcattcagaccactttctgtacaaggggctatattggaggatgcatgtggatcagacccatgaggaactcaggctgtccagagacaagccacagtcttcccatggacagtgaggtctctcacggcatcactcatttctttgtgtctttctcctcttgctgccatctggcttgtttttccctcctctgtatgtcttttctaaccttttagctcctccttgcttatagattctacttcctcatgagtttggtttgctgtgatttgatgacctccgcagtcattttgcggatcataacctctcagcttcatctctcacagctgataacctcattctctcagtattgcttagattcctgagagagagggaatctgattttgttttgcttttattgttgttccaagccacatcatatgtcagagttaagctcttgggtcagatgtctgcacttggtctcagaagtggtcatgtggccgatggctgcctgggcctacccttaaagctgaagcagttcccattagtaggatttgtaggctagcaggcaccatgattggcatgtatagttcagtaagggaggaaaaaacctggcccaatatcaagaccacttgaaattcctccaaatgtattcctgccctttaaaatattatcctgctaacagctttcattctaagttgaacctttattcccacagagaaactaaaatagctaaatgtgttgaaagcattttcacttttccattttcttcctgttttattcagtctctgacagtgcagggccactcagcatagtctacaggactctatttctaatgttagtgatttctgctgaaaatgatatagcaacttcagatagctattagcaagatggatcattctaaccacatgcctttcacataatcctttcccccaaagctctggggagctgtagaggcatactgtaatccagcactgtccccagattgacaacagctagaaaaacatgtaaatgtcccatccacatgtagatac

SEQ ID NO: 72142 - DNA, 1124 bp, Homo sapiens
agttccttaatatatcataactcccaggggaaagtgaagttccccaaacttaaagctagatcttgagatctatacctaaacttctctgaacaattatagaatatagcagaggcggggaggtagtagatggaataaataaaataatgataatgatagctttgttgagcccttgaaatttgccaggcagtgttttaagtacttctcatggattaattgatttaatccttaaattaccttatcagatcagctgcctttattatctccattaactcattcttaacctcctaggtgaaggttacacagcaggtatgcagtagggccaggacatgaactcacccagtctgactccagtttgtgcttcttcagtaccctgagagactggaaaatccgtgaaaaaacactattgattgtttattccctggcattttagccagtctgagtcagttatcttatacctatgaaccttaaactcattttggatctggttcccatcacgaggctaattgtgataatgggatacctatatcttggagggaagttgtgcagagtgcctggattttcctttctgtggtttctcagatttgctcatcccttctttggacctccatgccttgaatcccatatatttatataaatcccagatgtaaataggtctgtcctatcttctgagctgggaccccacgtttatagtagctagttcatgaaaacattttgtgatcctaaattctctataaataaacccatttttctctttgcatttctcccatccagcaggatcctaaggcctttgtagtccttcagccactgtgggccctgcctctgcctgttcttctggaatgtcttgggggttttgatcctgtcactgtggtaagttttccccttgtttcaccatttgtcctagatggagaatcccccttgagtattttaagccaaagctgtctctagaattttttctgagcatgtgccctttgggctcagtgaggaagcagctctccgtgcacgctcttcctgacctctcgcctttatctggcattggattccccagatcttggaccaccttccttactctaaagatgtcagaaacatttttgtccaactctttttgttccctgggatcttcattt

SEQ ID NO: 72143 - DNA, 1500 bp, Homo sapiens
atgatatctacaaattctctccttcagacctgcaaatccaagagacacatctttggaagataagagagcttcttcaagaccaaaaaaggtttgtgttactgctgtcacatttatataaaattaattttggaatcaatagcagttttccagataaaagcattttcaatttatttatttatgtttctattacaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttca

SEQ ID NO: 72144 - DNA, 1039 bp, Homo sapiens
tctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccagg

SEQ ID NO: 72145 - DNA, 1027 bp, Homo sapiens
cctggatcctgcctagccttagcatggtcctggggccacgctcaaactggaagcccagcttcatgcttagggttccagcccctggggctggggtcgctgcaggacagcccagggggctattgcaaacagcagacagtttagccacctccccctgcccagcagaaactatctccaccctccaggctcatggctggccatctggtcaaccctggcttcccagctggggcgggcagcagggaggaggggttcacgttactgctctccctccctctttggagggcccatggcaggacctcaccctgcccctgtggccccaccgtagcgtcggtgctgtcttcactgcccaacgcagccccttcccatcttgtccccctgcaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggtgggcaccaggtggggacagggctgggctcgctgagcccccaacactgggctgtgaatgctgccggggcactgaatgctgagcgcctgctgcatgcagagctcagactcgggcctgttctgtggaaacgctgtccaggggcctgggcagctgagcctggctcacgaaccatcaggatgcttctgccaggggcacaggcagaggaaaagggtgtggttggggccggccagatcacatgggcctggtggaccatccaggggagcctggacttcctttgatgggtagtgaggaggcgtggagggctttcggaagggaaatgctcatctaacatagggtcagaaggcccctgggagaatagaccagagggacggtgaataggctactgctatagtccaggcaaaagacagcggcagggtgtgaacagggacggaagtagaacaggtgaagagaggcagacggttctgagacc

SEQ ID NO: 72146 - DNA, 1032 bp, Homo sapiens
ttatgatttggccacgtacaggaaaagcgtgtggggccctggtttagagtggagggagggtgcgccccctcagtagggagacctctgaccacatctggggccctttctccatccaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccaggtacttctgtgggcacatgcgctgcccccgggatgctctggtatcccttgcccatccttggccccagtccaccgtggtgccatgtggagagtgacaagggcacagggctcagctgggtgacctcaagcctgccaagcaggtttcaccaacttgggggtgtgatacatgcccaccctccctggggagacctcagtggtagctttccatgctttgggctgggatctcagctggaccaggcccccgttgacagcccctgttgaacctctaagaaataatgagctaggtgtgctgggccagaccgggggcgatgggtgaggtgggacctgagaaggaagctgggcccgctgcccctggggaagggcatgatcggaacccaatttcagtccttggggctctcttgagagggtcaggctggagcaagtggtcagaggcagcccaccacgcagccaggcgtctcccaagacacccctagccccaggacgggtgaaccgcagaggagatttcaggagccgtgatcttctaccaggcaggggatgcaggcgtgggggcgggtgaagcttgcttccaaatgtctaaggcatctcaggtggtgagttccccatcatcaaaggcatgcaagctcggcaccaagtgagctgatgtgaggtgtttgatcctcacagcaggatgggctccaagtctccaggcaacaccagccagccgccagccttcttcagcaagctgaccgagagcaactccgccatggtcaagtccaagaagcaagaga

SEQ ID NO: 72147 - DNA, 1027 bp, Homo sapiens
caggggatgtggatttatcccagggcaatggggactcatcgagggtggtggaggaagagggcagctcccatgactgcctgaccgccttctctcctcccccaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggtaagaccaccctgacagcggccaccttcatagacgcgattatcatgcgtcaaattgctcacgataaaggggcgcgagaaggaggtgcgctggccaacggctcccctcgcgatggtaagacttccggcccgcacccaccccgtctcgtggtccaaagatattttcagatctctgctttttactttggcccccgttttttttgttgttggttttggtattttgttttgaagcccatccgtcctcgccggtttgcacgcgctgacgactactccggccgcgcctgcccctctggtttgggggcgctcatcatttgcacatcattttaccatggttttttttttttggatttttgcttttttttctttaatgaatggatctgtgattctgacttcgactgcgcccccatctccctctttgcgcctgtgtccagggagcagggatggggctgcgggagggctcgggcctacgcccccacctgccggctgcctggatgctgt

SEQ ID NO: 72148 - DNA, 1067 bp, Homo sapiens
ggcctgagatgggaaccagtgagggcagctgcaggagatgccccggctcgggcttgggagcagaagaggaggtggtaccgagagaacctgagcattcagaaaagggttccatggctggtgctgggagccgaggagggagtgcctgccaccagctctgctggctccaggagtgtgtgccgtgctctccaggagggtgatctggccggtgggcagcctggcctctctcctccctgtggctacagccctggcccaacacctcccgcaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggtagcgccactgcccagtctggggtggggaccccggcatccatgggaggcggctgggggatgggcgggcagaagccctgctctctttcccaccccagaagacaaagccaggctcttcttcggccctggggctgagtctctggcctttgggtttcctaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtagggcatcagagcccccaccccccgctccgggactccttgtgggccgcaagaggcctccccctgctgatgccactgactgtcaccaggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtgggccaggttggcatgggggagggggcgggcaggtggatgggtggtcagtagga

SEQ ID NO: 72149 - DNA, 1034 bp, Homo sapiens
agatcgtgccattgcactccagcctgggcaacaagagtgaaactcttatctcaaaaaaaaaaaaaaatgaaagaaaattttcttctgagcgtgtttcactctgtaattctcatttgtttgctagtttatcacctgtctctcgcattgaatgtcagcttgtgagggctgggatttctgtttcgttcactggggtgaccccagttctcacaacaatgcttgccacgtagtagaggctgcatcaatattttttaattgattgagtgagtgaatggatgaaagaatgaattttttaaaaactataacacaaaagcaaatgagtcagtgagcaaaaagtgaactaaggcaatgaagaaatgaaggagtgaatgaagagacctggtccttgggatcccgaggtccctatcctcaaacaactccccgtaaatgccagccccagaggcccgatgcatccaccttgcccgtccacaggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcaggtgattgccctggggctcccagaaccctgcagtggtgctgaacagggccacggacctcatcagtgttcgctcagggactccttaggcatcaactgtcaggttcccctggatggcgaaactgaggcctcgggattggaagacccaacagtgtaatcatgagcttaggttggagcagaatttctcttagtagtttgcaggacatgtggggttaaacatttcagtggttttcttttccggcaggacttatcagtgcctttagcaatgcaaaggtatagaatgaggacttgagtatatgcatttttcaaatagacatgatctgaaagtcttttttaaaagttgccggg

SEQ ID NO: 72150 - DNA, 1319 bp, Homo sapiens
cttctccgccctgtgagatgggaactattgttctcccgttctgcagatgggaaaactgaggcccaagaggtaacctgagtttcccgtggcacgcagccagtgcggggcagagccggggttagagctcagatgagaacatggagacccccaggacgaaggcctttgcccacggccaccctcaggctggctccatctgtcgggggtgctgaccaccaggaggtcctggggttgggaattaaccaggttatgccagcagggtcagtctgggagaaaggcggccaggcgagggcagcagctgtgggtaggggcctggtcaggggctttgtctcaggggtggggctctaggcagcagcccaggtgtgtaggagcctcggggctgttttggcatcaggcgacagagcggcctcatccggagggtcagggccatgcatctcttctggaggccccgccagaccctgctcatcccctcttccttctcgccctgcacagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggtgagtgggcgccaggcagccctaaccttggcttttgtctgcagacactgagcagcgactacctacttagacagccgcacccagtctggctctgcctgctttgggggagcccgaggtgtggttagggaggcagacttggagtagagtccaggaatgagagatgcaggccaggaaggggcggaggtgtggccgggaggacctccccaggaggtgacatccaagctgagacccggacagagga

SEQ ID NO: 72151 - DNA, 1104 bp, Homo sapiens
gagctgggcacacagtaggtgttctgtaaaggttcagggaatgaaacgcgagcttcccaggctggcctgttcccccagggacaggtgagacttgcatagcaaggaaaagcttcctgtgttcattcactccacgtgtgccgatgaagctgacagggtgtccccaggaggcgtggtcactcgctctgactaggagactcctgggcaatgtcaggcaggttctctcgtgctcaggaaggatgtcagggtggctgaggggccagcctgtacccagagtgtatctggggctcaatggaagaataaagcccccggtaaaaataaaccctggcacgcttggctgccgaggtggggtgtgagggggacggtcaccctcattgctacatggccgggatcactgccctttgcacctgcggcgaggccccaggcatggggagtccccgagctgacagcccaggccccagtcctgatctgctgcttccctgtgccccaggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaaggtgagggctggcgcggcttggaggtggctggcagctgtgggtccgagctctgagggagggcatagcgggaactgatcccggcagcctcctctcccctgagtcatctgggtcctccttagaaggggcctcgactccctggaaggtgcgggcctgacttgccagaaactcaccagtaatgggcacaaggatgaaggccataacaatactgagaataatcagcttctctgggagccccaagcctcgctcagctcttctgatgcccatgagtccagtcttatgcttgggtgaccagacgtccaggccagccctgtgggtgcctgctgtctttcaccccatccgatgtcacagtttagaaaaaaatttactttggaaaagtttttttttgtttttttttttttcagacggagtcttgctctgtcgcccaggctggagtgcagtgacgtgatcacggcccagtgtaacctctgcc

SEQ ID NO: 72152 - DNA, 1637 bp, Homo sapiens
gctgggctccgagagggtcctcggtcagatgaggtcccggcccacctgaagcttgtgtcccactgtcgccacgtcaccaggtgacccctttcccaacagagtgcaggcagaggcagtcatggtcaaggcccttgactgcttcagtgtccccttctataaaatggggtgatcgcaggtgccccgacttcagcggcttgtgtggaggttggccccgaccaacggcacgtgggactgcccagcacagctccagcccagcataaaggctcagggagtcaggtgccacggtgggtactggctggggaggggcgtctgaaatgtggccttcccacggggttcagagccgtgcggtgacaccgtcaaggcctggtctactccctccctggctcaaaggagagaaaagggcagaaggcaaagtgcctcctctcccggctcctgccaataacctggcatcttcttttcagcctccatggagctgaatgagagttctcgctggacagaagaagaaatggaaacagccaagaaaggtgaggggtgtgtggcggctttaagccttgttggtttgcatccagggcgcctgaagctcacgtgctggggagggtgttgacacatttggccttgagccaggggctgtggtgaggcctctggtgaggttctggttctgggctgttctcaggtttgtcaccctggagcctcagttttaccttccagaaaatgggtctgtgcagctgcgctgtcaggcttgtctttgtgacttgagggcgcagctcagagagacacagcttgtgctgtgcatgtagtcagcgagtggcttctgggtgacctctgtggccagcacctctgggccttggggacagagcagtggcagcacacctgggtatctcgggacagtcagagcttgccggcggccatctcggtagagtcctggggtcagggagacctgcagggcgttcatccagcccttagagccccaaaggtcctatcctgggctcaagtgtgctggggctttggaaacctgtctcaggtttgagcaccccaatctgggtgacgggttctggagtggatggggacacccaggccgttggggacagtcgtgggagtggctcacacggcagggagccagcaggcattggtgctggcagcagaagccatcccgagcagatggccttgtgatgtgcagcaccgtgggggctggggtccagtgcctcctaagccggatcccctctcagctgtgctgtctcctggccaagatctttacttcccagcacagtgacctgcctctgggcctcggtttgcccgtctgttgagtgggagggtcgtctaggttggctgtgcggaatcagataaccctgtgtgagggcccatggtgggctgagtgggagcgaatctcctccctccctcggccgtgcctggcctggggcaggggctgtcggagctggcgcatcactggcagcactgctgaggccggggcagcacctggctcccacggcacgctcactctcggttatctaagaggtggggcctgctcctgtccccgcccatgtccctgtttgtgggcaaggagccaggaagcagaggccaaggagtgccacgggttccggagctggtgtgtggggctgggagcaggcccaggcccccac

SEQ ID NO: 72153 - DNA, 1016 bp, Homo sapiens
tgaggattctctcatttcaacctcccagccctcagctgaggcacaggcatgctgaatacccccattgtcaaggcgaaggagtcggcacagagaggttaagaccctcatccaagctcacacagccactgtgtggaaagggcaggaattgaagccagcacttctgacaccaatgcttcctgcccctcaccccgactccgcctccccaggcccctagggcggcaagaccccaggccgtgcctctccccatctcatgccagtggggcctggcttcccggttgtttatgacctcttctgggtggactccacgggttttcctcctcctcccccagctcaggctgagcccaggtgcagagattcacctgttcacggttttcttccctccccactcccctctgccctcccccggggtctgacagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaagtaaggcagcctgctgtcccctgcagggcccggccgctgacccaacccgggtggcacacggttctgggggaccctttgtagagacgggtggggtgcccaccaattgcctgtgagcaggggggagggctttctgctcgtttgcccctgacagccccccttccggaagcccacccatcgccctactcctcctccctggctcccccctctcctccgccctcgctttctttctccaaccctctggagactttagagactgatagctcatttgagctccactcctgagctaataaatccaggcaatgactttggaactctctgcctccctgcttcctcccgctctttcctcctgaggcgccaggaagggggaaagggggatcagaggccctcctggaaggactaggtgtgcaggcggctgctgtcacctttagaatcatcgatggca

SEQ ID NO: 72154 - DNA, 1032 bp, Homo sapiens
tgacacggggatgcaggcccgggcataggcttttggaatgctagcccctccacacccacccccatgagaccccacaggcctgagctttggcaagggagggccgagcccccacctcccggaacctggcccctgagatcggccgtgagcggcttttgagcctggaggctgggttgaggcccgagcatcctctcttgggctccgagccccatcaccaccaccctgaggtgaatcacggactgtggggcggtgcggggaacagctcaagcgctggcacagtggtttatagtccatgattcattgatggaagggccgcgttatcctagtgaattgcaaaaccagagcccaggaatgctggggcctgactgcagaccgttggggagcgaggatgtgaggctggctaggccaggtggcagggcccggcccctggtagccaatatggccttcccgcagcgatgggggttcatgtggccaagggggcctctctttctgcagagatgggacactgagacgggaacagcccgtcctgggctccagtcatccggcctgggtccaagaaggaagcccagggaggccgaggctccgcccccgactgctgccgtccactctccactgttccccatctctgtccctctgggtctgctctgcccaagcccctggctctgaatctcctgcatttttctaggtttctctctctctctctctctctgtgtgtgtatgcgcgcacacgggtggctacgtctgtttctcttcccatgtcttcctccctctttctatttctctgtgtctttatctctgtgtccacgtctcgtctgtttctctgcatgtgctttcccgtctctctctctttcccccatctaagtcttttaactctgtctctagctctctctctctctctccccttctctctctcccccatctctcctcttcctcctcccccgccccctcccctcctcaccctgtccctgggtctctcctctcacccttcctcctccaggtctctgctcctcccccacctttctccctttctctctc

SEQ ID NO: 72155 - DNA, 1031 bp, Homo sapiens
tgatccgccaggtaggacaggcctctcctgtggtctgtgcaggagccctgcgagggcaggcggcagaggggctcatgatgaggctccatgtcagtggggagtcggatgctggatgcggggaccccaggtgagccaggctggatctgtgctgtggagacaccctctgatatggggtgggtgggagtcctggggtggggggggctcagtaccccccgccaccacctgtgtctcttcccctgccatgtgtccctcagctcctggggacagcagctggccactgtctctttctctctcagtgcctccgccgttaccatatatgtctttggggagttgctgagggctcttcctcatctccctctctcccgccttgtctctcctccccatctctgtctcccgctctgcgtctcttgcgctctctcagcacccccactcccagtgcacagcccctctctcctgggttgctgtggaggctgctgtgggtggccgcagagaggctgtggtgcttgtggtcctggcgcggtgcccgtggctccaggccacatctctgctgaagacaggcacgagtggcctctctcatgtcaccaggacagaggccgctcgcaggggccttcctgcctcgtgtccccaagcttgctcgccccacagaccccccaggaggtgcccatcggatgcacagtatatgcatgttcatccgggggcatttattcagtgcctactgtatgccagggttgtcagactctaccttcagatgcgaatccgaccttaatccttccgaaaatagggtaaagggatcagccgcgcctggcccatctcaacaccccagactgccctgattccacgctgcagaggtggacacagggtaggacttccgaggtgtcggggagtgggcacgaccgcccctcccagggtcaacagcgcccacgtgcctcctgtgggtttcctgagttggggggtgcatggcccaggaccaaggacatgggtgcccctcctttcgccatttgtcaaggtgggattgaaatggaggctgtggt

SEQ ID NO: 72156 - DNA, 1025 bp, Homo sapiens
aaggtgagtcgctgcccgccccataccccttcggtctccacctccgtgggcaactgcgtggactcagggtggaggccctccctccttgcccacaaggccctggcctgcctggccccttgctccagctgccatgctcccctcctccctccctcccttccttccatctgggagatagatcagtgcaggccccgccctggcctcctgggcccatggaggaggagcctcaggttgctgagcacctgggaatcccgagaaccccagggagagctgcacggccaggcttcctggagccccgtgtgcccgacgggtctcctgccagctcctcaaaggccacgtggagcgtccttgcaaactgggggtggattctggaagcactacgtgcctggcatcccagtgaagttttcgtaggcaggagtggcgtgcctcaaagggactggagggaccagcttttctaggtccctctgagggtcactgactgctttctgacacctctaatgccaaaccagacgtgtggcctgcaagtccccatcttctttggacaaacctttgtgtggacctgaggcctaaagcccactttgtgtcaagcccaggcccggagcagctccaggtggccggtagacacaaagtgtccccagagaatggtaaagccgttgttttgcacccacaaggctggttggactgtgcctggagaggctgcaggtgggagaaggtggctggatgaggctgcatgttggacgtggcccctgggccttcccccagcatcttggggtcagaggagaaaggctgccgtccgtgtgtcttaagcagcattcccctgaatcacgtttctcagagatggggacctgcccaccccagcttggtggacaccctgctcgggcttcctggttgtaggagggaggccaggaggatgaggcacttattttaaaggacagctgttcccagcgcctgcccctcatgagctgataaccgtagaaggagagagaccgagcagagtggggaaaaatctctccatgcctgaaaaacca

SEQ ID NO: 72157 - DNA, 1358 bp, Homo sapiens
agtggccagccaggctctgatgtgcttctctctctccctttgcagccgctgtacaaccagccctccgacacccggcagtatcatgagaacatcaaaatgtgagtgctcgcgggcagccgtgcagacacacagaggcagggtgggcgagcaggctctcagcagcctgcatgggatgtgggacgtgggctctctgttcccatcaggggctcccggccagggccaggtgctcccggaggggacaggagacagtcctaggtggcacctggggtgggggtggggagcagagagagtgtccccctgaggttttgggagacaggctgggtttgggagggtgggcgagggagctgctggtgcacaggtgggtctggagagacggaggtcagaggtcccaggctgtacatctgcatcctgttcgagcaggagggagctgttgcgggcagaaggcagccggctcagggagatggggagtggccccagagcaggcgggggcctggtgttttgggctctggcataagcatgtttgggaatcacctggtgtctgcacagagaggtccctctggcacagcccactatggggcagatcagagcactcatccaggccctgaggctttggaggtggccaatgtgatgtattctaatgatgggggccttttcccagaccggtgctaggagggaagaaaatgtcaattaagtgccactgccattgggtgaggcggtgctggaggctggtagcattgtatcttcaagcggggtacaaggcattggaggtgtggcagctggaagggggctggctttttcttgggatgcattaacgggagcatagactgttgggccgaggagggcatgttatctcatgttagtgcccaggaacccaaaaggtaaaaggggctgcagatcttgccccttgaggaacatatggccacgtggtgggctggtaggttggaggtgagactcttcaggatcatagctgttgaatgttcaaggttcgtcatggtgagagggtacaggcgtttgagtgtggctgcaaagggaggcgtttagctgattcggtgggtagttcagcccggtccgattgttcaagcgttcctgggatggaactacagagtgtatatgcggtggtgagctccccgttcctgaaagcgtgcaaaccttccagtgttttcacacatctgctggtgctggactagtcgacggggagatcgctgctgttgtagtttccagagttgcgcgactggtccaagctcaggtgatcaacttggccacctggtcattgttgcagcagcctagaaaatctctccttgctagttgaggcccttggccttctcgggttcaggagcacctgacaaagatacttcacc

SEQ ID NO: 72158 - DNA, 1009 bp, Homo sapiens
atctcaccctccctcctcctcctcctcctccttccctcgctggctgcactagctctgaggtaattgtagacaacccaaccagcttccagggtgagggaaggcatctcagggctggcagtgtcggctgggctggtggggagcggtgcccacgtcgctgggccctgggggagcgaggcctgcgcgcctgccggggagcaggcttcagtggacccggcgcatttgctaaaatcgaaacttggctggcttgctggggccgctgtgggggtattgaggctcctctgtgtttttttccagcgtggggagggcctgcagggggccccgggcctccctcccccgtgctgaggatcagcatgctggactgggctgggcaggtgcccgctgctccgggaagcctctatttataatctgtgtttttttgttttttaaaaaaattcctcctcttcgccatcaccctgcagaagaaggctgaagctgcacatcggattctggaaggcctggggccccaggtggagctggtgagctggggtacagggtcaggggctcaggggagggcgggggtggctggagaggtgggcagggaggcgggagggtgcggcggaggaggaagtcatctattaccaagcgctgcccaggcggcgtccgcggaggaagcaggaaacccaccttcctgatgagaggacggcagatagcgggtgggcgggcctggctgggctgggtgggggtggggagtcttggcagcgagcgcctccggggccacctgcgcactcctgtgcataccgtgaagcccggccgctcgggctgtgaggagagtcacacatccgtaggccggtgcgcttgctccagctgagcgcggagagccggttctctgggtcacacaatctcggtccactcccaggtgcaccgcttcatggcggtgtgaccctgagcgggtctgttaccctccctgtgcttcagtttcctcatctgtaaaatgggaatcctaacagcacctattccactggattacagt

SEQ ID NO: 72159 - DNA, 1168 bp, Homo sapiens
ccggcatgggtggtggtctggctgcggggccaggccacctgggccagactcggccttctctcggggagagaggatacctgcgtggaacctgggatatccctggggtgggcttgggctggcaggaggtgggggtgccgtcctggggctgggatggctgggcttcccctcctgctctgagtggctgtggccccgacacctgcacacctgccagatacccacagggctgcctctggggccaggggagggaggggctggggtgtctgtgtggtcgttggctggcttggcctccctgccactggggcagtccccgcctcaccaagttgtcacaggaaagtggaggtcagttaatgaactcctagccaacagaccacatgcgcctgagagcccactcaggaacctcccccggcggatgcagctgtgttcttgttggcactcagggactccaccctggccacctccctgctctcctgcgtacttccagtccatcagcaaatcctgacacctctgccctaaaatatctcaattccagccttctgcccacacctgaggcaacccccggcctgagctcgtcattgctctccagtaactttgcagtagcctcctcctgggtctccctgctcctgcctccctctactcccttcagtttatcttccaagcagcagccagagggctcttataaaggcagacgactgcatccccctgtgtgttcccccctgtgctccaaaccatccatggctcctgtctcaagcaggaaaaagccaaaatccttgccatgggctgcaggtccggcgtgatccagccccgtcacctccctgacctcatctccctgcagcagccctctcaaccgctcacgtacagcctcccaggccaccctggagttcctcaaacacgccaggcacattcccacctggggacctttgcaccggctgtgccctccgcaggagcgccctcccccaggcacattcctctttcctcgctccttccagccctggctgccctccagggcctgcatggcaggggagacctgtggctagccctgtggggactctcgaggccactcatggctgaggctgcagccccaccacgtcctcctggggtgtgagattcagccacaggggccctgccggccttgaagggggtctctgtggcctggggcttgggccgcctg

SEQ ID NO: 72160 - DNA, 1120 bp, Homo sapiens
gagggcatgtgatcgtgggcgctcccgaggctctgccctggggctccgcggtgggctcaggcaggggagagccaggtgcaggcagcgctgcagcccggccccggcgcccggctccccaccgaggtggcgcttggctcggtgcccatgtctggtttgaaatcagcgccaccggcccaggcttgcccagggacttggcagcgaggagccgggataaacactggaaagttggaagggcttcccgagctcacaaggagcctttagttgcaaaccggggggatgagggagtgatttgtcctgaggtctgggtgcgccgcggccatagggaggtggcgggaatggctcctggggacctctgagcccaggctggggaagggagggggctgggcttccaggcaatgttgctcctttgccacagacctgggtttgagtcctggctccgtcctctctatgctgtgtgaccttgggcgtgttgcctcccctttgcagacctcagtttcctcgtctgtaaaatggggcacagtggggtctacacaagcatgggactgacgggagaaggagctgcagttttagggggaacgcggggcagactgcctgggttcctgtcctggttggacacttcctggctgtgtgaccttgggcaagtcacttactgtctctgagcctcagttttcccatctggcaaatggaagttgcatctttccccacctcataggctgtatggcttaagggagtgaatgaaacctgccttctagctcataataggctcacagttgataattcactggcactttgttttctcgatgctgacaataccggcacctggtctgagggtggggggcccctgggatttcagcatctcagggcgatggtatttatgaagttgtagtggccggactgaggttccagtcctggctcgacccctcaaggatggtgtgaccttgggcaagtcccggaatcccacagagcctcagtttccttgtcctttaccacagtggtagcactgcagcctgccggtgtgtctcgggagagcctgagagaagcctgaaggggcccgcacagtgctggcctgggtgggcctccgtaattgtaaccacaaggttggatttaagttcgagttccg

SEQ ID NO: 72161 - DNA, 1022 bp, Homo sapiens
ggggtgtttcctggggaaggctagagggccagctgttcacaggagacatctggcttccaggggcctccgcagccactatgctcatcccctcgtggccagtctgggccccctgccagtccagtggccacgggcccctgtcacaggcaaatctggtcttagtcctgaaaccctcctgtgactccttgtggctgaattaccacgtggatagcggagacaagccaggcttgcccagttcaagtcccagctcagccactagctgttgaccttgggcaagtcacctaccctctctgggccagcctcctgctctgtctgtgtgtggcggctcaggggcatacctgcctatgccgcggtggtgtgaggccagctggtgaaccaggggacccgcttagcacagtgctgggcacacagtccgagctgctgggctcggtgtgtgtggccactgttattgttattaatattattactctcaagatgctcctgagagtaaaaaggatgacaatgttattgctggagttgaaggccaggcccagagtccatctgaccacttcccctccactcctattagctccctgacctcatcgtcaaactctccccgcctcgcccctgcgccccggccacaccagccttctctctgctttgacaacacacccgcgtggtccagcctccagaccttcacatctgccatgcttctgccaggggtgccttcctcacatctgcacccccagacccttgtcatcatgtgggctgctgtccagggacacattcttaggcccaactcttggctgctaggggcagggaagtgaatctggagaccctggtggagcctcctctgcctcctgggagctccagcagcttcctctggcgcctcatctctgctttccagagcacttggagaagcagagctcagcctgccccttctacggatggaaagttgacacccagagaagctcagacttgtctctgagtcacacagctaattgcagccaaggttcagactcctggctgactaccaagccatcatt

SEQ ID NO: 72162 - DNA, 1121 bp, Homo sapiens
gcccacggccacagcagtttctcagagaacaataccatgtctccagtggggcctgacattcttggagacagtatagtctagtggttagtgtcgtagatgcgggtttcacacttgctgagttcaaaaccgacattgccacttcccagccccgtccccttgggcaagtcacttcactgctctctgcctcagtttcccagtatgtattaatggaatgggtatgacagcaccccataggattgttgtaaggcaagcttgtccaacctgcggctcaggacggttttaaatgcagcccaacacaaatttgtaaactttcttaaaacagattgtttttcggttttttgttttttttttttttagttcatcagctatggttagtgttagtgttatgtgtgatccgagacagttcttttagtgtggcccagtgaagccaaaagactggacacgccggttgtaaggcacagtggaggccgcgtgaagcccactgaccctggcacactgagagcttgggtgatgctggccggcgtgatgtgtccttcccgggttaggtccctgggatccagctggctggcgtggagcattcctgggcactcctctttcctctgccgctgcccctgccaccggggtgtgggttcccaggagccccagaacaggcagccacctgccccctgcccccagccgtccttgccagttgctgggtgcccatggtattctggcgtgccggatggtgctgcagttggaagtgagtcttgagtgagcaattaactctgccagctgccagctcacagctgctgtgggtgggggcggccccttttaaaaataaaaacaacatgcagaaaaacagccctggagtaccgttggcttcccttagccaacgtggtcagggcttcattttgatgcttttgtggagaagaatcccgggcctggatggggaaataggatgcattttggtctggggagtgtctttatttaggggcagaggtgatggcctgtgtctggcctccccatccaggaggcaggcccctttcctcaagctgcccacgagtggctggctcatggatgcctgccacagggaaggggatttgggttccttggggccagtttttagcaggctcaggccggag

SEQ ID NO: 72163 - DNA, 1281 bp, Homo sapiens
cccaaatccccaccagtcccttggcactaaatctctagcacccacctccaccccccacccccgactagaggtacccactgatctgctgttatagaagcttttaactcttctagaattttataataaaattatcattttattatatactatactttgttgtgtctggcttctttcactctgcataacccatgttgctcatgtatcaattcattctttctcatggctaagtagtatttcattctgtggatatattacagtttatccattcatcagttgatggacatcaaagtttccagtttttggctattgggaataaagctgctctgaacattcttgtgtaagtctttgtgtgaacatgttttcttttttcttatgtgaatatctaggcattgggttgctaggtcacatggtaaatgtgttattttagtttataagaaaccaccagctgttttctaaagtggctgtcccattttgcatgcccacctgcagtggatgagagttccagttgctccccatccttgtcagcacttgctactgtcaatcttttaatgttagccgttccaggagaccctaatgcacatgcgattacatttttcagcttttgctgccttttgggcaaagctgtggttctgtgttttgattttatgtgtctggccagctggtgggagtctaaaggatggtgggagataatctcgtgtctgccaacgctagctctgtgttttcctttctagtctttatgctgctgactgactgcttctcgtccggctgcagtggttgagaccacagtgcagtgccggattgcaccagttgggttgtttggggttagttagctgtgagtgttgttatttatttttttattttttattttttttgagacagagtcttgctctgtcgcccaggctggagtgccatggcatgatcttggctcactgcaacctccgcctcccgggttcaagcgattctcctgcctcaacctcccaagtagctgggattacaggcatgcgccaccacatctggctagtttttgtattttttttttttagtagagacggggttttgccatgttggccaggctgttcttgaactcctgacctcaggtcatccacttactttggcctcccaaagtgctaggattagtgagtgtttttttttttttttttttttttgagtcggagtttcgctcttatcgtgcaggctggagtgcaatggcacgatctcggctcactgcaacctccgcctcccgggttcaagcaattctcctgcctcagcctccctagaagc

SEQ ID NO: 72164 - DNA, 1036 bp, Homo sapiens
gagtttgaaaccagcctgggcaacatggtgagaccctgtctctacaaaaaaatacaaaaattagccgggcatggtggcacgtgcccatagtcccagctacttagcaggcttaggtgggaggatcgccttagggttggggctgcagggagccatgattgcaccccagcctgagtgacagagcgagactatatccaaaacaaaaacaaaaacaaaaacactccaaaataccaaacaaacaaaaataaattcttgcatgagaatagtagacacccccacccccggaccccatccttcaggtgtccgtcgacccatctccctgtttgtggggtcctctgggtagttaatggggcagtttcccagtagcctagccgtgtggcccggggcccctcggtggtcttgccagggtgtgggatgcctttaaacccacacatctgggattgaatcacagctccgtcacttcccggctctgagaacctgggcatgagatttgattgtctgagcgtcagtctccctctctgtcaaataggtagcagtacctgcctcacagggttctcatggagaaatacttggcccagtgcttacgacacatgggccctgacggcagacatggtcttttttcctgcatgtcggtgtcgtcatgccaaactgcatacatgcgatgtcaactaacaaaacccgtgttttgtccgcaggtctccctgagtctttgaggacacagcctcgctggaggcagtttctggtaggttcatgtctgtctccacttggtgtccccaggaggttcatcctgcctggactttctcacgggaagtgggtctggaattactcggagccaggttcggcctggagtgtgtggtgggggcctcggggggcgtgtggggtctggcacatcagagctgtccagggcagggagcaacttagggcagtttgcggggtcccccagtgatgggccgtttcctggctgagttggtgcagtgattttttgatgacacctgagaggtgggagggtccctgacagtgtcagtgtcaggagggtggg

SEQ ID NO: 72165 - DNA, 1333 bp, Homo sapiens
atggggcagggctcaccctgttcctttttggcctgccccggggccctggctcctgagtgggggtttgtgagagcgtagtcaccaggagctgcaggggagggtgctgaccatgccaaggacatcctgagcagctttgggtggcctctggttccccagctcccccactccccattttgagggacaccagctgcggagtgggggcgcatgcagctcgggctcttggacgtctcctcccgtgggtgccccacagcagctcagctctaccctgcaaagccttctgcaacctggcatgcagggacgtgaggaagcgtaggtttcagcagtggggggatttcttatggatcttactagagcatgggctgtacaatcgggccatttgtgactggtcagaaaaaaaacgttgctcaaaagtattgataagttctttgttgttaatctagagagggaagtctctagtgttaggccacagggctctgtctgatcacgttttcatcagatgctggactctgcactgctggggacgtgtattcacgtacaggtgctggcactggtcatgctcacccatgctgtgtagcagtggagagactgaggcacgtggaccctggggaatcgcctgttgggagttcagaatctgtggggtggggccttgggagttccctagaggcctaaagatttttgtttttgaagcctgtgttaagctgagtaatggtcccccgaacgatgtcctaattctcagaagctgtgaatatattattttatgctgcaaaggggatttaaggtggcagatggaattaaggctgctaaccagctgaccttgagatgggagattatcctagattatctgcccgggctggaggtaatcacagtggtctttataagaaggaggcaggaggtcagagagatttgaagatgctgcgttgctggctttgaggatggagaaggggccattagccaaggagtgcaggcagccgctagaagccataaagggtgatggacaggttctcccctagagtctccagactggatgcagcctaccgacaccttgaatttagctctgttagatccatttcagaccttggatctccaaaactgtaaggtaataaacttatgctggctgggcacggtggctcacgcctgtaatccccagcactttgtgaggctgaggtgggaggatcgcttgaggccaggagttcaagaccagcctggggaacacagtgggaccccctgtctctataaaaaacatagaaaactagctgggcatggtacctgtggtcccagctaatcaggggactgagatgggagggtcacttgagctctggagttggaggctgca

SEQ ID NO: 72166 - DNA, 1068 bp, Homo sapiens
aactggttttattgtgattattattatttttccctttttgcagatttggaggaaggatgtgtgagggagggaagaggggaggaggggataaggggaggaccctgtgggcggggtgggggagttctgggcgcgttgggatgtgttaccggtggccttgactttgccccttttcagccagatctgggtccttgcggcagctttgatataaggggctctccgggccagactgcgccgggagggcgacccggggcaggctgtgtacctcgtgggtggcctctttgggggtgctgaggaggggccgagaaatggcaagcagcagtgaggtgggatggcccactctgcacctcagctcctggggtttgactctgacctttgccactttcctggcagtgtgaccctggacagatgcttaacttctctgtgcctgtcaggtttcccatctgcaaaatgagggtcaaaatggtactgagttcacagagtggttgtgagagctgaccgtccggccataagaatcccttggtacttgtatgtgttactatgactactgtgtcggtattattattcctgggttctaagattgggcctttaatccaacgtggtctggaagccctgtgaaaaggggccaccttacctttggctgggggtggacagtggggggatctgggggagggagggggccttttcccactcccctctgcttgtccggagaggatggagaagggcaggtgcccccgcccattgaacagatgcaaagactgagtcaggcccagcagagcaatgaagggggggtggagccagcggtgactggcgagtcggcagcgcggctgccagggcatcccgggctctgtctggcttccctgagccgcctgccgtgtccctgcttggaaattcactgctgccaccgccagcgggtgccgggggagtctgtggtgccggtgcccagacatgggggcgggagcgcagcaggccccagccctggcctcttcccactgagctatttacgctgctggggatcaatactattgataaatccatgtaaatggtaatgtggctgtcaggccctggtga

SEQ ID NO: 72167 - DNA, 1815 bp, Homo sapiens
gagagaccgtctctaaaaaataaaaaataaatcaacacataaacatacgttctcctcctgagggacagagcttgccccggttgttccatgttgactgtgctgcacacaggccgccccccttgctctgcccctcactgtattaagtctctttgggcctcagtttctccatctctaaaggaggtcggggaggccaggcgggtgttgagtgagatgaagaggcccttggagtcattccaggagtctataggtgactccagtctcttctcacttctgacagcctggtggcgggggtggagtctctgctggggatgtgggtacagggctgtggtgggcggggatgagggtggggtttggtgacagggcgtgggtggtcacccagctttgcctttctccacagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggatgcctgcctctgtgacagccttgtttgctgaggtcgtgggggtgggggcctctgggaagttccgggctcctcttctcttggtcaatagctcctttctggtggctgccaagagcgtctctcccagggccgggctgctggcttaccttcctgttgttttcaaatttcaaccttgtgcaatgttgagtttcatagaaatactgcatgagtacgcccttgtttagaagcagcagggtctgagtcccatcccacagcccccagtgcagacgcttttgccacttttgcatggggccccctggatgtgtttctgtgcatttatctacaaatcctggtgcccataggacatgccccgtgttgttctaggcctttgctttctgctcgttacataaatggtgaagaagagaagcgggtaagagaacagattggagccatctaaaagttctcatcttaagtgtagatcat

SEQ ID NO: 72168 - DNA, 2610 bp, Homo sapiens
ggcctattctgaatccctgatgacatcagctcccaagggctctgtgctgcaggaagcaaaactgtaggtgggtaccaggtaatgccgtgcgcctccccgccccctcccatatcaagtagaatgctggcggcttaaaacatttggggtcctgctcattccttcagcctcaacttcacctggagtgtctacagactgaagatgcatatttgtgtattttgcttttggagaaactgcccttcctatgttctgagtgaatagcagtttttttgatcccagagggcaacttgtattctgtgggctggtgcctatttgcaaggtcacattagaaagacaggagcaaggcttaggcctgctgcttctggaatctcttgtgcaatagactcccctggggaagtctgctagaaatgcagatccctgggcagccttctagccttctggaataggatcatggtgggaccctggaatctgtattttaatggaccctaatgagattctgatgtagaaacatgtttgagaggcattgatctaaatctgggatgactggccaggtgcggtggctcacacctgtaatccagcactttgggaggccgaagcaggtggatcatttgaggtcaggagttcaagaccagcctggccaacatggtgaaaacctgtctctactaaaaatacaaaaaaaattagctgggtgtggtggcacacgcttgtaatcccagctactcaggaggctgaggcaggagaatcgcttgaacccgggagatggaggttgcagtgagccaagatcgtgccactgcactccagcctgggtgacagagtgagactccgtctcaaaaaaataaaactaaaataaataaataaataaatacatctgggatgactgaccaagaacaaagaatgtaggcatcaactgaacaccaactgtatacctgggactggatctgagggtaggattgccagattgagcacaaacaaacaaacgaaacacaagaaacaacagaagggtgcctgttaaatatgaatttctggtaagcaataagtaatttttattgtgttcctgtgcaatgataggacgcacgtatcctgaaaacctgtctgtagttcacctgaaattcacatttaactaggcgttctgattttatgtggccgccctatctgctgggaacataggctgatgcccctgggggttctgcgtttccttggccaggttcctgtagggctgaggtcatgggggagccgtggccagggatggtgtccttgccaggggaggtgacgggcagagctgcaggccctacaacttggggttgggcagggatgagtcgctctaccgtggtgcctctgataatagctgttattttagtttctgaaaaatgtgctgccctcaagagcttctgaggctaggcctacttgggtgaaaatagctttccagggagccacattgtggggacgtgaggcagcagccccactctttggggccacttggctgtctctaactcatctcacttgccagggctggacaaggagatgaaaaagaaaatgccaaggggtgggcaggcaggagcctgttggcgttggcaggcgctgccagccctgtgtcccagtcaagctctggggcgcccttcctgtccatctgggagtagggggtggagtctgaccatgttggggtggagtgttaatattaggagaggatcctccctgggacagggtccccaggcttgggggcaaggccttctgcctggacccccttcctttcctctctcccaggattcctccaggacaccgtagtgctgtgcacggtttggccccatcggtgtgcctgctccttccagccactgctcccttctgcagaaacttgcctgggattcccagggtgcaggggtgggggctggtcaggggctggtcagggcctggtcagtgtagagcagggagcttttcacttttagcatagatagagtggccagggccccatggctgcacctccctggacataaccaggatgtcctgtcatctgccccccaaacaaaactggggtctcccctttattttgccaacagaatccaatttttaggtgatgagacaagtgtttgacttgaaaagaccctcctgccctgcctcctggaaggtctggagcccagcccagcgccccggatcccctaggcatgtgaaacggggaatgcagtgtcctccagtggctggctgcagcttggggtgggcacctgggtggtggctggtggtccccctgcaggccactgctgccccctcttgggtcctgttctgagtctcaggcctgagtccctggggaaggccccacacctttgccctgtacctgggtatggggatggccctgaggggctgccttgcttgggagaaggggggaaaacagatatttttatataaataagaaaaagacagcccctctgggcagatgaggcctgctgtagggcagggggcttggtaaactgtgtgtccactggtctgtaacccttcagctgggtccttttgtgcagtgaacagcctggacaactgtccaggtggcccttcagggatatgttcctggacctttcttagcttctcaccgatctttcttccacgccaagtccatgttcctcagtcaaa

SEQ ID NO: 72169 - DNA, 1030 bp, Homo sapiens
gtgtgggctgcttggcttgcgcttgagactcccctccccacacccaagttcaaatctggcgttgccttttccatccgtgcctccctagcacccttgtgcaccatgcatttccccctccccacgcttgcttctgccttcccttccacctggaatgcgcttcccgggcatccttcacctggctcctgtgaagaggcctcttccttcttttggtctctcctgtcagaatcagcggctcctgcctcaccccttctctggcgcagagcttgtccctcatcacagggcctggggctttttacagaatggaggaagggatcctctctgtctggttatcttgtcatcgccacgggggtgccctgcagaccacagctctgtgcagacctccggcctggcaggacctgccaatatactgtccttgtctgatgtcccctccctgcccctcttctaggtgcccccttgtttctctcccatcctcacttcctcaacgctgacccggttctggcagaagcggtgactggcctgcaccctaaccaggaggcacactccttgttcctggacatccacccggtgagcccctgccatcctctgtggggggtgggtgattcctggttggagcacacctggctgcctcctctctccccaggcagagagctgctgtgggctggggtggtgggaagcctggcttctagaatctcgagccaccaaagttccttacttcaccccgactccatagttcaaggtagttcaagggttttatgatccctgtactggtttctataaatgggctctaagacagtaaattaattagaacttatcagctgggatgtctcctacatgtgagctggaggcagccctctggatgtgtcaagataccataaagatctttaggtaccaagaagagcctggggtattttgcagataaatcacacagggaatttgtcccgtgtgaagttctgtctacaagcagggagctggacatgtggccctcccaaggacactccttcagcttgtggcctcttctcttggcacctcc

SEQ ID NO: 72170 - DNA, 1031 bp, Homo sapiens
gtttcccaggtgggtccacctgtcttggtttggaagtcctggccaaagtacttttttttcccttttcaatttacatttctgagatctccaaaaggggctgtcttgttgagggctgagccacaggcccgcctctgggactggggctggagttcacttagcctgagtccagtggggtgcaagggggagaaggggttctcgggagcacatgtggccttggcactggaggagcagagggtggttctggtgtcccagatgccccacgtggccactccaggggcctcctgcaccccagcatttcccttcatgggctctttgctgtgaggcccagctggggccaagggaggatgggccagccacgtccagcctctgacactagtgtcccttcgccttgcagggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgaggtacgtgtggcctggtgagaagccaaagattcaggcctgtgtcctgtcttcccctcacacagcctggacactggtcaccagcttgctttgtagctggctggggatctagtggctgtgggttgtaagtgactgagaacctgactcaaaccggcttgagtgaaatggggaatgttggggctcatagaactgaaaatgctagggttggattcaggtacagcttgatccaggctcaaatgatgtgactgggccttagcttagcaaattggaggctttgctggaggaagggggcatggctgctggggagtaatatcacaagctgactcttaatcttgactcttggcaacctggtagggtcactgactgggcttcggagccaacatctcgtccatggagggtctgaccctgaccttggctccctcaccgcaggtttcac

SEQ ID NO: 72171 - DNA, 1027 bp, Homo sapiens
gttgaagaagcctgcaattcctcctggtcccttcctccacctgctttctaaaatttctggctctcattccttgcctttgagcggtgatgtgtccatccttcagcggccctcggccagcctctgcccaccccagtgccatcacatgggaagagatggcggatctgatccctgactcatcccctgggccaggaagattgtggaaaccctggggtctcagggctggtcgggtggaaacgggaggctggatggagtggcaggtgggggcttttcctgttttgcctctccctaactgggcctcccggcagccactagcccagatgcccaggcctcagagccttgtggaaattcttgtgccagatcatcttggccctgtctggcctcctggcaggcaggtggaggtcaaactggccttacttggccgagagcccattgcagccaggatcccttggcagctctgggaacagccaagtctcccctgtccttgggatttccttccactgtctgttcccaggctcctggactccacctgctgcaacccctcgctttgcactttccacccagagtcttggatttctgttttttgtgaaatttgctcactttgaggaaagtgtaagacatatgcaatcaaatatgtaactaagatgaacatgcatgcaatcaccccacgtgaagaagagggaaagctcatctgccccgaagcccctgcagaagacactgtgtttggtcccagcttgctttgctttttatagtatcactccctcatagccatccctaaacaccgggattagtttggtccggttttggacttaacttggatgcaggcatactctcagtatttttgtttggtttggtcttgctggtgttacttcatatggtatttgtgggatccacccacattgctgcgataagctgcactctattttcatggccatgtcatatcacagttcatgatgctaatcggaagaagctgagtatcacagttcatctgtctttttttttttttttttttttttttttttgagatgga

SEQ ID NO: 72172 - DNA, 1050 bp, Homo sapiens
ggtctagaaggtggtggcggggcatgtggaccgttgtaagggctctggggttcctgggtgggctggcgaagtcctactcacagtgaccaaccatgatgatggtcccgatagaggaggagagggaggaggagggaaaaggaagggtgaggggctcagaggggagagctgggaggaggggagacataggtgggggaaggggtaggagaaaggggaagggagcaagagggtgaggggcaccaggccccatagacgttttggctcagcggccacgaggcctcctcagctcccgccccaaaacggaagcgaggccgtgggggcagcggcagcatggcggggcttgtcttggcggccatggccccgccccctgcccgtccgatcagcgccccgccccgtccccgccccgaccccgccccgggcccgctcaggccccgcccctgccgccggaatcctgaagcccaaggctgcccgggggcggtccggcggcgccggcgatggggcataaaaccactggccacctgccgggctgctcctgcgtgcgctgccgtcccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaaggtgggtgagggagaccccagggggtccgcgcacggacccgggctgttgggcgctgggcgccgggaggacccgcgcgttgcggtgggtgggcgaccgcagcggaatcggcgcccgggcctggcgccgcagagcacgagggaggccaggcgcttcgggaggggctgctgcccgcctccccaccaccctcaccgccccagactgaggctaggggggaacccaggggctttgctggaggcgcaggccagggttggg

SEQ ID NO: 72173 - DNA, 1347 bp, Homo sapiens
gtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaattggtgttttttttttttttttttttaagtttattttgcattagactgggtgaagggggtcaaggttttcggtctacaaatgttcctgtggtaacggtgaaatgtcagtgaagggggtggccttaatatagtatgaactgtagaaggtgggtgcaaataaaagccagcttcaagaccagcttggccaacgtggtgaaaccctatgtctactgaaaatacaaaaaaggcaggtgtggcagtgagtgcctgtgattccagcttacttgggaggctgaggcaggagaatcccttgaacctacgaagcagaggttgcagtgatctgagatactgccactgtactccagctggggcgacagcaagactcaaaaaagaagttattgggagatggaagtattttgcatatgtagatttgcttataagttaactttaaaagtactggtttgtgggtgatgtgtaaggtaacggaatgggagaattactggaacaccaggaaaggaattttaaaaggtgggagtgatggggtaactgaaaggatgctttcagtgcataggt

SEQ ID NO: 72174 - DNA, 2655 bp, Homo sapiens
gagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctctggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaa

SEQ ID NO: 72175 - DNA, 1014 bp, Homo sapiens
cttgggccttggggaagcaccccatgcttcctagggagccggccattcggtcaagtgggtggcacgcgtgtccagagagcatgcagggcccgggtgggggactgctgtctggtgaagaagctgtgctccgtgctggctgtgacgtccccttgggcagggccaatctcccagggggatggcaaaggtgattccagccctcctggctttgaagccactgggactcctgggggtggcagtggatgcagtttgggtctgggtggcccctgtctgtgtggcacctgctgtccaactgcccacggccccaccccacatctcatgtccatttcccacctgccctcccactctgcgggcatctgagttgagcagctcacctctgatgaagagcagctgcccttcctctaacactgtctcctcaagtgggagttctgggacgtgaagcggcccttggggcttaggctggaagggtgggcctcaccccggacctccccccaggacttcctgctgctgcggtacaaggtggtgatcatcgacgaggcccacgagaggagcgtgtacacggacatcctcatcggcctcctgtcccgcattgtgactctccgggctaaggtagcgcaggaggcgggtgctggggagccccgagccctaggccccccccagctctgtcagaggcttgggcttccttcacctgttccccgttgtaccctgggctgctgccatgagcaggtaccccgagcacaaggtctccctgggcctaggtctaggcctagtgccagggctgtgaatcttggaacagcccctgtgtgatcccctccccaccgccccggtgccagcctcataaactggtgtccttctccccatccaaagcaagaggctcaggagaagtgttgatgccttgccaggcgcaatggggctggttgatgaggcctctgggcctctgggatcagcagagcaggtgggcctgcccagccaagggccaggctcccggagctctgagaggggctccccagggcctct

SEQ ID NO: 72176 - DNA, 1057 bp, Homo sapiens
ctgccgcgcgtctcattcattcattcaccgcgtttgaatggctcctactgtgagccaggcagcacactggcgctctcggtccccacgcggctgcgccctccccagctaccccgggtttgtcctagcctcgcatcccgacccacttcccctgggaccttctgccccactcctcctcctgctttgaagatacttggagttgtttttactttacaggaaaagaagggagcaatgcgatttgctcggtggctttgggaaaccgagcacctactgtgtgcggggcctttcgcgtggagccttttgtttagtttggggaggtcccggatcctgcagcctcctgggaagggtgttgagtcccaggaggatcgcagggggttttccccaattcctgctctctggagctaggtgcgataggggtgccattccgggccgaagtccgccgactagctcttgagaaggaggaagttactggggacagttgtgtgtggtattgcggttcctttgctgttccctggggaggagggggctcttgcttgccgccagccttcctggggttttggagtcagagaagtttgggttcaagttggagctctaccagttggatgactttggggaagtgacttcacttctttgagcttgtttctttatttgttaaatggggatagtaatcattccccttcattgcgaggttgtaattatgactagttggtaccttcctggcccagaatcatggctaaaaagttaaagttttctgctcattgagagggagtggggaatagaagggaatatgaaggccgaaatcagattgactgcatgttcttactggataacatgaaaggttaatttgttaggaaaacagtaagttttgacctccctctcctgtgggcaggggcacctcttgcacaggtgggtctgtgtcttcatacatgtaggggagagaacgctttgtaggtggccaaagaggggcaaggaagcagggctgaacgcctgaatgtgaaaaggttgccctggagtctggcgcgggaaaggatcaggggtgtgagtgcagggagtctcactt

SEQ ID NO: 72177 - DNA, 1063 bp, Homo sapiens
ccctagctacttgggaagctaaggcaggattgcttgagcccgggagtttgagggtgcagtgagctatcattgcaccactgcactccagcctggtcaacagtgagaccctgtctctttagagaaatcaggcagaggaaggcagagatcctgacccaagaggaagcatgaaagacagcaggagcaatggcaagcggcgtaacgcggccctgcagagagtcccagcctccataggtgccttgttcagcccttgcaaggaaggggtcgttttcaccagtttttctcagttaggctgtgatcagtacccagttcaagtcaatcccctgggccagtagtccacatgtgtggtattcatcatgggctcactatttttcccttcccaggtataaactcccaagctccccagttcactgcttgactgatggaggaaaacagtgattgggtgatgaccgttttcttgtttctgcagttcttggccaggctgactgagagatttgtgctgggagtggatatgttcgtggagacactgtggaaagtctggaccgagctcttggatgttcttggacttgacggtaggtgtaggggtggcattcacgtaaggtgtcattctattttggtggttctcatagtgtggaactggtactcacagtgagtaatacatgagaaggttgcggagggctggtcagtgaggatatgagtgaacattttttattttaatagtctcatatataggccaggcatggtggctcatgcctgtaatcccagcactttgggagaccaaggtgggagggttgcttgaacccaagaattcaagaccagcctgggcaacatggtgagatcccatctctataaaaaaaaagtacaaaaaaattgctgggtgcagtgatgtgcacctgtagtccccatccacttgggaggctgaggcaggaggattgcctgagatgaggaattcgaggctgcagtgagctatgatcatgccactgtactccagactggacgacagagcaagactcctctcaaataatcataaaaataaaaaacaaatggcccatcaaagctgagattt

SEQ ID NO: 72178 - DNA, 2466 bp, Homo sapiens
tccctggctgggcatggtggctcatgcctgtaatcccagcactttgggaggccgaggcaggtggatcacctgaggtcaggagttcgagaccagcctgattaacatggagaaaccccgtctctactaaagatacaaaattagccgggtgtggtggcgcatgcctgtaatcccagctaccccggaggctgagacaggagaattgcttgaacccaggaggcggaggttgtggtgagccgagatcacaccattgcactccagcctgggcaacagagcaagactccatctcaaaaaaaagaggcttccctgtgtgtcctcatggagcaaagtgtgactattcacagaggaacttccttgagttcctttggttgttgcaaaggccttttaagccccacaggccagctcaactatccaattctagcttgttaagaaacccctggcccctgcgtaacgagccctgttcctcttttctgtcccgcagtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaagtttattaaaactttacatggaggggaagaatatgctaatttgacatttgagaaaagtttaaatgcgagcgtttgttttcacagcttagggattggtgggtgaggtctgtgtgcgttattttcatgttcccaaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggtttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaagcccagcattt

SEQ ID NO: 72179 - DNA, 1906 bp, Homo sapiens
gaattgtatgaacctgggaggcagaggttgcagtgaactgagatcacaccactgtactccagttgaggcgacagagtgagacccagtctcaaaaaaaaaaaaaagtgtgtgtgtgtgtatatatatgtatatatatatacacacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaacagaattaaaatattgtgaaaattacagcttaataaatgtttattgtaattttgttgtatggacttttaaaatatatctcatcacttctaaccaaacatttgtggagtttccccagttttgatgtgtaaccaggattctatggttctattcctcgatctgagaagagtcataaaaccttgaatttatgtattcagttggaggtaaggttgca

SEQ ID NO: 72180 - DNA, 1197 bp, Homo sapiens
atccgtcatccatctattcatccattcatttatcctccacccatcatctacccattcatccatcttccattcatcatcctcatccaccatccatccaactatccatccaactgtctatacattcttctctctacctacccattcacccatcttccatctctccatccactcatctatccttcactcattatccattcatccatccatcttccattcatcatccctcatacatcatccatccgtctatacattcttctctctgcctacccattcacccatcatccatctctccatccatttatctatcctccatctgtcatccgtccattcattcatccatccatcctccattcatcattcctcatccatcatccatccatccatccatctgccagccggcaaatatatgaggacccttgatgtgcagggcatggtaaaaggcatttggtaaagcaaagaacaagacaggcaaagtcccagccctcatgtgagaaccagatactagacggccagttacacaggtgattattcatttgcagttatgctaagtttggtgaaggagaaatacagtgtgctttgcaggtaactagttgggggacctgagttcaccgggttgggggcaagacagccttggagaaggctgctctgaggaagtttcatttgagtgaagagctgcaggatgagcgcacactgagtggagactgctggtgtgcgtggaggagtgttcagcagatcagacagctgtgcaaaggcaggaggtgattaggacaactgaggagtcggaagaaggctgctgtgaccagatcccagggagggatggggagcagagggaggagagcccacggggtcattgtcatcagagcatggagaatggattgcagggggatggtggggagttgacaggctggcagcaggcgattcatctgggcgggggctggtggtcaggatcctcaggcagttcaaggccagcccccttcccactctgaccttggctctcagagaaaccttttggacatctgctacctcccatacaccctgaacccaaggcttcttcctatgttttctccacaggttatttacccaacagtgagcacgctgtcgaggcgatgctggctgcggcaagcattggtgccatctggagctccacgtccccggacttcggtgtgaatgtgagtcagggtctgtgacagagggggc

SEQ ID NO: 72181 - DNA, 1231 bp, Homo sapiens
ttcacacgcctgtccactgagagctcctcggctggctgtgctgggtgctgaagggaccctctctgctgcagagccacagaccgcagtgggctgtccagggagtgctggggcatccgtctttactcgatgacactgggggaacgcgtttctggcctccgtcactcccctgtgctttacttctacccattccatgctctctcccaccactgcccacctccttctgcctgctctctgctggctgcctgggcatctcagcttgccttactaatgcttttgggctcgaagggcatcgccaggttggggaagtgctctgttctaagggttcccaacctttccagccccagcaagatctctaggtcctgagtcttttgatggctttgggttttttgtttcactgtttacctttgagcctttgccattttcagagatgtcagggaaggccaccctctgatccctgcacaccagagagcccagcctgtagcctgcaggccttgtcctcctgaagtgccatcaggtggccgtgtgtgtgtgtgtgtgtgtgtgtgtgtgtgtgtgtgtgtgtgtgtctgtgtgtgtaaataggacagccattctcgctcgctctgggtggctgtcaccatgattcaacaccggctgttggtttcaatgcttgattggttgctaagcaccgtattcaggtcagacacatgttcataggtgtgtttgttttgttgcaacatgaaagctgtcctcgagcagctctcctgggccaggacaggctgacagctggttttggatgctcgagatcttgatccctgctggtccagccaggaaaacttcagctgtgtcagaggacccctgagtcttttcatggggctaggggccagacctctgattcagaaacactcgtctttgtagcctgatcactgtcactgtgcctggggtcctgtggtatttgagccccagatcactggcaggctcagtcctttcaccttgagatcctggtcaccctgtactgggctggttctctgagatcccagtttccttgtggaaattctctgccgccctccggggctctcccaggctggctctctctgtttcttccctggcctcaggcttcctggcaggtcttcctctgggccccactccacctgcccctgggtgttgatctctatgtcctctgttcagaacagcctcttctccctcccgcctaccctgtgggacctgcttattcttgacgctgggctttgga

SEQ ID NO: 72182 - DNA, 1128 bp, Homo sapiens
cccatggactgtgggaccctgccgaccttaataaattataaccaggtgccagagcgctggctttctttcatgcaacctcggattttgtgccccaggtgtatggatggaggccatgatgcatggaggctaggaggaaaaccagacagggtttaccagccccctggttggcctggctattttttctgaataatattcatcagcagttgatataaaatgagggcatccagcagaatcatgttagccacttcatttagcccgacaccccaggggctggactcccactgcagtccatcctttgattgtggatgccacagataaagcagaaacgggtacgtgcccatctgtggagaattgacggggccgggggagccaccctgtgggcttttcattcttagaagagctttaacaaaggtaatcattatgtactgtgatttatgggccatttgacagaaaaggcttttctctgtgtgaagtatctgattagatctggcactttataatgggattcttataggaggtagaggtgggatggggttttcattggctgtaaagttccacagtgaatagttttcctgacatgctggagcagacggctttgtttgtttcttgcttagagttgaattattttggatgccctttttaaaccaccatgtcttccccaggagaaacctttatatttaaggatgccttctcatgcaagacagcaaaattcttcattttagtctgtatggcatttgtatttcagagtaattatccctagcaaatggctgcaggctgcgtttaactgattcccacctccttccctgagagaaagtccatttgtcagttgagtatagggccaatgttttgagatggatgttgctgctgaattcaaaatagaaaaccaccttttcccaagatggcttgtggcttctgcggctgtttctagtgcagaaaacaaatctcctgtttgtgtcgcccctttggtggttcttggccacctacaacaatgctgcctgtcagctttgggggtaagcctaggcacacttcctgggtgacagtcaatagctgggattaattttatttgttcttgcacagatatttgtatcttgctattgtaaacctcaggatctagtaagttagtgacaa

SEQ ID NO: 72183 - DNA, 1061 bp, Homo sapiens
agcctacaaagtcggtatgttttaaaatccaaaactggaacaaaatgaaagccgtccgtgaatcttggctgagtttgggccgtaattcattcaagtagctcattacgcatcggaattacccaactgccgaagcttctgaacagcaggcaattctagagcttcactttcaactttctgctcttattgatttatgaaaccttactaccttcaaaatcatgaaatattccaggcatgcaaagaggcacagagaatattttaatgaatatcgtgcacccaccacccaaccgaggaaataaagcctgacagttacaatcgatgctcctgtagactcctcccagatttccttccttctcgctctccctagagattaccactgcctgaatttagcaatttttcttaagtttgctatccatatatgtaatcataaactacatgaggcattgtgtgtgtttaaaaactttatataaatggcatcttgctaaacatatccttccgcaatgtgttcatcttgccacgttggtgggactcatctgtgctgatctatattgctgtagtttatttcactgctgcatagtattctggtatatgaatatatcacggaatattcatctgtcctcctgctgatgggcatttaggctgcttgctgtttcttgccacggtaaacaatactacagtgagtgtcctggtacatctccttgtgtacaaatgcaaaacttcctccagagtgtatacttatgattggaatcactggagttcaaggcatgtatggtagacagaattgaaggtacacatgccctgtgtaatctccaggaccgtggatatgaggaatatcgctcctgagactggattgtgttttatggcacagttgaatttaagatagagagagtgttaaagacaagataattgtgtctccataccacttaatccttccccgtcccccagccaattcatacgttgaaatgctaatccccaatgcggtggcactggaaagtggggaccttaggaagtgattagatcataagggtgaacccctcatgatgggactggtgcctttatgagaa

SEQ ID NO: 72184 - DNA, 1067 bp, Homo sapiens
gattgaacaacggcataatacttccctaaccgattcccacaaatgcatgcattgagccaagggctgggagagcactttgttgggagccccagttaagggattcatggtgctcatgaggagcagagatgcatgagtctcctcgctgacttttcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggtgagcgttccaggggccctgcgtccttggtcagtggggatgacttctctctcagttagcacatcctgcgaaggagagcaggagagccctcacgcctaggactggggattcttgaagcttcttgcttcttatccaggccaccctgtctctgagaaaagtattcagtggcttagacacatttcctcttatgtgcttttccacgctgaccacatccttatacgccatttgctttcccctgggcttatctgtgacaggcacagcctgctgctagaccatgaccaaaggatcacgtgttttcacttttgccaaagcaggtggtttttgatacttggaaattccatttcagctacttaagcatggctaacaggcaccaaattgctactgtttacaataagtatggtcaactctaaaacgtcctcccatctctaaacttctataaattatttctaaagataccagagccactgtaccattcaagccagccagcctcacaatgcaccttcccgagtccttccagccagtgcatgttttgctccatcaccactggcttcttaatgaagagtgttcaaagtgatattatcttgagcagtagcctgatttgttgcacctgaaattgattcagataaattgcctgatctttcaaaatgtttttaaaaaggtcaaagtcaaattctattgtatgtatgcaataaattaatttatagtttaatgcagtcattaa

SEQ ID NO: 72185 - DNA, 1060 bp, Homo sapiens
cagaggattttacttttgattacgagagtggctgttacagatgtccatgtgttcagtgctgggggcagtgatttggctggaaaggcaactgggactggatttgaagctgatatttgcacaacaagggaaagtgctgaaaactagggacgtagcgaagccccacccctatcccaaaccgcctctgccctctagctaagtgcaaccttgatttgatggggctttctttccctgctttttgctttacaaagttcaccacgtgatttgggggtgcataagggcctgcaacttatcatctgcaaaatacattttccgtttgtttctcatgatcaaaagcagcagttcattcccccctcggattcctccacacgtaaagcgtttgcaccgtaagatatcttctagagaggaaagtttgctgaccttgtttacatttctgctgtctttaaaaaaaaaaagccatctctgtctcttcctgcacacggatttaagtgctgatttctggaatccttgaaaccactgattaatttttaataccaattgtctgtttatttttgactgtggatttagaggctttgcaatttgtcagggttcggaaaaggcagaattgttcttgggaggttccataaataggacagggcattgaaagaaagaaatcttttcctaagatttaagacttgggccgaggcaggagaggcaaaacatccttgaattagaggttgatgtattgcgcctgtataaagcaagtggaagggcggtgccaggctgagatgccctcggaagtttagtgatggttgttagtcacatatgagaccttctgggaaggttatgtgggaccacattctcttttctgaaatctgtgggggcaaatgtatttcaagatttagaattactgatatctttgaatgacaagatagaaggaaagatagaaaaatagaggcatgaagtcatatgcatgtgtggtatggcacccttagtctgcgtctggagttgcagcctgtaattgcacatcgtgctgactttgtgtgcaatgtatgaatctttacctaaagaaggataataagac

SEQ ID NO: 72186 - DNA, 1040 bp, Homo sapiens
cgtacctggtttataggggtgcagctgaaaacacatgcaagcacacacactcacaacacattttggagaatattctgaaagaaagtaggcccaagaggtgtatttaacgtccccatcttcaaagacagaaaattgctggtaacttttaaatcagcattttctaatttgcagtctgccctatatgattctcaataatttttggcctatattggtatcatctgcacttccatttacttaacaacagcttttctctatttcaagtcttttaatctgagctttgccctaagcaatcatttccatgaaagtcactgttttacatactaattgcattttccccaaaacatcaagctaaatacataactgatagcatgtttaaaggtcctatgtttcacctcaaattatctcatatttcacatgaggcaaaccctgtcctgaggccctgatgaagatgggcaggcagatctgatatcagctgcttttctttccttgatggaacctctggattgcgtgccctatcctataatgtgaaaaaagggcttccagaaaaggtggaggaattactttctgaaattctgaaaggctggatccaaaggtgcagaaaggaacattatttcctaccatataaaacccagtagggcgtgtgatgctgggacactgtatgagtccattctcatactgccataaagaagtacctgagactgggtattttataaaggaaagaggtttggttgactcacagttctgcaggcttaatagaaagcataactgggaggcctcaggaaacttacagtcatgggaaatgggaagcaagggacgtcctacatggcagcaggagagagagagagtgaagggggaagtgccacacttttaaactatcagatctcatgagaactcactatcatgagaacagcatggggaaagccgcccccatgatccattcacccccgaccaggtccctcccttgacatgtggagatttcaattcaagatgagatttgggtggggacacagagctaaaccatatcggacactgaagatgtg

SEQ ID NO: 72187 - DNA, 1040 bp, Homo sapiens
ttcttttggagcagcctcctgtgaattcagtatctggtatgtgtttagccagctgccactgttttcctcaagctacgtgtgaaaccaacactctgttaagaagtggaaacaagatcctccccgttattgcatcaaaactagggcaaccgaaataaacaacacaaaatcagcgcccggaagtggagggaaggagtgaagccagccggcgtcagctgcacagagcacacggcccaagcctccttggaggatgattgtacctctttggggtggcccccacagcaaggtgatggcagggcctgcggggccctctctcacccggaacacatgctcccagcccagtgctggtccaagctggtcagaggctgcggagctcagactcagcgacaccttctccagggaagcagtctcaaactctaggcccagggggcctcactggccctcagacagtttattgcacacacagcagttaaaagaatgacagagaggcagggagagagggaagagagaagagacaaggggaagaagagagggagggaagatgccacttctttaaaattagagacagcacataaaaactgagattcttagtttctttagaaaagttaagatttggggcaacagcaggctggattcgctgcctggcagccatcggctggagtcagggaggggccgtcccttgggtcttcggatcaccagaggccccacctggccgccctggcattccagccctgcctggccctgtattctctgggttggccacgccagcccaagaaaagcctcttcctctctccacactgacaccacggatcccagaagaggaagccactggcccagacgcttttcctgggctcgggctcttggaagtggagggatcccctgggtgaaatagaagccctggcctcttgggactaagtcagacccatacaggaacctgccggccaaggagccagtggacatttctaagctctgccaccagagggcggggaagggcacaggtgacggccgggcacggctgcccaggagcaagctgggtctggggt

SEQ ID NO: 72188 - DNA, 1033 bp, Homo sapiens
cacttatcaaatttattgatggcacagaaggaagtgaggctgcatgttttaaaagtgagtttggttgaattcggtatacagaaaaatatataaataatgagatagttggttctcaaatatagcaaatactgcaaaatgaataaggcaattacggaaattcaaggaattctgctgtggatgctggcaccctttgtgctctgattatgacgagttatttttctccttatttttcttttttattaattggcgcatatgcctcaaaacataaaatcttgtccttcaaacctttgtgcagctgagtgaactactttttctttttttcttgtttcatttggcttctcttgtttttatttggaagtaagccgaaagcatgaatattcatgatgctgttaaacaagatttttattgaaaacaaaaacagattcaaagtttcttgtttgtggctctctagccagagagtaaaagccccattgaaagattggtatcagagatttgggttctttgctgtttacttttgctaaaaatgtagatgtttggctactaaggggttagtctgttttagaaaaaaaatacaaaaataaaccagtattacgtttctagactgcccttttctatccttgagcaccagaggaagacaagataaaataataaatgaaaaaaagggagaaatattgtttttcctgtttgtcctaagttcaagagaaagaaaagacacaagcatctacagctaaaaatgtgcctttgatttttcccaggcttcctttactttctgatttctagaaaattgatcctcttcatcctttttaatttgtgtgagtctccgcctgctacccccggcaggaaagagggctgcatattttgtgaggttcattaatcaacccattattcttcctcacacattccaatgtgcagggccactcatttttcatgagacctattgttacttggcagaaaataaatacaccatcaaaaatgtattgcgacactgactaaaatttgaaggggagtaagcattgcactttcggtctgtaca

SEQ ID NO: 72189 - DNA, 1931 bp, Homo sapiens
ctcagggaacctcctccttttaccttacagaagagagggatgggctgctaggggcaggtggggggctgcagacagcccacctccagagcccccggtggcgatgtatctgacttcagggagcttcttcagtggttttgaaagcaagatgcttgtgcattttggactacagagacaacatttgttactttttttatgactccagttaaaccttagtgggaaccagattaaatagtaaagtcttgaaaaaatacctgtagcagcgcagcttacctgccgctttccttttgttttctccaggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccatgagccggttctttgcgtggtttgtcctcagtcgctgctggtgtggcgtgtggattcctcccctgtcgtgtagaaggcgcagagcttcccgagtcgggaactgaggggagggtggggaagtgcgctcctgcacagccctcggatgctccggcgcgtctcctgattctgcagcctcctctgcatggaagggtagtttcagcatttggagaagacaaaaaacaaaccaaaaaaccctcacgttgttgttcgttgtgtaatagaaagtatagaaaaactatagaaaaatacaagacatttcaaccagtggaagtaggatagagtgaatacagatgacactcatggtatcactggatctcagaggggccggagttgtgagcccaggttaaaaaaaacggggcaggtttcgaaaagccttgtgctacgaaggataccactttccggagacagaactcatgtcttcaggatatatca

SEQ ID NO: 72190 - DNA, 1134 bp, Homo sapiens
agatgcttttacactttatttccagtggctgatttttgtttatagagtaggagctgctgcccttgcttgtttttctcatgtctttctgttacacttgataggtgaccagtaacttagcctgcacctgcagtgagatctcaatgctgctgagagcacaggttgatttgtgaagtcagcttactttgttgcaaagattaagcctaccctatgcagggaaaccaacatcatcatcatcattattatcatcatttgttgttataataataaatcagtagatcaccttcgatccatcactatgattggaagaacatctcagtattacctgctgttgggtaaaatagcactactgttaattctacagtaggactttttaactttctcctactcccctttgtaagagacaaacgaggtatgggtgagcaatccagatatttgaggattaaatgaaacatgttgaacatctgattttatataagatgctgtaaaaagccgaagtgaaataggtgtgctatgccatgacctccactcagcctgcttaggaggctgaaggctgggggcctattagtcctgggggaagctgtgattagacgtggtcctttcacgcatcagaatcacgtttgctacgaagtctcgtagccaacatcagatttttagattaactgtaaatgttaataaatgaatattacactaacctacttttgaattctaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggtgaggacctttagtgccggaggtgtctgagtccaggcacaagcgtgagcgctcgggcattctgactgtgctgttggaatatgttgagacaaggatagcacagcacttctgtagtttttggcagtgtgtggtttagaatatgaatcgctaggtaaacacaccagtgctgaggttctccattctttgtgtaaaaacagtatcgcaaaatattttcatgaaagtttgttaactaccttgtaagtgccacaggacagagaagaagaaagcaa

SEQ ID NO: 72191 - DNA, 1825 bp, Homo sapiens
gagaatggcgtgaacccgggaggcggagcttgcagtgagccgcgatcacaccactgcactccagcctggaaggtagcgagactccgtctcaaaaacgaaaaaataaaataaaaaaaaaaagttgggcctccaaagcctgaggaagcatgacatacccaacatttttacagttgtgacacttaatttcatctggcccaatctcagtttcaatccaggttgatctgtgttttgaagataatatagtgcttgatattaaatgagaaatgaaggcgtatttgttcaactcatcagaccagagtagaaatggttctacagctttttgagatacatacttctttgggaatccgtgagaaccagtggactcttttcctggagaatacacacacctacatgcggccttcacagagactcaggcacaggcgtcctgaaactggagctcgtcaacttgtgtgggaggagcagagggctcttgtgggtgttcgggtgtcacttgtgaccgtggcttcgtgttggacccttgtatgttgcaaaatagtgcacctaacaatatgtgtaacccagtaaagcttcagatgcatgttgatttcacagcttttaaatattttaattacataaagcgaaagtaatataaccagtaacctgtgtgaatgattctttgtgtgaaaatgggtttatttgttatttaaatgtttttagtgaaaggtatttaatatgatgtggtaaaccactgatagtatctgcattaggtacaaaaggactttaatttcctttttgaaaaaaagtagtacttgaagaagttaatgttttcgagtgaaagtatttataatgtctttggaatttattttcacttttgggtgtttttgtttttgattattttcccccactagactaagtccgtaaggacaggagccctcccctttagcccccaggtagagcaatgcagggcctacagcaggtactcgatcagtatttgttgaatcgaacttagttttcttgtccaaaatttggctaaaatattcagttatagttttcagcgcttctatttttccccactctgaatgtccagacttaaaatgttgactttataagataaagaatttaaaatactggcaccatagtaaaatgggacatgagttaataaactagaaggctgacaggtgccatttctgttggcttcccacagttaaacacaatcttattgggaattaactctctcctggtacttctggctttagagaatagtgtgcactttgttttcccattttacccctgagatccttggagcccgttccccattagagtgttttggagctgggagagagtgcggagctgtctagtggggcctgttcattttctaaataatgaagcaggcccagagcaaggaagtgaaactcgttagtacaagagctggggatgccaggtccatgttcctgctgtgaccggcagatgtgagggcagtggcagggagtggagggacagtggtgtcctgcaggggtcagggcctcaggctgtaaagccaagactgcctgggtccaagtcctggccatacctcaggcacccttcacactctctgtgccccggcatcttcctctgtgcaatagggccctgaagagttttaacaccacatggttaatgagggagcacatgggacgcggtgcactgggcactccctgtttcctactgtcaggggacagagccagggacatcctcctctcatcaccaccagcaccgccctcccccaacagctcttccttaatccaagagctgacagctttcctccgagaatagaagcctgcctcagtcctgccagtgactcagtttaaac

SEQ ID NO: 72192 - DNA, 1977 bp, Homo sapiens
atttagtgtaattaagtgaaacctacctagcaactgtagtaattaaaagcgtggggtgtgctttttgttgagatccgtgaatgtttctgtaaacacaattttgattgtgttgcgcttcttaaaggttgtgatgacaacggtaattttaaccacttgaccgtatatggttttcatccttgaagactgtcatatattttcaagtgtctttcctccctgttattttaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatgggtaagcacttagttctcatcttgggctgtttgaaaggactttatcgatctctttattaacatcctagcttcggtttgttgtgtgcttattgtgtgctgggcctgggctgagtggtttacatgtcttctctcctttaacactgcatttccccaaggaggcgggtgcggtcttattatcccatcttaaagacaggccagtggcctgattccagagctcatgctttaaccccacgttgcactttctctcactgctagtgtagacggaagctcctttggtgccagattataaaggtagaaatttgtggaggacatcgaggagacagaagacatgctttatacatgtttctttttattttaaaaagctttgaaatacatttgaatgaaaaactaagcagttgcttatgctgtcagtacctgtctctgctctttaaaaagtaagccactgcctcttacctaaaggtcagcatgggctccatcatacagcggtcaggtccatcatacggcggtcaggtccatcatacagcggtcaggtccatcatacggcggtcaggtccatcatacggcggtcaggtccatcatacggcggtcaggtctgtaactcttgacaggaaggtgcagtagcagaatggcgagatgcactgagggtaaccagatgatctcatgggacttacccagtgttagcaccaaagtcccatgaactgaggtgttaaaacagaaaggcctgtgtcctcagaacccctccaagtcactggccaactatgactcatgtttggtgatgttggatgccagttaataaagtccagaacttaagcccaagaagagagctcagaagtgtttgtgttactctttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgatcactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaag

SEQ ID NO: 72193 - DNA, 1027 bp, Homo sapiens
aatgaggatgaatggcattttaaggttaggattttcccagagtaatcaaatgctgatattttcatgcttcatctgaagaggacataagtctgagactgtgggaagatatgtgcagtgtcactgtgggtaacgggaaggcccgagtgagaccgtgggaaggtgtgtgcagtgtcactgtgggtaatgggaaggtccgagtacatttcagttaggaaatcatttgtgcctctattaagtttatatactatgtttactggcctcttttatgcttgtcaaaaaattactttttgtttgttattttttcgcacttctagttttgttttctcagtaaccatttctctgctcacatttttcatttttcttcctggtccatgtctagtatagcatgagaattggtgtccactgttgagcaatatttaaatgcattgtgtcctagtgaagaagtgtcttagatgtctgtgaagttctcacctcaaactctttattcagtagagatgtctgcatttggtctaggacctctgttcagtattgtaatagataagagaaaagtttaaactcttgagaataagtgattttcttttaaatttagatttttcgtttgaagtggtgttactatatataattaattacctgccaccatagtggccatgcttaatcatttggacttcaaacaaatctctttttgaggagcacacaattttttttcttttgctctatttcctttagagaggaacacacaattttaactataaattttactcctctgatttaatctttaaaaaatagagtttaaaataccatatcaaatatatgactgctaaaaagatgcatgtgcttattacataccatatctttttttttcttttgagacagggcctctgtcgcttaggcaggagtgcagtggtgccatcacagctcactgccacctcctccccagttcaagggatcctcccacctcagtctcgcaggtagctgggactgtaggcgcacaccaccgcacctggctgatgtttgtaattttttgtag

SEQ ID NO: 72194 - DNA, 1041 bp, Homo sapiens
attaagggttgccacgggccaggagaggggcgtgggactgacttaaagggaacaggagttcctgttggtgtgatgagaatgtggacttggatggcagtgatggctgtacatctctgaatatactagacactactgaattgtacacttttgaagggtgaattttatggtatgtgaatcatagtgaaaaaacatttgaagggaaaagtacccttatgccagggtgcttgcccgtgaccaggtggcaggtccccctccaggtgcggctgcttcatggcaggaggcctggctggggaccctgaggtgtgcaggcctgaagtacactctgttgtgccccaggcgagggttaatttgtcctggtttggtccttttcatttagaggaaacctgtttgtatttttaaggtgctttttatggttctttgtcacttacctcttcatctcccaggtagagcctctgggaaacattctgataggagagacaatggggtgaggctgcatagctttgagaaggaggcctagttggcttctgaaagaggatgtgtgagctgtgagtccaagggagacgtatgttcgtgtaaatcatgtcaggccgtatcttcccccagtgtttcacctttttcaaaggtcacaatcgttcttggtggatggattatttgaaatagtgacctgaaagacgaaaatcttatgttacagatgaaaagagcaaatgatgcattttttttttttctagaggaaaaactgacaccccattttaaggaattcttctgtcagccaactgtttggtatgctgtacacaattctattcttttagcttttcttctccaaattgattttggtggtatcttttggccagtcatgtgaaaaccttgtttacccttggtagggcacgtagctgcagctcacacagtgatgtcatgcaaacgatgggcaggaggttgtggcctgctcgccaggggctgggaagcatgtgatgtcccttcacagcagccaggttcccttggtacagaaatgcctgctgtgtggttatttagggcttagtaatt

SEQ ID NO: 72195 - DNA, 1043 bp, Homo sapiens
gaatagctggcattacaggcatgcaccaccatacccagctactttttgtatttttagtagagacggggtttcaccatgttggccaggctggtctcaaactcctgacctcatgtgatccacctgcctcagcctgttgggattacggtcactccagcctgggcgacagagtgagactccatctcaaaaagtaaataaatttgcactccagcaaatatttttgagactgtctcaaaacaacaacaacaaaaaaacaaaaccaaaacacagaaatgaccaaactctactgtacactcaagtaaagagtctggttgctggccggggagccacagagcgtctgtgaatcttgagtcaggcgcgcacacataggcttcttctctttgtggacctgccaagtgcccaaaatctctatgggagatgcttttgttttcaagaaagcctttttaaatcaaatcagaattatttgggaataataggtgcttagtgaatttattagttgaattgaattattacttgacagaaggagagaacatagatcgatttaaaggtgttgcaagtcagccagaaacaagggtacaattttagttcatgaataatttagattagacaaatttatttagaatatttatgagattgcaaagttagtgtcaaaatgccatttaaaaatatgcttaataggctgggcacggcggcacacgcatgtaatctcagcactttgggaggctgaggcaggcggatcacctgaggttgggagttcgagaccagcctgccaacatggtgaaactccatctctactaaaaatacaaaaattagctatgtgtggtggcacgtgcctgtaatcccagctattctggaggctgagacacaagaatcgcttgaacccgtgaggcagaggttgcaacgagctgagattatgccactgcactccagcctggcccacagagcaagaccgtatctcaaaaacaaacaaacaaaaacaccttaataaatcagaaactaccgattgtctctatgtaaccacctgcattccacgcactctgctgtat

SEQ ID NO: 72196 - DNA, 1072 bp, Homo sapiens
gaaaaatagctaatgcatgctgggcttaatacctaggtgatgggttgatagatgcagcaaaccaccatggcacacgtttacctgtgtaacacacctgcacatcctgcacacgtatcctggaacttaaaataaaataagataaaatgaaacaaaaaagacttgaaacaaagcctctaccacatactctatgtcagtattaagttctattgaaaagaaaaatttccaagcattttatcagaaataattttcgtagtgtattcatcaatctcagccacactagcatggctgttctcagtattacagatgaacccacacgacctcagctgctttgtcatgtcagttacatgtaccattattcagaacgagtgggcccattttcaatttcctgttgtaaggttagtctgtcttcaatctatcacaggacgcaatggcgttgtaactaagattcataatttccagtaggagaatgatttgtcatcacattccatagtctcagggttgactgtttcgttggtcttgctattgaatgattaagggaacagccaggagattttaaacactccttacaaagcgttttcctctggagacctacttggctgctgcttaatcttaatgtgtgcaattagaagttgtaaatgtattcagaatatatgggcttagagagactggttgtggctctgatagctgacagtggcagataacggcttaagggtagatgtaggattaatctgcgtctctgggttttatgatcaggcatctgttcgcatttgtgccatcgtttgtctttgtcgtctctcaggctctggggatgggccgtcctcatcaaccttactctatcttcccttggcctctggagcattggaaacctgtgactgtgatttgtccctcccacttggagcttcagacagtgaaaacagaaggtagagtgaagttggtagacactattagtgatcagataccatctgccttctcaccaactattaaccttgaaatcagggggagtgggtgggaagggcttcatttaacactgcatataaacagttgagtgattgattagtcaccagggtgtgta

SEQ ID NO: 72197 - DNA, 1024 bp, Homo sapiens
ttagttttccactgtcctgtgccctcaggttctgagaaaatcataaaaatagcaaataatgataggactaaaataattttacctgaaaatatttcacacatgctgatttgtgtgatgcatttggagttttggttattgtttaaggtaatcgatacagtcttggtatattccaaagtccacattgaattggggtgatattggagactagtcctagttatccagtaaattagaaatctggacaatggataatattgtagaaattcacttaaaatcataaaatgtcaaatacagaaattctaaataaatataatttaaattgcctaatattatgaatgaaagccaaatgatatgaaataatttatgttattgagaaatttatattgaagttagttgtgcttgcagctgtgacttaaacccatttgaagtgtttttttgtcttcttttttcttcccaagcctggcatcaggaggagcccaatgtgcacctggtgattgtgggtcctgaagtaagttgatgtgcagtaaacacttatctcatctctgttttcctctatatactttttatgtattttctacaatcagtttacattgctcttctttatttttttgagacggagtcttgctctgtcccccaggctggagtgcagtggcgtgatctcggctcactgcaacctctacctcccgggttcaagcaattctcctgcctcagcctcccgaatagctgggactacaggtgcccaccaccatgcctggctaactttttgtatttttagtagagacagggtttcaccgtgttagccaggatggtctccatctcctgaccttgtgatccacacgcctcggcctcccaaagtgctgggattacaggcgtgagccaccgcgcccagcttacattgctcttctaaccaagtggagttttcctctttttaagtaaatgaagtcaatttgcctcttaaaaatgaaaactagaccaaggttaaagatcattacaacggcaatgaatcttgacgactaatttattgcta

SEQ ID NO: 72198 - DNA, 1135 bp, Homo sapiens
tgagtcaagtaaacctctttcctttgtaaatgatgcagtcttggatgtgtctttattaacagtgcgagaacagacgaatacggacacggttggggtatagtggataaattaataagtaggtaggctttccagaatcgacgtaagcttatgaactatatctgaggaaatactttggacagaaactagagaggcagcagagcatagttttacaaattcagccccaggagtcagcctgaatgtgaatactggctcagcaactttctagctgtgtgatcctggttaagttatagaactctctgagcttcagtgtcttcatttgtaaaaggcgggtaatgataaccaggttgttggaagaaataagctaatgcatgtaaaggacttagcatatgttctgcacagagtaggtggccgagaagtattaactattaatggcaacaacagcaataaacaaaaaaattgtgtatggctataatttttctcttgaaatagatttctaggaattcttttaaattttcttatgcatccaaattggctgaaggctaacagcaaattttcagtgacttagtgacctcagggatgtcaacgagcttaacattaccaatcctttgcgttaaatctcaggctttctggtcatctgaaggagctggggtttaatacacacgtgaaacatctccttgccagaagaaatggaaataaagtttctagaaagcagcgttatttcagttagtgttataaactgttgggatatcatcatattcttcaaaccaacttggtttgtaactcataatgcctactggtaaagtgtaaatgagaatagaaattgaatatgccttcactcccggctcatcaggagtagcagctgggaagaaactgcaggcatagcattagcaaaatgtgtttagaccctctgcctgtatctttgaataaatgcttagaattttgtgttacacttgcatatatttaggaatttttttcagtattttaaaattctattcattgtcgataagaccaggagaggcatgggtgttggttgttttgttgaagactttgctgttggatgagccagatatgataactgtattctgcagctttgtcctgagtgggctggaaaaggtgaaacagcaccctaggaagg

SEQ ID NO: 72199 - DNA, 1040 bp, Homo sapiens
aaaaacacagagggagatggcagaagctgtgtgtccgtgcccatgaatctgctgttaggtgctttcagagcacaaagtgtgagtttgtaacgtgatcatcctcagccagatgtcagcacctctgcttaggggttgtcactagtattaatctccattgtcctttcaaattacctcccaactgcagtcctcggggcaatacattttattcgtcatgtaggctttaaaagtgtatatgcttatggtaccagtatttgaactattgtgaactgctcctttgtaggtaaatatacattttttttcaacttcttaaggaaaggtagagtgaaattcgggaatgattttataactagcacacacagcacttcactgcggatgaatcgctgtcaaacctcatttacttcaaagcaaaggcagctgttagcaactctgactgccttaaaatcttgatgttgtgttccttttgaaaactccaaaataacctttgggcgaagtgttttgaatgaaactgattttagaggagtggtaagggtgcatttcattagaattcaattcagatagccacagtgtttaatcatggaataagtgcctatcacttttgaaggaagtgaccttttgacctttcagaattagctgtattttcccatggaagcatagaaacgtcccatttgcagaaacacgtttcttactgataaactccaaaaatcaaactttagctggattcgtgggcagcggggtgaacaattctacaactaatcagttgtttccacttttgagctttttgacggagttgaatcctgcagagaattacattaaaagtatataaacagttatttgcttatcccagccatcatgattaggctcacacacacacgcacacacacaggcacacacacacacgctcacacacatgcacctacagatgcatgcatgcacacacatgtacacacgcacatgcacacgcacgtacacacacgtgtacgcacacacacacgctctgcctgagagagaggaagcccatcttctaaagcagagacgagcac

SEQ ID NO: 72200 - DNA, 1008 bp, Homo sapiens
aaataatatcagaataggaagagttttcagtagttacttgttgattctccaaacaaaggcttattgctttttaccatattccatgtctctcaaaatcaacgccagccaagcttcaggtcagtgaatattaatatccgctctggcaaagtgttctgggattttttttttccatctcccaaaaggcaacgtctatttactttatagctcaatttcagaggaccaaagaaagcactccaactttatcagtgaacgtctgaatagcaattccttataagtggatctattaggctgaacaaaagaatgagagctgtttggctcttccaatttcatacagcctcttgtaagatactccttttaatgtctgcaaatcattatcgtgccgccgatgtattcaggtcatttctgcgagttaccggcttcctgtgagccatcagacacgactctgcggcactcacggagtctcgttgcagacttattttgattccagcgctttcgtgttcatttcacaaaggatgttaaaaaaaatagaactcttctggttttatgttgggggaggctgcgattcttaacacacgttgaaagagtgtgctagacgtggatgtcgcacctggttcagtctggtttggttttctttacggtcttcttccaattttacctagcatggggtaggagctgttgttttaaacaacaacatgcattttaaataagtcagggactatggttctatgaatcttgactaagaaactcagatgaaaggaaccactagtgggttgccagtgttggcaagattaattttaaatatgaggccgggcacagtggctcgtgcctgtaatcccagtactttgggaagctgaggtgggtggattgccagaggttaggagttcgagacaagcctggcaaacatgcaaaaccctgtctctactaaaaatatgaaaatgagccaggtgtggtggtgggtgcatgtaatcctggctacatgggagggtgaggcaggagaatcacttgaac

SEQ ID NO: 72201 - DNA, 1072 bp, Homo sapiens
ctgcatgttctgcacatgtatcctgcaacttaaggtaaaataaaataaagaaaagcggggcatcgttatttcagatgccctaattattatgttggctgagtatttatgtaaccaggctacgtttgttctggtccaatttttattaaaataaattcgtatttccctcttttcttgaaccacaacttaaaattactccaaaatttgagcaatttggagatattcgtgtctctcttcggaacatctgaaaaccctgaaaaaggattacagattttcatcacctcctcagcacatgcggattgttaaaaatgctggcaactgggggatgggtgggctagaagttgagactccatcctaaggactcaatcaatgcattagtcattatggatattcacaaaaataaagttatcacatgcattacctctcagttcataaatgctaagtgacagcctatgacttagctacaaaaatggtattatcgagataaaaagaatctgagaggaaattgagaatgcaggaaggagaaggtgctagaattgaacactggcgtaaacataaatcacaaaagaagattggtttaatgcaatatgagagtcagaagctgaaggtgttataaagatcatccactcatcagatgaagaatccctcaggctgaaaatctttggtgagaaaaagcatgactttggacaaaaagagccagctagacagaggctgtttaagcctatatgagaaataacctatcattagggaatatcctattttataaattttaggtacaaggtaagaaatatttctgggagtacaacgtatcatatctttcatctcaaagtagttttgctgaaaacagcccattttgaagacttttcttatatccaaggcttattaatcttatataggcttacctagctttactctgcttccaagatattgcatttgttataaattgaaggttcacggcaactctgtgttaggcaagtctgtcagcaccatttttcgaacagcttgtgcccacttcatgtctctgtgtcacatttggtcaactctcacaatatatcaagctttttcttttttatta

SEQ ID NO: 72202 - DNA, 1077 bp, Homo sapiens
cgcaatccctgcagcttctccattcctgagctgaatatttgaagccatttggctaaactcttggggtggggacaaaaaagctgatcgggagttataggatctgcaggtggagaaaaaaagaagggactatttaggaaactgcctcctgggggctgtccctgtggctgcgcaggttgtcgggcgcccagctggattgcagaaagagaactgctgggagccggctctccaccactctcctctcctcaggaacaggctgctggaagaggagccaggccattcaggccccaacactgaagcactccaccagggatgctgaaaatagctgcagaagagcttctctgattttccactcgtctcttcctcccagttgtttactcagcttgttaagcgttgtgctcccatccccgaaattacactccttctcctcacagcagtttgctgcactcacagaaagattccactttgatccaccttaggagaatgtgtcaagctttatacacctgatttccactggtgtgtgtctctggtgcagaagcaagggtggatgttgatgctgttgaaatgctgtataataaagcaggttcaccaagagcagctgtaatcaggtagggctacagccccctttgatttttatcagtggacatttctgaaatatttggtggatactggtttattcaggacctgttaatgaacacttgagtctgtaagttgcaacaacaaaaacaaaaacctcagcaaatttttcaggagtaatacttgagcccacgtcaatcttcctcctagtgtgtgcagtgtggctggctttaggagagagtggctctcccaccagctgatctgtgggttcttacaatgtccccaaccccgaggctatcccactcctaagtggctgcaggggacatgggttgcttttgctgcagagagtccactgcccttctctgtagtgacaatacacaggttggccctgggggaccctactccccaaactcctcattgagttcatgtgctttgagatgatttagggcttggacaaccagtatgtttggatccctgggctgcagtgctgggctcaaggataag

SEQ ID NO: 72203 - DNA, 1080 bp, Homo sapiens
gtgagactccgtctcaaaaaaaaaaaagaaaagatctgcctcatgccatggtcctgaggcgtgaggaccacatttatcttcaaaatggaggatggcaaagcagagctggggcatgactaagtgatggacatggaatattagaagctttctgaataacgagagaaaataagtgaggctctcaagacgaaaaacctatgtttctgtcacccctgatcacagtaactttgggaagtttctattttggtatcagcctcttcttatctgtgaaataatgtcacaatgaccccatctacttaatagaattcttgactttttgttaggaagatcagtgataatatgttttaaaacagcctatgaattttccatcatataatggaattctctctataacatctccactgggaaattgtctagctttcatttatcttctctggggacaggaaataatgcattacctcttagggaaacccatgcttttctatataaatagacataatagataaatatgtgggtaaagtatggttatgaatatagatgatagagaaaaagataataaagctataaatgttatgtatacagagatagatgacaggtaggtaggtaggtaggtaggtagatagatagatttgtataaataatgtctagtgggtggctcgctttcattttattattcatttaagtcattattggtactcctctttcgcatgtccttatatccaacccaataccaagtcctgttgattttacctgaaaaaagatggatttatgtatttttcaaatctatccctttcttcctgtatccactgcccctattgtactccaaactattcttttttctagtgtaaaccattacaaatgtttcaactactcttaatctctctccacactattttctatactgtagatggtaatcttttataacttcatttttgatgatgtccttatctcatacttaaaacatatctatgactttctttggctcttagatgagacaccagaatacttcacatggcaaacaaaacctagcctacgtggtctaacccctgcctacatttccagtctcttctagtatcatctttt

SEQ ID NO: 72204 - DNA, 1032 bp, Homo sapiens
ccacccctcttctttctgcaacagaaagaaaaaagccactcctccgagtcagaagccaggggagaaaacacacacacacacacacaaagctttgtgtaatgcacagtaatgatagcccttgaaaatgtctttgctttatctactaaatgccagcctcagatgcagagtggctgaagtggaggagctggcctgggtagaaaaatatatttcaggagtgtcaattctgtcctcagctgttcctgaatccaagtgtcacgtgtgtgctcttctcagcacattgagagcttcgttatctgttacctaggctattgaaatgcttttcggacatttacccagggtattttacacacagctgcttgattaatccctctaaagcgcggttctgggcttgcctccttccgagtgaaaagcttcagtggccttccattgccttctgagcaaattggaatcctgctgcctagcaatcagggccctttgggacctggatctaacctgtatttccaaacatttagtccattacagctgttcaagcacagaacaggtcattctgccatgccttcccacacagagtgtccccacatgcctaaattctttctggttttcaagccaaattcaaatgacttgaccttggcatgtctgctctgtcatcatcccaaattcctgtgatacccgagggtgcagaggagcctcctcccttttaatctcctctgggttccaccacagtagcaggtgcaagtgatgtcacccagccccagccaatcagaatgctcaacctcttggccacagtgattggtcagggatggtcatgtgactcaagcatggccaatgaaattccatcccaggacattggctggagctatagggaagccacccatctttccagtggggacctggaactggtttctcttaagcccccagcttcctttcaccatctttgagagtctgcttggaaattgagatagagaaaagcagagccaagaatatgtcctgatgataaagtttcaatcctggattcaaccatgtttggatcca

SEQ ID NO: 72205 - DNA, 1111 bp, Homo sapiens
ggctcacgcctgtaatcccagcactttgggaggccgaggctgacagatcacgaggtcaggagatggagaccatcctggctaacacggtgaaaccccatctctactaaaaatacaaaaaaaaaaaaaaaaaaaaaaaaaaaaaattagccgggcgtggtgggcgggcgcctgtagtcccagctactcgggaggctgaggcaggagaatggcgtgaacccgggaggcggagcttgcagtgagccgagatcgcgccactgcactccaggctgggagacagcgagactctgtctcaaaaaaaaaaaaaaaaaaaaaaaaaggaaaggaaattatgatgttcaggtgaaatttttaaatatttataatatcatcaaggccaaacaagacatacctgtgggttatcagtttgtaacctctagttcagacatcaaacacatagacatctaaactgaatagtttggcaaatattattgagtgcactgagatggatgtagaagagttttttgttgttgttgttttgttttgttttgagtattgtgtggagtagcttggtaccagaaaaagaaaaccacttaaaaatccagtaatacgaaattgactaaatgaactatagtagctacattgaacagaatgcagtgtgtccattagctgtgatgacatgcatttggaaaaatactttggatatatggttaagcccagagcattttaataaagagcgccctcaccctaattccatggggcatatagatttaatctgtgtccccaagggtccctgttgactggacaatttctccctctcttcctctctgttattgacagatgtatagtgaactggagagcttagtctctttcctcatattggtaggtcaaccagttgtctggaaaattattgtattatggctagaaaagactttagaagaatctgtaccaaaatattaatgtaattatctgtgaatggtaggattatataataatgatttttaaaatccacttgctatcagtaattatgaactcatttactatttagaaagagtatttgtatattttagaaaataataaaagttttaaaagagacaattacattctactataatgatttccattttcctcaaat

SEQ ID NO: 72206 - DNA, 1034 bp, Homo sapiens
gccatactggtgaactgggtgaacttatagatacacaaattgaaacacatctgtaccagtaatataatttggaaatcaggtgctatctcaataaaatatttcttttgtgttttgtagttagcaaaaattgggagagatggacacgggggtggacggatgggtagacggatggaggaatggatagattgatgggcaaatggatggatggatgagtggatggatgagagggtggatgaatagatgtgtttattctttatcagaagaaaataataaatttaggggaaagaatctcaaccggtgaactttcattttctcttgtgatttcttttgccatctctttttatgtattagtagaagcagtagttgtagtcttgtctatgagagactgagggagttgaaccattagaaaatatttgtgccctttttattgttaacttctgacaaatagttcagttcatcttggacacagagagagagcatgggggggcccaatggtggctccttcccattgaaatgtaagctgcctttttatagttccagaggcttccagaatctcagcacattcagaggacatccaaatgcagaaatgcatggtggatgccatttatttttctttcatctgtgtcagtatcttctttaagaaacgaggaccctgaatagaatataaagctcttcttttaaaagccctaattcttcattctaagtgaagaccattccttatctctttgtacattctgatgccagttttctgtttccttttttatcttttttcttcttgtcttctggaggccaggatatgtttcctcatactatgggtctggatgatggaaaaaggttatacacatacagacacacacacacacaatatgttatatgtgtataatatgttatatgtgtgtacatgcatacagcatattatatatgcatatagaacacatatatgtgatataggtatgcaaatgcatgcatgcatatagatgtacattttacaggtgttttgttgatagacaaatgtgttgaggtagggattttac

SEQ ID NO: 72207 - DNA, 1036 bp, Homo sapiens
gcaaaaggctccaaatccactgtgtttgccttcccattgttcctggctccctgtgaagaaaacattagtggtttttggcaatgagaacatgaaccaatgtgagagaaagctgtcaggcccggggaccgttaaatgggagatggatggggaaagtgatgggtcctgacagcctgggagtctccggccatccatcacactctcaccatgaaagagagatgccattcagatgtacttaaattcccaaagagctgacaaaatgaatccagtggaggaaggctccgggtgtgaatcatggtccccttgacttcaaggggtattaaaatgcacatgaggaaatacaaaccagcagactcaatatttgctaaacccttagtaggctcaatttcctggggaatttggttctacttatgtgcctattcattctcaggtgacatataagaaagctgtaatgggttttctacctactatggccgggagtcccacaaaactaagctcattggatttatattgtttcttgaatttaaataggtaaaagctccttgtaagaattggaaacaatgtatcttgaaaactttggatttgtctgattttccacatgtccataggtggttgatctataattcataagtgttatgaaacattggagaaaaatacagaggaaagccaaccatatccagggggaagatgtttgtctctttgtacatgaattttgctttgtctgtaatgcgacggtaaagtggagttttttgttccttttggaggacagatgatggttctgttaagataaaaaaattagttgtattgaatacagaaaaaaacatttaagccaagcatcctacttacccctatgtgggatttaaagtgaatcagacatggtcctggccctgaatgaacttgttgtctacttagggggcatagagggggacagtcaaagcaaagagaggactgcatagaagatgcgtgaatgcaccgaagtggctgacaaagtgtcacaaagtggcacccaagtgatgacaaaggtcatcaatagttagtg

SEQ ID NO: 72208 - DNA, 1097 bp, Homo sapiens
cattgttttgtagcaagtaatacaccccctcttaggctaaggggatttgttgaagctttgtaggagaaatgaaagaagaaatatctaagacatttctaggttactttatctaagttatttgcaactgtttatctaaattcctcaaactacagtggtttttctaaccaaccaggggtttactggattactgatgctgctttcttttcctagaaagtttattccctattgtcttcgcatagtttttactttctccatgagcaggtcccatttcaaatgtcacctccccagaaaagctttttctggctactctctcaagcacttgttactagctgaaattgcattatttatgcatggtgtttgatttcaatgctcatctgtcccaagctgctggaagataagttccactagtagaattggtctgatttgcttactctgcaactcagaacctagccttgtgcttagtgcacaatggcaatgtcatgattatgttctgaattaatagttgactgcatgaagtaaaatgcaggtaccagcctccttttcggaaacaaatgcagtttagctagaagctcagaaaattaaacattctcagtgacctgtgttaaacatccagtgtctaagtttaaggacacactttggtaagttttctctcccttggccacagctgctttcctgcagaccatggctatccatgactggttgccaagtgcttttcaaatgagagaaaggcaaatggcccattgtgtttgccattaacttacccgtacatttttataaactgcaaggcattgttgccttgaaggggaggctgccctctcaaacgatgaccttcagcatttattttaactacaaaaatgtatttgactgacggttaaggggctgcttagagactttgtttatttccttcttgatggtggaaatgtgagatcagccccctcctatcccattgttttctgacttaaccagttgacggtggaaatgtgagatcagccccatcctatccctttgttccctgacttaaccagttgacggtggaaatgtgagatcagccccatcctatcccattgttccctgacttaccagtgccagctacctct

SEQ ID NO: 72209 - DNA, 1049 bp, Homo sapiens
gagctgggattcaaataaataccacttggtgaggccccgtgttctgtatgccagcccaagttgatttatgttacttccaaccaagaatgtcctggtgaatatgaagtattccatccagtgacgtgctcttattgtttaaccattcatagacatttagggtgctcctatgctgccttggtctagttaatcctgctctgagcatctttagcggtggaaaaagatactctcaatatataccctccagacacgcaagcctctctctgttctcgggagaagtgaagcttgtctctccctctgggtttttgcactaattgttcctttgcctggaacatcctgctgcttccatatcttcactcaaccgaccaacctttctcattcccagccctcacctccagtgtctccaatgagtgaaggctctgctgattccactgaaatcaccaccaccacccttacctgccgctcatctgtcatctcatgctattgtcttcatgacacgtggcagcctccacaattaagctgttggctgtctacctgtttgtgttccatttcactccattgcaatgtgtctgccttgctcactgccgccgccctcgcacctgaagtttgcatagcatacaggaggcgcacgatgtcgaatgcgtaattaagtgaatgactgtatcttttttaatttagcaaattatttcgtcagcatgaatccctacgaatggaatgcctacagggcatttgtatcctagatccttgcatacccaggagtggctgctgcccagaaaagcagcctgtatttcccccttgtttgttctaacaaaccgctgactcttccctcatgattttctgctctgcagggatgaaaagagtcctgtttgctcttgcttccttttctcagtggtacagcaatgaatcttgcgcactctgtcagcatctatgtcttctccattcctcaaagatgctaaaaaagataaatgatgtgggaggaagtccgagccaggagttgcctaaatgcaatgcagcttccgccctcacaggtccccaggacctgggctcaatga

SEQ ID NO: 72210 - DNA, 1041 bp, Homo sapiens
gcagtttgtgtaatggagagagcaactgctcctgaaaagcacgttgaatgatcaaattttattggtgcatgaaaacgtcagaggtgaatatcgttgtttggtggggcagctatttaagctcaggtctgggcaattgctttattcttgtctgaagagagaaagaaaaaaatagatgttttggattacattttgtgtgtaattatatatgacagatgtattaacttagccgttccagggtttttggaaatctgcctccaaactataaattttatttgactttttcatttgcaggtggcacgaaaccatttcatgtatatttcgtgggctccggagaggcaggaagtccaggaactattgtgatgctgtagctcattcattctgagagagacatgggtgtgtggttgggaagtaaatcatctgcgtttacgttttgggttaaaaatgttaacagcagatcgaagacattgaaagcaagcttttcatttggtgggggaaaatcactattagaaaggtctgagcaagtttggagtgggaataaattacttctccttggttttcaccttttaaagcataaatccttctatttggagaagttgcctcattgaggaagataaaggtgctgttcttttttgtgtatgtgcgtgtcttttgtttgtattttacctgcaactgtagaaagttttaaaaagcaattgtttgtaaacctagcaacttaacaaaattcatctggacgtgtgaattttgtactaagatcttcagtacaggactctctgccttgtaaatagcaccgtggacctgtgtttagttttggtatttccaggcttacttcccatgaaaagggaatatccttgagaataaattcttttagggagatgtcaacaaagaaaattgtcacaaaatactttccacaaacatgcatattttaaataatgcaagcagcatctataaaaaaataattactagacttgggtaacacatatgttactgcctggattacataattatttctggaatacattcctttaagtggcagtggtcaca

SEQ ID NO: 72211 - DNA, 1022 bp, Homo sapiens
tgagatgtgtgtgtttaacatgataagaaactgccaaactattttgcaaaatggttgaaccatttggcatttctgccagcaatgtgtaaggttccagctgttccacattcttgccaacacttgatattttcatattgtaattttattgtagccattctaatacatgtgtagtggtacttcattgtgattttaatttgcattcccctaattactaatgatgttgagtggcatttagtgtgattatttgccatctgtagatgtttttgggtaaaatatctgttcaaatccttttgatattttaaaatggccaaataatttgggtggctttactattcagttttgagaattgtttgtttattttgtagacaagtctttaaaccatatacatgatttgaaaatattttgtctcagtctatagcatgttgtttattttaacatgtcttttgcagagaagactttttatttagaagacatccagtttatcttcttttctattatgtaactgatattgccatatcttagaagtctttgccaaaccaaatgtcataaagcatttcttttttgtgctttttccataagtttaatagttgtgtcattttgggcaacatagtgagactccgtctctacaaaaaatcaagaaattagccaggcatagtggtgtatgcccatggtcctagtttcttgggaggctgaggtgggaggatcgctttagctcaggaggttgagattgcagtgagctacgattgagccactgtgctcctgcatgggtgacagagcgagatcctgtctctaattttataaacactgttacagattttattgcattgaggtctataatccagtcttggttaatttttgtgtatggtggggtgtataggtcaatattcacttttattgcatttgagtatccagttgctctggcataatttattgtaaagtttgttatttctcttttaaatcgactttacatttttgtcaaggttgtctgaccgtatatggtagatatactctgagctctcttt

SEQ ID NO: 72212 - DNA, 1040 bp, Homo sapiens
gtaaaagcctccacagttgcaaaagtacaattagacagttcctttaatcaaggagcttaacactaccatcccatagcccattaagagatacatttgcaataaaaaatactttttatcttaaaaggtatttattaaaatgtgttatatatgtatttacctttcattgttttgattgtgtaacagtcataattgtaatgacaccaatccaaagaaatttttgcataatgagaatcttacagtgaggagaaactttaaaaagtttaagttcaatatataaccatacatttttgtggtaagaagacataataaggtaatggacagttactttcaaggttattacattaggttaaaattctgtgaaataactggaatggaaacatgagttcaaggagaaaatggaacaaagtaacatttcttattagtgaagagtttttcatgggttttataagtggatggtcgtgggtgtcaagccattctgttatttatattccaatggatacatttaaaagagtgatgtaacagtttcattttaaaatgtcaagatttacaatacactagaaacttcatccttagcaactattgaaactggatgaaaaatattagataccacttttgaaatttgcaagtgggtacagagtttaaaaagtgttctattaggagttgcaggagcagtagtgtgggaagaccattgtttttacacgagtggttctcagccttgggtacacattagaatcatttctagagttttgcaacagtccagtcagcacctgagccacggtgtagaccaatgacatcagaatatgccaggatcagttccaagcattggtagttttcaaagctcccaaagtgattctgatatgcaatcaaggttgagaaccctggagcaggtccttcaagggaagccatctgttgtgtgtacaagggttgaggcagtgattctgcactctggctacacgttagactcacataagaagatatggtgagtggagaaagtcaggctaattgaagtataatttgcatagagtaaaattccctctact

SEQ ID NO: 72213 - DNA, 1033 bp, Homo sapiens
ctaggtggccaaaaattagcacgtaaaatgtttacgataagcctagcatatgacatattttgtgtattgaacttaagcaagtcagccagacagttcaaaagtgaatcagttctgtgtggagactttgtacagcaattagcagagtctgagcacatggtagatgattcaggattagtcacaatatgtcaaagaacaagaaaaaaatcaacacccctattagcaaattgcataaaatggaatttcatgatgcagatgtgatttatacattcagggacagggccattcttttcccaatgtgttcatatcacctccctctaagattctctgatcacttgaaagttctcacccatcttgcaatcaagtatggactatattgaaaaggattttaattgaaagtaaacacacagacacacacacatacacacataccccaaagtgcctcatttgtctggggctgattgaaaaagaatattatcaagtattaaatatctgtttccacatattatcatttctactgtattgtctttccaaataggaatttttgaatgaaacaaagggcagattttaataccaggttaatatgcttgagccttacacgtttatatttcataagcagaaaatgattagttatagaacaaacccaccctcttgtagatattttttaaaaacaaataaacataaagttttgttgcttgtatttctatgcccctgggacctaggaagtatggtatgacacacggagtttccccagcagccttgtcctatggcccctaatttttctggggaatggccttaaatgtttaaggtctagctttgctggcagcttgatgtagtttgcaatggtgctagcctgcagatgagctttaatgcattactgtgaactttatgggagggggcaggtgtatggagggtgggctgagaggaaaaatgggtgaggagattggagttgggcagagggcaaggtgatttttaaatacaaagtcaagagggttgccacatttaggttgcttgttacagtcctcacgtgcatcct

SEQ ID NO: 72214 - DNA, 1067 bp, Homo sapiens
aattctgttggggtcgaaggagggaggtggggtttgcctgcgcgcgtgttggactccggagagcaactcaggagcccgcgcggtcgtcgcctcccggcctggccatggactggcgggaagagggagcagggcgcccgggctgctcgggcccctagccgggcgctccctcgccaccggccccgctgcgggcctctaggggactgagacggtctcttgttcgcctggacggcgccggggagcggaggatctgcgctccgggtctccaggatgtgcccgtctgagatggggacgctgtggcaccactggtcgccggtactcatcagcctggccgccctgttttccaaaggtgaggacgccgcggccgccagggcccggggactaacttcgcctggagtgagtgtgtgggagtgtgtggaggatgggggcggccgggagagagggctcgtgtgcaagtgtgtgtgcgcgcttgtgtgcatgtgtgtgtgcgcgcgtgtgaacgtgcgctcgtgcggcagccaagctcctcggacgccccttggccgaaggtgcttgtcctggagcacttgggtgggaggccttaggtgagactactaaggagccgaaaggaaaggaaggctgtttcctgaaagccttttctgtaaagggagagggcgtggggacccttgagaggaaaggtggcctctggagggccgagccggctgtcgggggaggaggggattgagatgaccagggagatttctggaatttgggattgactttccctggtggcactgacctatttggaaataattttggagcactcctgttgtatgggaatactattttgtgtattataggctgccaaaaatatagcctggggggcggctctgaagaagggggatgggtttctccaggtctgccgctgtgaggtttgggcacagggtctggcgctcacccttccgtagggtgctgggagcagcagcggccccgcagggtgcacgtggagtttcagctacaagttgtgacccgaattttcccagcggagccctgacttgaagccatgtgtcaaggcaggaattcctcaatgt

SEQ ID NO: 72215 - DNA, 2165 bp, Homo sapiens
cgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatga

SEQ ID NO: 72216 - DNA, 1023 bp, Homo sapiens
agaataaggcaggagacaggaggggaaggaaggagagcaaatgggagggccagagagggacaggaatgggaggagaggagaggggatgagaggggagggaaggggagaggacatatattctaagaagaggtcatataatacaagcaagttcacaactatcttttaccaataacaataaattgtgtattttttgatgccagtaaacatagacctacacataatttttagtggctgcagatattactgctgtacatactgtaatttattccaacattctcctccgaatggacatttctgttgttttcacatagcctgttttaaggacatctgttttctatcattttagctggaggttgactcaaacacaactgtccctagagtgcattaataaaagccaaatttgaacagtattatcagttatctagctctcaactgttatcaactcagtttttaggaatgtattaatattcccttgatttaaatatgtcagatctccttgaggaacaaaacggattggcatagagaagaaataaacctaatccaaatgaaaagaataattatgagaatgaggctacattcgggaaatattctaagatcccaaatgtaaatgtaaaaaaaaaagttagatatatatctgtaaaattggtatatttgcatacattaataaccttgactttcaaacaatgaggtgccttcttcattatggtattacactcatcaagggtgtatttttaaactacaccaaaccaaaaatctagccatctgtctttagaaccaaagaatacatgtcagccacatgaattactttatatgaatctacaaatatcatatcattatattgatagactcaaacagactcatcgactatagagaattgtgtcaacatgatcgcaatgcatcaatttactatgcactgaaatatatgtgtattgatttaggtagagaaatacaaacacgtggacggggtctttgggcttaatcatttattaatcatttagctattaagaacatgcattgaggctc

SEQ ID NO: 72217 - DNA, 1069 bp, Homo sapiens
aaaggcccttagtggatgcttgcattatttccaaataattgaacatgaatcttcctcagtagatagcacatggtagtatttaaatatacgttaagcgcttaatagtgcttcagaggggtagacttttactctaatacgctgcaggacgacttcacctcgcttccctttacagctaagcatgtgcctgagttggcagtgcagcagcattcctctggccctacctctccagagcaactcttgccatgtgagtgtttagtattcagcaggcaaatgctgtaagccaaggggcttcaagcttgcttggatttaaaatcaaggtctaattctaatggaaaacacctagtaaagcatcccaaagtacacctgaagataccatctattccatctaatgtgatcatttgagctgcgtgcttcatcaacttagtattgcattggtataccaacaacaaacgcgtgttgcagcaacttctgtcacaggatgattgtgctttgaggaggagcatagctctctcgtaaggtagaggcagggttacttaaggaaaacacgttctggccactcgagccagtgtttggagtgttcagagccaacactcgatcacctgtgttcactactcatctgcttgaccttgggttaagtttctaaagtaaagcttcctatagtaaacatgtttgttaggttgtgctttttccaagagtggctaacaatgcaatatgcagctctctctatgtaaacacacagttagcttgttaagaaatatgttcccaatgttggcctttcaaatattcttaatgcaaatagtaggaaatgattattaaagatgatttgcttcactataaattcagttgctttacaactgagaccaagtaatattctaattatttaggtccaatagttttttgagacatatttctttgtatctttttttttttttaaccccacaatgaagccttaagtctaccacactggcccggttaaggtagcttaagttggtatctttatcggtatcttcagttgctcacttacgtgaaggctacattgcctgattaaggtgtgaaatgaacactcttc

SEQ ID NO: 72218 - DNA, 1031 bp, Homo sapiens
ggaagataatctgtagggtcgcagggtatgtgcatttttagttttgggagatttttactgagaactttccaaagaagttggactagttttctctcccaccaataatgcatgagagctcctgtttccatacaaagcatattgcctgcatggtctcacttgctggtccttcccacggtgggtgaacacactgcctgcgtgatcacactcagggatccttcccacggtgggtgaacacactgcctgcatgatcacactcagggatccttcccacggcgggcgaacacactccctgcgtgatcacactcacgggtccttcccgcggtgggtgaacacactgcctgcatgatcacactcacggatccttcccgtggcgggcgaacacactctctgcgtggtcacagtcacaggtccttcccgcggtgggtgaacacagggacattcatctttatattttttatttctttgtttgagagaagtttggcttgtctttctcatatttaaaagccacttatgttactttttcagaaaacatggatttgaggggagggtgaagtatttttgtacagagtgtttgttttttaagcccagtatccatagagaaaagggtacacatcacagccgtctcagctgctagattctcaccaggcgaatgcgcccgcacctgcacccgcaccatcagagacaggacacctcaggaccttgggagctctcatgccccgtccatcacctccccagtgagagaagtcaccgccttgacctctgacaccaaggattaactttcttgtgcaaacgtggatgtttaaaaaggcgattgtgagactaatggtttctccaagagaaaagaggttgtttcctagtaattaatgagtagtgggttatgtcctgccccgtggacaaatggttctctagacacaaatgcatggggccagtgacttttggttatgccaggctctgtactggataaaggggaattagtcaaatccagcgaactggaatcccagctttcctgatgataaatgcagggtttccta

SEQ ID NO: 72219 - DNA, 1056 bp, Homo sapiens
ctttacaacctgaatgcatcctctcgcagctctggaggctggaagcctgaggtcagggtgtccgcagagctgccttccccctggaggctctgtggggagcctggctccctgcgttccccggctgtccttggcatccttgggcttgtggccacatcactccgacctctggttccactgccatccgtgtgagctttcccgtgtctgtgtgtgtccttttctacctcttatgtggacactctcatcagatggagggtccaccccaacccccctggatctcatctctacccttaccttaattatacctgcacagaccctgtttccaaatggggtcatgtgggttttttggggaaggcactattcaactactacgacctcaccttaaagataaaagaatgagacatagtgcgcctccgacataattagacaacaaaataagcccatcagcttctagaaacatgacttacttataaaaatctttttgggacaaatgttttgctcatagctcggggtactcgtatctgaaagaaatacttggatgtgaacaatcttattagaaatttcagactcctgtggaaggctccttcccttgtgagcacggctttggccaatgagtctcgtcttcatcaattatcaccaggagcagaagtctgggaagcagagattgggcgctgcctcctaatgcctgagtgactggacccgtccctcacagctcagtgtcacaaagtgacacaaggaaatcgatcgtctgcccaccactgcacgcactccgtgtctgatatgttttgaattttttggaagatcaagttttacagcatacagctattttttaaaatttagctttttagcattcagcagtgacaacttttattaaacacccctggtgcgccgtgcatgatttgaatttcagttgctcacatccataagcggcgctggtgttagtcaggttaatgtcagctgcagcaaaaatccaggaactctgggggctcagcacagcccgttcatttcccccttgcagggaggtgcaatggtcagtgagtggcttcctccacgtggtca

SEQ ID NO: 72220 - DNA, 1051 bp, Homo sapiens
aagctgttattttggatccaccaaattcaggttaattgcagtgttatatgtgatgctgaaatgctggaagcagctttaacagttgaactgttaacaggaagggactggttcagttgattaaattatggagtgttcataggtcagccttttaggcaaccataggcaacctaaactttgttcatggagaattcttactgaaatatgcagatgtttgtgctagaattaagagaaaagggagatacaaagatcttctgtgtatgcccgtacatatgtatgagtacataaacacaaacacatggcacgagcttggctccataaaacagtatccacagaaggaaaggcgtatatcaaacagtgtaatggcagtgagactatgggaattttaatcttctctaaaagtatttattttcagattttctataagaagcatatattacagtaataactaggagaaatgtctgaaagaatcaaccccaagtggggatacaatctatgacacagatgcaagcttgtgcctgttacacggggtttcccatctgcccagtaacacagatagggagtgaaagcaggtgtggaaaggcccttctgagtgaaccgaagagttaatgcaattcttaataaatagaaaactcctctgggaggctgaggtgggaggattgtttatgcccatgagttcaaggctgtggtgagctatgatcatgccactacactccagcctgggtgacagagtgagaccctgtctccaaaaaaaaaaaaaaaaaatacacacatatatatgtatgtatgtatatattgaactctccatgtaaagtacgggatggatcacagatcacatgctctgtgatgtgcatgggtatgttcacactcgctctttgtctttgaataaggtcttctcgttatttttcaaataccatggagataagactctgttgctggttaggattcagctgaccaccaggtgaagcggaagcatttatatcaaaccatcctaagtaaatggtttcctcacttgtcctgagcctggtttcggatctgttttggctggagtcat

SEQ ID NO: 72221 - DNA, 1020 bp, Homo sapiens
gacctcaagaacccccaccccacggggcacagacaaggacaggctggccagcgcctggaagccgcgtgcctgaccacgtctgcccgagcgagtaccgcctcccacccgggaggcaggagagccgcgaccgtcgggccgcgcccaacgtctcccgctcaggggcgcgccgcctcgctttcagcgcatgcgcgcccgggagcccgcccggggcgtcggcgcacgcggtccccaccggccggcttgcgtacgcgctcccggctcgccctcccacgcggtccaccgcgcctcccgccccaccctaagcgcagcgaccgcccgagcggccgaccgaaccgcgttgcgtgcgtgcgcgcacgcgcgggccacgtgggcgggcgccgcgccgttgccccgccccttgcaaccccgccccgcgccggccccgcccctgctctcgcgccggcgtcggctgcgtctccggcgtttgaattgcgcttccgccatctttccagcctcagtcggacgggcgcggagacgcttctggaaggtatcgcgacccggcgggcccggcacggccgggcggggacaggggtggcggcggcgggataggggtcggagccggggccagggccggggcgggtggcggacccaggggcagcgggcggctgagtaggtgggtggtgcgggcccggccgggccggggcaggagacgggcgtggggtcggcgctagcccccgcgaacccccgtttcatcctccgctctcatccccgtcccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtc

SEQ ID NO: 72222 - DNA, 2664 bp, Homo sapiens
gccatcctcttacctcagcatcctgagtagcttggactataggcacgtgccactatgcctgactaatttttgtatttttttgtagagatggggattcaccatgttgcccatgctggtctggaactcatgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatctcatttagcattaattacttcagatacttttttgggatgaggggagtattaatggtgaagtatatcagggagatttgatagggtcagctcatctctcttaggaggaattgtgtattaacatttttagaattgacagagaccttgaaagtgaggggagagatacaggtgactcgttgaggtctaagactataactagttgaatcctagtctctggttcttagcattcttcacttgtgcagtaaactgagtgtactaattcccacaaatgtttcttcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcaggtgtgtaaaattaaaacttcctgagttatttctcttagcggagattatatgtaagaccatgaaattaaccagtgtctattatatatggaaatgatttttttttccccaagacggagtcttcctctgtcccccatgctggagtgcagtgtcgcaatcttggctcactgcgacctccgcctcccgggttcaagcagttttgtctcagctcccctagtagctggattacaggtgtgtaccaccacgcctggctaatttttgtacttttttttctagtagagacggggtttccaccatgttggtcaggctgatctccaactcctgacctcaagtgatccacttgccttggcctcctaaagggctgggattacaggcatgagccactgtgcccggccggaaataattttgtcttttttatactactgtttttaaagaatgatagagattgggtttcactgttggcccggttggtcagctgaaatgtttgtgtatttatatatttgttgttcgagacagggtcttgctctgttgcccaggcaggagtgcagtggcatgaacatagctcactgtagccctgaactcctgggctcaagcaatcctcccacctcagccttctgagtagctgggctcacaggcactcaccaccatgcccacctaatttgtttttttgtggagttggggtcttgctctgttgcccaggcctgatcgtgtactattggcctcaggcaatcccacctcagcccccgaaagtgctgggattacaggcatgagccaccatgccttgccaagaatcttaacattttcttatcttgcaatgtcctagaaaaatcgtcatcttaataatgaattttaaaaagtaattttacctttcttttaaacagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaa

SEQ ID NO: 72223 - DNA, 1186 bp, Homo sapiens
ctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctggattttttgaatcatctctagtatttgctttaggaaatgctgaagagttagcagagattattatcttttgggggggcggcggggaaggggtcagttctctccagattgtacaaatgggaaaagtctgctctccattttttgaaatctcgtgtctaatgggggaagccttgaaagctttatatgaagttactgcaaaccagtaatagcttattagagcaaagtcattaagaaaaagcatagttagtgcataggtcttgtgtggatataatgtgaaactggtaaattagtagtttcaatttgtgtgagagccagtttttttaaaaaaccacatagaatgggattttttaaaaaattgtatcaatcataaaatgtctagaaaagatgagactccaaaatagcctccaaagaggactggtttcctggctaactgttcacctgaaggaactcaagtacagagaatttctggtttcttttgcaaaaacagatcagaaacacaaaaaattacctgctgagcaaatgggatgagggttgg

SEQ ID NO: 72224 - DNA, 1022 bp, Homo sapiens
cctcactcaccgcaccgggcctcactcactgcatggggcctcactcactgcaccgggcctcactcactgcaccgggcctcactcacggcactgggtctcactcactgccccgggtctcactcactgccccaggccttactgcatggggcctcactcactacaccaggtttcactcactgcactgggtcttactcactgcactgagcctcactcactacaccaggtctcagtcactgcactgggtctcactcacagcaacagaatcttactcactgcatggagcctcactcactgcaccgggtctcactcactgcaccaggatcttactcactgcatggggcctcactcactgcaccgggtctcactcactgcaccgggtctcactcactgcactgggcctcactcacggcaccgggcctcactcactgcaccgggcctcactcacggcaccgggcctcactcactgtcccaggccttactgcatggggcctcactcactacaccaggtctcactcactgcactgggtctcactcactgcactgagcctcactcactacaccaggtctcagtcactgcactgggtctcactcactgcaccaggatcttactcactgcatggggcctcactcactgcaccgggcctcactcactgcactgggtcttactcactgcactggggtctcactcactacaccaggtctcagtcactgcactgggtctcactgcaccaggatcttactcactgcatggggcctcactcactgcaccgggcctcactcactgcactgggtcttactcattgcactgggtctcactcactacaccaggtctcagtcactgcactgggtctcactcactgcaccaggatcttactgcatggggccgcactcactgcaccgggtctcactcactgcaccaggatcttactcactgcatggggcctcactcactgcaccgggtctcactcactgcactgggtcttactcattgcactgggtctcactcactacaccaggtctca

SEQ ID NO: 72225 - DNA, 1062 bp, Homo sapiens
tgggggaaatcgcttcgaatcttcagagcttgtctctcccagtgtagaacctctgcccaatgagtcaacagagatgagggcagtgaggccccagtgttctgagcctgccacaccctgcatactatgagttggaggaggaagggagtcccaacctttcagctgcttttatctggagtagagcttctaaagcacaaagttggggggaatgagaaatgcgggcagccttccccacctcccccagcctggggagataccgtagccctggactgggagctggagggagtggagccctgtcttcttgcccacacctacttggagcagagcctctctcacaccaagctgggcagggaagcaggttttggctgaagtgccacagactcagtcttcttaacaagatttagtagattttcttgagccagtttttctcaatttgctgtaaacccttaggaaaatgtacagagactttaaatgattatgttttttaaaacttttttttttcagtgatagctgtctctggggaggggtctgctgagcgacttgtgctgtcattctagaagtcagctccccagtgatgtggcttctttgctgagctttgcccttgcccatcccaaggggtcccagtgagcactggaggctctaggttgggctgtgcattgacacttagcattctcgcagttgttgtaaaacactgaccagacatgagggacctgctacttgtttcaaatacgtttaattttcacagtctttgttatgcaagtagcaggtaaacaggcttactttgtgctttgagttggcaaatgtaatttatctgaggattaagtggaggtaaattgtgctcccctcgtggctccctggggagactgaagaggccacttgggcagccacctccagactgcggctggtcatgcagggagctccccgagtcaccacggacgtcctccgtcctgcctcactgctcatgctgtatcatcacgaggatgcttttgcacacgctggtcctgaggcccgtgtcctctgccctccctccaggtcacgcatgacctgcttcttcaggcctctgtg

SEQ ID NO: 72226 - DNA, 1039 bp, Homo sapiens
acacacgcacacacactcacactctccataagccacagaaaagacagctgggtgaacgaaaagtgtctgcaggatttgttgctagagtgagagcaatgtatgtagcggggctgtctgtgtcgccgataggatggggttggggtgtgtgtgtttgacagacagagaatctaagccaaaccaatccagcctggaaggatgttttatttgatctgcacaatgctggagggaaaaaatgaattatttgccaatattttaagattgagggattttacacaagattacaaagttcttttgaaaaatgaggagatccgacgccctgagtttatattcctccttgacaacagtggccagaactgtgtggtttctgataccaatgcagccccagtaggagactgagcttgtagtccctgacacagctcttgcaaatggagcgctggctggttctgtgagtcctgcaacctccatctatctccctgtcagctttcccttaattaatttcatcaggagcccaagaactgtgtctttcattccaaatggattggagctggctacaagctgaagtcgggggggtctgcaggcagttgggctctctcgaccttcagtttttaattaaggagctggaggcccacccagagcatggtggggggagcccctgggaggtggcttcttcctgcagatttcatcctggccttactctagtttttgagcaatattattttttggaaactgaggtggggtgggggggcatcaaatccacaccttaccttaaggtgttgttgactgcgagacttgtgctaggaactctgaagggagggacagataacctctgtcctcaaggagcccacaaggtagccaggagggcagagtgacaagcattggagagtttacacatcactgaagcagacaagaaactctgattgcaaactcagaggtgaagagaatgtaactcgttttatttttctttattgcaacttagtttcttttgtgagctcctgttcctctagggacaaaacttaatcttagttccaggccccccctt

SEQ ID NO: 72227 - DNA, 1031 bp, Homo sapiens
tttgtagtcgagtgtgggtgtaccatacagcaaggcatggatgaggatgagtgaaatggagtgaggggggccaggcctgattctgtattatattttcatgaaatgtcagatttgtgccactcgcagccaaagtcccccaccgcaccgatgcaggattggaggccatggtgagccgctcctcctcttaggaagccacagcaaatgtatcatcctgataagatggaaaaaatgtgcctggaaaatgaaaccagactgacccaggctaaaagaaaaaaaaagacccagcaaaatctttggagaaaaaggaaagatgatgaattctgacaagtaataatgtgatcagcttaactgttatgaaacacttagagtgcatcttaacgcaaagcggtcaagataaagtaaaggacttgaaatctcaaattaatcactcgtagtgtttcatgttggcaaaacattttgctgcaagttgatcatcctttcggtggccttgtcagaaaagtctgggaacagtcatgtgtgcatctttcagctttacagctgagaggtccggggcagaaccacgctttatagcctccagaggcaaagcaggagtgatgatgagacctctgagctcatgtgggtgttggttgtgatgggaccctgagctcagatggggtgttggttgggttggttgtgatgggaccctgagctcaggtgaggtgttggttgggttggttgtgatgggaccctgagctcaggtggggtgttggttgggttggttgtgatgggaccctgagctcaggtggggtgttggttgggttggttgttatgggactctgagctcaggtgaggtgttgattgtgttggttgtgatgggactctgagctcaggtggggtgttggttgtgttggttgtggtgggattctgagctcaggtggggtgttggttgtgttggttgtgatgggaccctgagctcaggtgaggtgttggttgtgttggttgtgatgggattctgagctcaggtggggtgttggttgggttggttgtgatgg

SEQ ID NO: 72228 - DNA, 1031 bp, Homo sapiens
gcgcctggaggacgatggggactcaggctggacctgtgccctccctgagccagaccctgtagagggggattcactcatatgaccgtgtgactgttcagttagcacccccaaaccacagggctgaaagctggggaggctgtccctcgcagggaattcaggggctttgtgaaaagcagggcgtgggtaccaggcagctgacattctgtactgttacttcagccaccgcgtatctgttctgatgtgaaagcaaaagtggcaaatatgtcagcagcgaatctatgagagaattagtctgtaatgaattccaaacaccataaattaacctgacaagaggctgcagcctccttgggctgttcagctcctggaaaccttcaagggttgtgccccgtgcgagaagagatgctcgtggggtcagagatcacgtcctttcctcttccattgctgagaccaggatggtctcctggacctctcatggcctggctggggagggacctgtcccttcctcaccccagccctcagctccccaggccctcacctcagcgttcagggtcagccagtctgttgccagcttgtctccagcaaaagctcacaatcccctgtctgagccccatgaggccactacttccactgtcaccagaacacccctgtgcacctgccccgcacctgtgcaccgccttccatctctaccccactgcgccccatcctcccatcagtgcccacccaggaagcagcttctgtccactgcctttgcttctccatggaaatgtcctccaagcgacaggctggcactgtgtctgcagctcttgtgaaggctcgaggtagcgtgccccgggagagcatgcccaggtctttgcagggcacagctgaaggcattgcccatccttcccacctgcgtctgcacctggcagcccagggatgcgtcccttccggggaggtgcaggcaggcatctctggggacagaccgctctgggtccctctccattgtgcaacccagcacatttcccaatgccttcagctcctctcctttgggc

SEQ ID NO: 72229 - DNA, 1030 bp, Homo sapiens
atggtggccgggcagaagggctgcatgatcacaaagcccagtgaccccttgatcgcaacgcccagtgaccccttgcaaggcctgaggtggatcccggtggcaggaaggcagtgcagccatggaagcccgcccgcccacccgcctgcctgcccaccacgcatttgtttatttgcttctctctcacactcaccccgggacattcattgctgagtgtgaggagcccagcagaggccactccacacccagcttccctggcctgcgatacaacctggctctgccccacagagcagcgatgcacagctcagctgtggagccagcagctccgactcatatttccaaatcccaacctccctcgcacatctggttccggagttgcaccggcacagactcctctggttacggctgttgcagcctctgaaattgctctcacgatcccttccccgctttcaaggtgagagccgccttcaagcacaaaaccaaggtctggtcgctcacgagcagctctgcccgcacctccaacgcgaagcccttccactcggacctcgtgagtgcagcctccataaaccgagggtcccagcccatcctccttccccaggctcggttgtcagcaggatggggtgtgcaggcagcagaggtggcttcgggtgcccagcagtctttgtccccctctcatgcctgcaggctgcacgtgctctgggcttgtgtcccccacacagtgccctgtgtcctgatgaagtcaccacagccctaccccttgaccccgaagagtcagggcttcttgtgttcacttagggatggaaggacttagagatcaactgaccgtgaggtggcccatccccgccgccctccagagcccaggcaggcccccaggcagtctggagcaggccctgttagggttctcactgtgccgctgcttcccccctgctggagccctgctcaggtgtcccatcctcaggaagtccttccccgcacacggtgctcaatgaaggcgctcccacccattctcgcactccgcccccgcccgcagctg

SEQ ID NO: 72230 - DNA, 1050 bp, Homo sapiens
tgctcactgcaaggcagattgagaaatggagtcagctctggtcccaggagggaaaatggacttggggaatagccagccacgtctgcccaactgtcttctcatcagggtgcttcacaaacctccctgaggtcacctgttggtttccaggtctctgtgcctctgtgccacgtgttcctatgtcttcaacaggaaataggaaaattcagaaaactgctcagagatctcaggtgccaagaaccccaggcctatgtactttgtcctctgcatgagttcagtgtggactttcctagctgagaatctcattgctgagatttgccgtttgggagccacatgggtgcatttgagggcatggactgaattcttcatgtttttcctgatagttgagtctcaggctggcacccaccagtgtgggtaacactttgtggtacaggaagttcaggacttgaatctgctactgggaaatgcagtctcctccgcgtgggtgaggtttctgcacagactcgggcatgtgggtggaaggatgttaagtgcccagagctctccagagacggaagcagcagaagtcatcattcgcagcacaggttttaaaattgcatttcttcctcccagtgcccttgctcaggatgagcgctgggtggagacgtctccttggtggagtgagaacctcccggaggcctgctttctctgctctctgacagagcgcagctgggcccggtcgttgaagggtgattttctgcccagcactgacagcccctctggagggaggactgagctgagaccctccaaagtcatggtgccgtgggtgacaagggaaggcaggctccggaggtgctgcacaagctcgaggccaggcgtcttctgcgcatttgttgaagttacagagccctcgtcatgatcccggggtggaaagtgatgctcctccactctccatttgtggttgttgtgcagtgacttggtaacaggcgctgctggtggggagtggagggcactgagattgaggcagatggagatgggagcagggtctgcccggttcatttccagcacacatta

SEQ ID NO: 72231 - DNA, 1056 bp, Homo sapiens
aaaaaaaaaaaaaagtaggagagaaggatattcctggactgactgatactatggcgcctcgctgcctggggcccagaagagctagcagaatccgcagacttttctatgtctctaaagaagatgatgtctggaaatatgttgaaagcccttaaacaaagaatgtaagaaactgaggaccaaagcacccaagactcagtgtcttgttactccacgtgtcctgcaacacaaatgctggcatcttgctctgaagaaaacagtgcactacgaaaaataaagcagaggctgcagagtaggctacacgctggccatgagaatgaaagaggccaaagaaaaacatcaggaacagactgccaggaaatgcagaccctccagcggtgagcttctacttctaagtctgcatccagacaaaagtaagattttttgagtagcaaataagatcagacccttccaaaagaaaatacttgtagaagatgcagaaaagaaaatgagaaagaaatcaaagcagctcaatacaaaaaacaaaaaacaaaaacaaagaaacacaaagaaaggcagcaagagaggaaaagaggaacaaataattataagacaaacacaaaacaacaaaatagcaacagtaagtccgtcccatcagtcattaacttaaacataaatgggtgaaactccccaatcaaaagacatggagtgactgaatggataataagatgcagctatatgctatctacaagacactttatatttttttatttgtacaaattcatagggcacatgtgaaatgttgttatacatatataatgcatagtgatcaagtcagggtatagggtgttcaccacccaagtacaatatacttttgttaactatgttcaccctactctgctatcaaatattgaatttattttttctatcttactgttttttgtacccttcaaccaacttttcttcatccttcccctatccccactcacccttcccagtctctgttttccgtctttccactctctacctccatatcactttagatataaggacatacacaggttcaaaatgagaggatgg

SEQ ID NO: 72232 - DNA, 3812 bp, Homo sapiens
cctcccctgtccccacctcctcctggtgttctggtggggagggggacggtgaaacctgccctaaggcactggctggaattgcgtgccgcgtccgtctccggagggatcgtctctggtcccgcagcccctctcgacccctcaccctgtcgctgggctgcagttggcgattccgcgcggtgaaagcagccagtgcccagggtcttttcctgagtgcacctgggcctgccgcccggcgatgccatggggtcgtgcgctgcttttctacttgccgcgctctcactgctcggtgtactgggagggtaccctgggaggcgtgcctttattcttccgaaccgccgctcactgagacagtggctagaagtgtctcttggacctgtgagttagccttaacctgttatgcccccagagccctcagtggagcgcccgtactttgccggcatgacgtttgatttcccggtgataatccgacgagtttgacagattgaggtagtgagcaaagttgcccgtcagttggtggccacttgacttcgtgcggaccctggccttgctcttggaagagatagtgttcttagggctggtttcactgtctcttaagactgaagggtggagctgggatatagatgtgttgtttcttttcaaatcaaacctgctttaggtcgtcactcgagggtgtctagcgattatgggcagtgggggcctgggattagggatttctaaaggcgtttgatttgaaaaggataacattacatgatgtaggtggtttgctcccctctttcttcccattttttcaatcccccttcccctcgtctctgggttttggggttgttgtggggtggttttttttcttttttgcctgttcggctacttctggggcccggactgaaaagctaaccatgaccaaccattaaactgtggaatagtctctccacgtgaagaaagcccatcgtttgagaccattaaaactggattcttcatagccctggagcatgactgtagggatgacctctgagctggccagaatggacacattaatgaccaaataggcctttttccatccctgacgtttccttttggaattagagctcgaaaacgagaactggtgaagggagggccgcggaatcagatcatgtctggatctgatggctccgtgctgtgctcaagcgtgctgtgccttcacaccatggtttatattgaatgtgtcgcctgagttgtcaggcttgcttttccaaagtgtcacttgtgttatttatcattaaagtttggtaagcaatgaagtctgagctctttgtacagttttcctatcattctgtacatgatttgagttaggtcttccaaaactggtggggagcaaacgccgcacatgtacatgtataatatttttaataataatctacatttgtaagttaaggaggtttacatcaaaatccaattaattttgaaatttaatgaaatgcagtaacttgactaccttggaattttgggcctttttcctgtaaatgtcttttttggtctacattaatatttttggttcccattacaaaagtcagcattaaaaaaataagcagacttttgtttgtttctctacatttgtttttgaaaccctaaacctgagtgttttaagtaaagttcactaactcattcatttattatctgacagttacacgttgacagcatcctcattgaatcctttatgttaaaagcatagcagaaagtgctcccattacttatttggccaaactactgtttggtccatgcaagagaaacatggaagtgtcttcatgtatgttatttccttgagggtataaagttcagaaggaaatattgataccatatcttctaatagttttgctctgttcccagtgaacctccttaaactgcatgtatatgtcactgttccaatgtatgtgtgtctctctatcacgtaacccagcacttatttcctcagccaagtggctagggggcgagcctagccaagattttacctccaatggacgcaagtttctttggtgaagatctctcctgagagttcgggactagcagaaagaagcgaggaaatttcgaccgtttggttcttacggataggtatttatgtatttggtttgtgtgaatgtaagctatgatatttaacttttcagaaaaaaataataattttttgcaagtggcattgaatggttgaccaaaccataatggtaagaactgccagtgaagtgggtaccatttttgctattaatggattgtttgcctttagttataaatgttatcttactgtggaaaggaatttagagtttgttaagataacttgagtttaaaagtaggtgagatatgactatccaaattaaatataaatctgggaagagtttttatacttgttttaatatttttgtttattttaatcggtaagtatgtgtgtgtatatatatatacatatataaaacatcacacacgcacaccagtctagacgttaatttccttttattgaccagcttgttcacattacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaaggtactgctcaagacaaacttacttcagcaacaaactttttaaaatttttaagtatttaaaaatttactcccattcatttttttatactcactctttctgatattatcttgacagtacccagtggattggaaaaacaggagtctttgcgttctgagaggacctcaggatagtttatatatagagccacaaagaattttcccagcttttgagggcagactgggatttgaaaaaaacaaaaaccaaactctttaactgttcttctttaacagtatcgtataaataaaattgatgttcttgtctttgccgtaacagtctttaatacagttcttaatcccaaaattttctcagcaggaagaaattttccacaaaagacgtgtattcagctgtctgtgggtaaacatgtactgacaaaagtacataatgatagatataaagtgtgaatttttaaaactattttacctcaaaagtaggttgaaaaaagtatgttgtatgctttactgatagctacaactttagaaatatataaagtttttctcagtaattttctatttttgttgataaaattctcatttttattcaagaggaagaatacaagcgattgagtgaagcactagcagaggatgggagctacaatgccgtggggttcacttacggtagcgactattacgacccgtcagagccgacggaggaggaggagccttccaaacagagaggtgagtggggagctgcctggactgctggtgtagggctacacgtgtacgcacaggctgcatgcaccgtggtccagtctgcagaacacatctctggcactcatgatagcaccactatgaccacaggagaaaacgggagtgatattccttcttttggtaaaacgaagttaaaaactagaatgattaatggaggtggaaagtgaatgcgttggattatttatttctcattgattcgggtaacagaattactcattcaggattatttgtttctagattggtaacatgttcattaatatcctcagggattcattcttgaggcagtgaaagaataggtgttaactgggataagttaacatcaccgccctctcactgacctgcttccccatatccctccacaactgagacagtgacacatgcccagtggaaggacaca

SEQ ID NO: 72233 - DNA, 1125 bp, Homo sapiens
tatatagaaaaatgttgacttggtgcacaaagaagtcacctcccatgggtctgtaccatggtggagtggcctgcctcagctggcgagctttctcccctgcaaaatcctgtcaagatttggagatgaggagtccgaacagcctgggctcttccagcttaaagtctcgtatctcttaaaattgacagtaaaaccagagtcatttctatgttttaatgaaatcacgtggccggtggacaagaggacaaatgggtgacgtgaatatgtgtgttttcccgtagccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaagtaggtcccactgcgtctgttccgtccagactttgggcctgtgttgtgggggcggcaggctgggtggttctgggaaaagtgtgaagatacacattcttacagatgcatggttgaaagccagactcgaatttctagaatgtgtctgaaatcctgcagctaaggcgtgatcgttacccctgctggtgcacctttattaaatctttggttaatattttatagataaatgaaatataactaaatattgatgctgtcagaacataatcatctgggtgggaaatttttgccctcattttgcccacttaacatttcatagagaaaacagttatatatcctctcttggattattcaagtaccacagtgttcagggctgtatagctcaattatacatggccacaaaagtgaaaattttacttggattatctattttaagctattatttttataacagtgtctctattttggagttcttactgccaaagccagttagctgtattttgaataaagatggtattttgacaagtctattcatatatatgtatatatatacacacacacacacatcttccattgaatttttttttttttaattggcgacagagtctcgctcttgtcgcccaggct

SEQ ID NO: 72234 - DNA, 1855 bp, Homo sapiens
tcataggcatacagaacactgtgcaggtctaagacttaggagaagacggagatttctaggctgttggaatgttattttgtatatgcgagtttgggtagcttaataatagagattaaataaaagaaatgcagacaaaacctacaatggagtgccatttttcagctgtcactcaagcagagaaaaggtgacagacgtttattgtcggtgggggtgtagatttgtgccagcgatgtggtacttgtggagggccagcgggcagtctatcagtctaaaacacacgtgcctccaacccaggatgtctgctctcatttactagtatatgggtgaacatagccacatagatactcatcatagtacagttttagtagtagcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgtatcggcacctaaaagggcaggtaagaaggaccagtggccagcacagagaggggaactggaaggacgaggtcgcagacaggagtggctgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccgtaacatctttcccccgtagagacttgcatacccagtactgctgtgtctcgtgggaggctgctgggtcactaagcttttctggctttcatacgctgggtatttaataatcaccttaggatatactcagtcgttctttcttatttacttcctactgatggagattttcctacattttggcagcctgggaagaaaagcatctatttttttccttaaagtccagcagaattttatatatatataaaatatgtgtataaaataatttttctagaagctcattaaatatagatgtgtaaaactaacaatttatttcatttattaattttcctgacaatgaactacttttcatgctctttatttttcattacttgtcttctgctatttagctataaatccttatagaagagtataaataaataaaagtaattatgcaggaggcagtcatagtgaaatgctgcccactgtgatagcctgtgggttttttttaataaaatgccaactcagtttttcttaatattctataaatatctgaagtgaaattaaaccattgcgcatggctactatagatattttcttgcttctatccctgttttttaaatgtgcctttgctgtttatggtatatttttcctgcacatcatgactttgaagttctttacttactttccaaacccatttttaaaaatggttttattgtatgtcaagagaagaaggaagaaagcaaaaatgttacccaggattccaccatccagaaatagccattagtgaacatcattagcaaagtggaaaacactgaggtcatcgtgctaaataaaaaggaaagaaagaagcttgttatctgtggaacacaaagatcatctttatgcacgaatatcaattaaaatgttggatgtgtctctagaaatacttacgttaaagtggaaataaacttaattttacttaaacagaagagcctgcaatctaaaaatg

SEQ ID NO: 72235 - DNA, 1053 bp, Homo sapiens
gttatatagacaccctgacatttttgtaaagccagttttggtgaggagatgacatgggccttacttctcaggagatttcttcagacccttatctccaatagcccacactgaaagaaactgactcctctgtaggtgatggggataatttggtatttttaaagaattctgagtaatcagtgtccaaagaaaagatactgaaaattggttcccaaggcagtattagggcttcaaagagtatagtgttttttcagacaggagaaaatcttccattcctctttgatacattccattgtaagaaaaaacagcagatctggatttggaagtctgttcccagtgctgcttgggcagtaatgtacaattgccgttgtccagtgaaacatataccgtatacatctctctttttttaaaatttctgtataatttcctgctgacagtttatagtgacatttaatctctaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaaggtatgctgccacttgcatgttggccttgcacattccaccataagttggcaagcgtaggatcctcggtgacctcagactcagcgccctcacctgcaggctggggtggggttggcggccccctggaggttgctgtggtgaaacctctgccttccatgctgtgtcatgcttgcctcgcgtggcattggaggtaacgtgagtgtgagcagcccttaggtatgtgtctgtttaacagtctgttcagtgtactggacatttgtacagaaagtttcaaataatcctttgtactccctgggacttctgaaactatttatatgcaaactgttgtaccagtgaaattcatttattaatttgtcaaagcagattccttgagaatctctaccaggcaatacttcactcactcgatttcagttactttgttatgtt

SEQ ID NO: 72236 - DNA, 1023 bp, Homo sapiens
agggtctgggctatcacatgcttaactgtctacttcacatcacacgcgggtttggagccataaaatgctaaagcggaaggacctccgccaggggccagccaggtagcccaccctgtgctacagaggtggcatcacaaacataagttgcagcccttccagaagcggccttgtttacccagaacccacttccctctcagtcacctggtttgcggtgcacttagcatccccttcattgtgggtgccttgaatattcttcataaataacaactgatggttttttaaaatactgtatcttattgcaaccagttagctcttgtcaagagccatttatcacagcatctgaaagagaaagggactctgtgttcattgagtggtggggcgggaaagatgattttttctttagggcctccatatttcccttaaatttaagccttctggatattctaagaggagggattgcttctaaacttctgtcacgctgggtttgacattttcttacaggtgtggaaaatggtctaacataatgcctgtcacaaagtaggtaaaaatgtttgctgaataaaggcatggattctgtaatttttgctttgtaagaaaaggctattttttatcatggggaattttttaaagagacctgtttatagtggagtcacatcatatgcctcctgaagcaaatttagatatatgctgagccatgaatttttttttttttttttaaagaaaaatgaggccgggcacagtggctcacgtctataatcccagcactttgggaggccgaggcaggcggatcacgaggtcaggagatcaagaccatcctggctaacatggtgaaaccccatctctactaaaaatagaaaaatttagccaggcatggcagcgggcgcctgtactcccagctactcaggaggctgaggcaggagaatcgcttgaacctaggaggcagaggttgcagtgagccgagatcgtgccactgcactccagcctgggcgacagagcgagactccatctcaaaaagaaaagaaa

SEQ ID NO: 72237 - DNA, 1121 bp, Homo sapiens
taaattgcttttcctgtatacacacattcagatcaagcaacatttgaaagaggccaattttcaggccaggcgcggtagctcatgcctgtaatcccagcactttgggaggctaaggtgggtggatcacctgaggtcagaagttagaaaccagcctggccaacatggtgagaccccatctctactgaaaaaacaaaattagccgggcgtggtggcacacgcctgtaatcccagctacttgggaggctgaggcaggagaatcgcttgaacccgggaggcagaggttgcagtgagctgagatcacgccattgcactacagcctgggcaacaagagcaaaaactccgtctcaaagaaaaaaaaaaaaagccatttttcaaccacaatccaccatcaagaacttccattgtgctgtggtgttctccctaagcaaacttgtactcatgcctgtacatctgaatctgtccttcctgtgtgtaaactaaccaactgtcggatcatttggaataaaacacttatagagtattcattgcctggtgtgaatattttggatatatgctgagagccactctgaggttttcattattccagctttcgttagtgtagagtctcaccaaccttctaactctgaaagtaaaatgtccaaaaaagggcacgttataaactaattctctcaaaatttgatttgtccaatgtatgtacctattcagaaactttaactaactgcattgtatgacacttttgcaacctgtgaaaattaagatcagataaaatactgtttgctctaaacttctcttttttctttgtttattccttaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggtatagtaaaatcccacattggtatctgcggggctgtgtgatacatagaggcagggaggatgtgtctccctccagctgccctagtctctggcctgagtgagggatatgagctccca

SEQ ID NO: 72238 - DNA, 1210 bp, Homo sapiens
cagatgcttgggaggcagaggcaggaggattccttgagcccaggagatcgaatctagcctgatcaacatattctctatgacaaaagaacaagaagaagaagaagctggtggtttctcaccataaccttttcttgtggaattctgcctcagctcttctgggaacagtgagtgcgtgttttatttagtaggattgcatttttctaaactggctgcaaacctgcctcctccatccaagctctgccagcaataatcatttccagggatccaagtggctttaaaatgcaagttagaaatgggaggggtggtgatctcctcagtaatatgaattattggagtataaaagataactaaattttaaccaaaatattgaaagtgttaatgctgttgttatcagatagaataaactgttacaaacgcagcctccactcagaatggatcggacttgtcacttgggcctgaacagacctaattgatcatttttcatgactgctgccagcccacagtagaataccgcagttgttaatatttctaattgggtaggatgctacatggaatgtattttgttttatatattaaattactaaaattctatataaaatacagaaagttaagattagaaagccttcttacagcacaacgaatatttatttaatggctatactgttcctgtggttgaagtcccatgtatttagtatgtctaagttatgggcgactctggatctccaaaggcaaattagtcatggaagaatctttagttttggaaaatcactatgttgcttctcaaaaagtatactagttacgacaaggtagtatttagtgtcttttacatcaacattgaggctggcacggtggctcacgcctataatcccggctcttaaggaggctgatgcaggtggatcacctgaggtcaggagtttaaggccagcctggccaacatggtaaaaccccatctctactaaaaatacaaaaatcagccaggcgtgttggtgtgcgcctataatcccagctactcgggaggctgaggcaggagaattgcttgaacccgggaggtggagattgcagtgagccaagatcgtgtcactgctctccagcctgggcaatagagcaagactccgtctaaaaaaaaaaaaaaaaaaagattaaagtaaaatacttttattgtctgttttcatttgtattttgatattgtatctggttctctatgttaatg

SEQ ID NO: 72239 - DNA, 1543 bp, Homo sapiens
agcgatgactcatctcctaatcctgccccttaaagggggaaaccagatgcttgcagttccccaagtggtagtgttgatcatgccaaggtgaggaccgtcgttccatcccttgcaaagtgaatcaaagtgaattgtagccaaacacagataagaccagagggtgtctgcactgagcagtccaggaaggaggggagctgcagtggctgtcaccgggctgggacacgaggaggaattgcaggtgaaatcagatccagtttcaacttgaggaaaattcagccccgggagctgctggtagagcccagaccttgatgctgagtcatctgcacagagaattccgtgacagaaaggccgtgggtagagacgtgaatggaggaagtggagtagatgaaatggttaaatgttggagaaaagaggctatttatgaatatgaccactgtcattcagataaaatttctggactgttatcattgaaaaaagtctcattatgtttctatttgaaagcaaaccattatgcttttttgaggaaaaaaaaaaactgtgagtcacgttatgcttgcaagtgtttaattcagaccatttcatctttaagaaggcccctggtcacattatacggatgatttgcttattaaatggaactcctgtttcttgcaccatgttgtggggtcaatatgagaagcctaattaacagaataaaaagcattaaagcttctttagctaaagtcaaacttagagaattgtctaatggtatgtagcccctcgttctaagatgggcgttttccccagataacttgaaaatctactggtaacagccacttccctttaaagaattctattactaatagccatgacaaaatggtattgtatttcaaagttaagaatttgcaggccttaaaaactaacttatttttcctgattattgagtttattgtagaattctacgtgtaagcattccccagccgctatagctttgaataagcagagcttttttcagagttctggtagcgcccagcccagcaccttttattctgaatgtgaagtgtgtgcctccgtgtcacagagtcacagcctccccagggacgctgcgcgcggagccctgtcagagcagcgcgtcagtgacagcggcagccgagccaggaagttatcaggcagcctcgaccaccaccagatttgactccgcgagctcttttgagggaaaacctggtaaaacgtcaaggtgtctaactgacctcgcctttatcatctgttctgtaaatcttaggaaaggtctgggaaaaaatcaaaacgattctgtccgttaaagggcagccactcctggccctccaggatgccggggtctgagtgatcccgagctgatctgcagaagcacagcctgtggcatttgcggtttattgtcatgaaaatgattcaacgtagaactttttcaaatggcaaaatcaaaccgctcttctttatattgtttttgaatgagttgtcatggaaacaaaatggaaataaatggtgttttttttccagatttgtgctcattgcaggtcttcccaaaata

SEQ ID NO: 72240 - DNA, 1045 bp, Homo sapiens
gaggtcaggagtttgagaccagtctggccaacatagtgaaactctgtctctactataagtacaaaaaattaaccgggtgtggtagtgtgcgtctgtaatcccagctacctgggaggctgaggcaggagaataacttgaactcgggaggcggaggttgcagtgagccaagattgcgttccagcccgcgacagtgcaagactccgtctcaaaaaacaaaaagaaagaaagaagggatactcttttttaaaaaatagatgaaggaacacttcccatctcatctcttgagtccatcataactctcatacctaagccagataaggattctgtgtttgggggagggggtgtgcacatgcacccttgtctgttcacagatcagtactgtgtgcacccgtgtgtgttcacggatcagtactgtgtgcacacgtgtgtgttcactggtcattactgtgtgtgcacccgtgtgtgtgcacagaccagtacagtgtgtgcactcgtgtgtgttcacggatcagtactgtgtgtgtgcacgtgtgtgttcacggatcattactgtgtgtgcgcccatgtgtgttcacggatcagtactgtgtgtgtgcacgtgtgtgttcacggatcgttactgtgtgtgcacccgtgtgtgttcacagatcattactgtgtgtgcgcccgtgtgtgttcacggatcattactgtgtgtgcgcccgtgtgtgttcacagaccagtactgtgtgtgcatatgtgtgtattcacagatcagtactgtgtgtgcacccgtgtgtgttcacagaccagtactgtgtgtgcatatgtgtgtgttcacagatcagtactgtgtgtgcgcccgtgtgtgttcacagatcagtactggtgtgcatgtgtgtgctcacagaccagtactgtgtgtgcatatgtgtgtgttcacagatcagtactgtgtgtgcacccgtgtgtgttcacagaccagtactgtgtgtgcatacgtgtgtgttcacagatcagtactgtgtgtgcgcccgtgtgtgttcacagatcagtactggtgtgc

SEQ ID NO: 72241 - DNA, 1059 bp, Homo sapiens
gaggcatatggaggggccacttgggtggcacccgcagcccctgtggttggcaggacttggccagggggtctggatgggaagccgatttggccaccgtttgccccaggccccgaagccatctgggagggtgctggccactgtccctgctgcccgcgtccaggtgcctgcaggtccccacagtggcttccttccagccaggcagcctgtgaacttggggtgcccccctccacctcctcaagacccttttgtaggtgcggatctcccggatcccccactgagaatcacgccctgggggcctggggtctccagctgtggagggaggtgaacccaggcccgccttccaggtccgagggtgccgcagaaggggccggggcaatgccagggaaggactcaaggtggggcccacacactcaggaggatggacccccggccgagccatgttggctgatcagacccagtgcggtttggaagtttctcgccacccacctgcccccctgcccggagagagtgggtcaggcgccctcctctcggctggtacctgcgcctcggtctctcctggcaccccgggggtcacccgccccgcgccctgcgacagcaccgagcggaggatgtggctccccagcctggccgggggcagtgagtggggccccggtgtccagccggagagggaggacgctgcgggcagccccctgcctggagccccgctccgtgtcgggcccggcctggcgtggagcctccgtcctgccgcggcttcctgctcacactggcggtgcggggcgtcctctgctggccctcggggaaccgcgggccgagctcaggcccaggggcgggcggcttccccgcggggagggacgaggaggccgggatctgggcgggagcggggactcctcctccgcccgctcgccggaggcgctcccggagtggactgatattcaggtctgggcgccagggacgagaagtgctcctttgtctcagagctgcagacagagctgcacccagcagggctggagccggggctggaggggagggcccgccccggagcgccccccgtatgcacgt

SEQ ID NO: 72242 - DNA, 1055 bp, Homo sapiens
tggcgctctgtatgctcagagcgtagatctcggcccccgcccgctgaagcggtggacaggcacccccgttttaatttgcctttagcagacctctaggcaaggataggggctccacacaaggatgcctgtcccatgccgctcaggtcaggggctctgccgcaggatgccctgtcccgcgctgcccaggccccgcctcccagcccacctggctctctccctgcaggcccaggaaggacgtgccccacagatgcagcactcactttgacgcggtggcccagatccggggtgaagctttcttcttcaaaggtacctccagggttcccgtggcggttggctgagggccatggcccactctgggtgcagaccgtctctgcagcccggccctcccctctgtgcccccaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggtgggtgggcctccccgtcgcactccgggcttcccgggccctctgtccgcctcatggagggacggagagggtccagcctgcgtgtaagccctacgtctgcccagaggctggtcgagcacagagcagctggtttgcttgtgcactcagcagatgcactctgagcacctactgtatgccccgtcctgaggcagccgctgtaggcacacagagggcaaaacgatggaaagccctgccctcgttctagtcaggccacagtccacccgcaagtcaggaggagctgatgccagtgccgttcggtgtggtcagaaatgaaggacaatggggagaggtctccttagggagatgctgtacaagcagaaactagggaacagtgttccagcccggggaacggccgtgcgaggcaggagcagccctgccgagtcccaaaaacatcaaaggggctgcagctggagtaccaggggcctggaggaggctcgggacagaagcgtgaggggccgtgg

SEQ ID NO: 72243 - DNA, 1026 bp, Homo sapiens
ggtgaaaccccgtctctactaaaaatacaaaaattagctgggtgtggtggtgggcgcctgtaatcccagctacgcgggaggctgaggcatgagaatcgcttgaacccaggggcggaggttgcagtgaaccgagatcaagtcactgcactccagcctgggtgacacagcaagactccgtctcaaaaaataatgatcataataataataggatggcatgtcgtgggcctcggtttggcccgagttgttgtttccatcggtaaaggggtggccggcagcgtccacaggctggatgggatggcccggactgggcacagtaggtgctcactaagtatccatgtggcccctgtgatgtggggtgattgcagtgtggccgctgtcccatcaagcccaggtgaggggccagggcaagggcggctgacacaggagaaggaaaggcaggagcctcctgcccttcggggtggggccgagccccggcccacagctgtttctctcgcccccaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgagtgccagctggggggacgggccatgcggccttggtttccccaccaggagaggggcatcactacagggcagccaagaggttccctgaaaggaggacggccccggtcggtgtgggctctgagggtcccagcccctcgcctggagctgccgaccctgcaggcgtccccgagtcgctccccgaaggcctggcccacgagctgcccttgttctccccgccctcagcactccctcgcccctgctgctcccccagccacgctcctgcccca

SEQ ID NO: 72244 - DNA, 1150 bp, Homo sapiens
ccccgcctgtcccgggacccccccacgcctcccgagagccccactcgactttccaggccgacccccaccccaggatccccaccccgcgacccccagcccgactttccagttcagactcccgccccgagatccgctgccgggctttccagcccagatcctcactccgagacccccagcccgactttcctgtccaaaccctcaccccgggacaccccgcaacctggtcccacagccggctttcgaggctggatccctaccccaggacccccagcgcgatcctcaacctggctccccactcggccttccagtcccgggattcccaaccgggatcatctcagggccccacctgtgtggactggggtctgggggaggcctgcgaggggcagccctggccttgaaggtgcacgtttggctttcagaagcacgatttggaggtcgccgtcaagtgcattaacaagaagaacctcgccaagtctcagacgctgctggggaaggaaatcaaaatcctgaaggtgagccagtgctgggggagggggcgtgggcgtgggcgtgggcaagcccccctccccacactgataacaaacttgggtttctgtcctaggaactgaaacatgaaaacatcgtggccctgtacgacttccaggtaaggcctctgggctgcggtctgctggggaccgggctgggggactgtggccccaggtgctggatcccctggtgagcactggtgttgagcctgtccaggctggggtctactgggcccctggagactccaccctgggtccaggcctgggctggtgctggctcttgctgtgacttccccagctgtgagaccggggagggggtgtctgggccgcagggcgccccagggcagggctgagttctcctgaacaggcatcccctccccgccgggcgtcagtcctaggggccctgcctgagtccggcgtccccggctggccctggcagcactgccggcctggcccacctgtctaggccgtgtgtttgttgacattgctcctgcggccggcattggccggcctcgctctgcgtcagacggggcgggggaggggccgccggagactcctgctcgctggcagtcagggccgggccggggcacaggcggctgccgctggctggccaaggagatgacctc

SEQ ID NO: 72245 - DNA, 1002 bp, Homo sapiens
gggaccagctggctttcgtgctgcctccgtgtcccggggcccagggcaggcagggctggggctgtgggagccagggtgccgtcctggggaccaggaacctgaggcgggagatccgccccgccaaagtgctgactaatggctctgtgacctgtttactgagcccagggcccagcccctggctgagggaagggctggcaggccgtgttttggtggcctcctccgtccgcctctcagagctttgctgtggccttggggaccgaggcttgtcacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcatggctctgggagccagcaaggagtggacagctgtccctggccaggcagcgactctgagggactccccctccaccctgggctacactgcctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggcaactctgcggctttctctactcaggaagcacttggagccgccagctgcaggcgctcctgtctccgggcaccgggctctgctggagctgcagcttagcctgccctcgcccccacaggcgtggggattgttgccctgtgtcggtaaggcaatgtttgaggcaggcacccaaacccaggaaaaaataactgggttttaaaaatggacaatgaacgatttgggtgataaaagaaaatcctcaaacattacgggagggagtgcggtcga

SEQ ID NO: 72246 - DNA, 1271 bp, Homo sapiens
cttggggaaggttctgtgctggctcaatccatatcagaaagtttacccctcggccaggcacagtggatcacacctgtgaccctagcactgtgggaggccaagacagaccagcctgggcaacatagcaagactcgctctctctaaaaaaaagaaaaaaaaagaaaaaaaattagccaggcatagtggcatgtctcagctactataaaggttgtaggaggattgattaaacccaggagtttaaggctgcagtgagccgtgatgttgccaccgcgttccagcctgggcagcagagtgtaaccctgtctcaaaaacacaaaacaaaaccctcaaaaagtttacccctctctgttagaggtcaccatctgtaagcacagtggtcgagagccaggctgacgctgatgaggggcccagtcctggctgccatatgtgcacacacagcttctttagtttgcggtcctatttcttcctctgtgaagcagaaagcacgggctgtgagggctgtgtgagggaggagggagtgctctcgggttggaggagccatcgtggaggtgctagctgctggcctgattgggtctgccgtggtgattttcagccatggcgtgcctgttgcccgagattccataactgatttcaccaaggccctgtaggtgggacatgaggttattttgggatgctggtacatcagggtggttgtgactggatccttagaagtagaatccttgggtaggagggatgctggtttttaatttgggtagctattgccaaatggacctccggagaggcaatgccactggtctctcagcctgtctccaagcatgtgtctccctaggtccttgccaggagggtggctctcagaggtttccatcgtggctcatgtgagaagtagaaaatgacatctcttatggttttgcttttcttttttttttgagactgagttttgctcttgtcgcccaggctggagtgcagtgacacaatctcccctcactgcaacctccgcctcctgggtccaagcgatcctcctgcctcagcctcccgagtagctgggattacaggcgcctgccaccacgctaggctaatttttgtatttgcagtagagacacggtttcaccatgttggccagcctggtctcgaactgacctcatgatccacccacctcggcctcccaaagtggtgggattgcaggagtgaaccaccatgcctgggcggttttcttttacattggtgatgaatgagcttccctatccgagcatgggaatgttagaaataccacc

SEQ ID NO: 72247 - DNA, 1208 bp, Homo sapiens
gtagtcccagctactcatgaggctgaggcaggagaatcgcttgaacccaggaagtggaggctgcagtgagctgagattgcgccgctgcactccagcctgggcgacagagtgaaactctctcaaaaaaaaaaaaaaaaaaaaaaaactgttgtggttgtgatggcatcttgagtatgttaagtctttagaactgtgcctgccactttgtaagtgctctgtcaatgttcttgaaaggtaggtgtcctttatatatgaagcaaagtagcttctttgtgataggttacaggtattccccgccatgttgtttgttgactgttgaggttgttatttttgttcttattgtgttgggttttgtgtattgggtttcttttttagccatacaaaattgtgaaaatgtgagtgcctgggaagtgtgtgccttgggtcacgctctttgagtccaccacagccgctgggaggcggctggagcacctggggagcacctggcctccttactgagcatgtggtgtccctgtctggacttgcctggccccaggagtgcggccaccacagaaatcagggtatagggctgtggagccaggctgggatcctgcccagcatgccctgggaggagggctgatggctactggccttgctgatggtggcccccctggccagcacgccatctgacaggttccttgcagctaaaggtcttgctgggccacccaggtgtgactcactcaggccctgcagacagagccgctgcctgtgagttacttgcagtggagacctgagtcaagaggtgtccagccctgcttggggtcctgggagaccatgggtccaggcagtccagcccagcatgagactgtaactccccatcccagagtgaggagggggctgccaggcctggcctggtctggccggggggctgtctgcagtgtgagttggggcaggatgcaggccgagtagaaacccgtggggtgggtacccagctcctgggcaggggcctgtgaaggggctcccagggcccaggcagttctggaattacctccgaagttgtgtatatctttttttttttttttaactttgaaaacaatgggatgagactgggcacagtggctcacgcctgtaatcccagcactttgggaggccgaggtgggcagatcacctgaggtcaggagttcgagaccagcctggccaacatggcaaaaccccatctctactaaaag

SEQ ID NO: 72248 - DNA, 2259 bp, Homo sapiens
tggtatcagtatctgtccgcgatggctgggggtcaggtctcagccacctgaaggacagagctgctgggaacagtttttactggggtgtgcgccaactaggatggccgggtctcggggggaatgtgaggagttggcgtcttcctgagggtctctgcagcttacaccccctgcaccccccaactcgcactggggttgtttcctgctttttccaagcaaggtcgtgccctcagaagggttgggccacccacccctgcctcactgcatctagggacctgcctcaaccccctgcggctggctcccggattgtccagacccccaggcccagcaggcgggaggctgcagaggtcagccttgggctgcagccccaggaggcccatacacaatgggcggctgcaggtggttccccagggccagagggtggcccttccttcttagggtggagccggcatcccttcccttttgggagctgtccaggagccccgcctgggggtgcagagtggttctgtccagccacagctgtggcttttgccactttccggagccagctctggaggtgtgaactaggtcagtgcctgctcaccaggcccagcccaggatcaccagacaagagtagggctggcagagggtgggagcctggatcctattaagtaaagcaccttagcaccccaggggtggggcagcctcctacgtgcccagacacccgtgccaggctgcctgggacacctggctctggccggccgtgggtgcgtgtgtgcagggtgtgggggccggcctgcctggggagtgctgtcccaggtccctcaggcatgctgcctggagacagtggggtgttgatattgctgtctttttgaagtgttctgagcctcagatgcatgtgttgggacttttcagggacagccctgtggaatggtcagcagccgttccctgtttcctccctttaaataggcggcaagttgggacccacctcccggggtgggggtgatggtgcagggagcctggtgtgtttgattagggcatgggcggtgtggccacaactgtgtgtgtcaccacgggacggacccccggaccctgtcttgggaggcgagctgctctgcctggggtggccggtttcctcccctggagcccagggaggcagttgtggccctttctggtgtcttaactgggtgacttgattctgggagcttgcccggtccccactgcccagggtagcttgtgaaaaccaaatgtagctgcgaggcagacgtggagcccgatgccctgtgtgggttctgcaaggcagagctggagcccgatgccctgtgtgggttctgggtgggcccaggggaggtcagctgtggccggtgaggctgtgctctcacctgacccccctcaagagccctagagagagtcgctgcctgtgggaagggtggacaggcccagctgggggcccccgtcggggggtgttgtggcgcagggcctgggcctgcagctgccctggaggagctcccccagccctggcagaggtggtcctgggcttgtttgtcctcacttctcatccctgactctgccagggttggagacagcaaggctaggtccttccggggacacagagggtgactggcttggcattggcactgggcagagtgaggacaggactccagcccacctgcttgggctgtgctgccatttcccagcctgggcacgcctcccaacctctggggcctcagtgtgctcgtatgggaagtgggctggttatggcctgctgcctgggctcctgcagggctggtgtagttcaacttcacaggaggctctcggaggcacgggaaaggccctggtgtgccccgatgcccagctcagggagttggatgcccacagccctgagggcctgtctgaagctgtcatctgtcccaggggagttgggaagacccgaatgcctgtggtgaggtggatgcccccaccctaccctgcagccccacccccagtggccttgagtcacctgctggagaggaccttttaggagagaggctgagcatgggccaggccttggtttctgcaagggaccatttgaagtgcagggaagaggctggaggtgcttcggtcccacagccccctgcccactccctcctgggagctggtgccccctgaggttttggggacagaggagggctgccagcacagtggggagggcagaggggtctctaggaaggtgacctagggggtgacatctgtgactctggggcaaggccaggggtctagacgtgtcagtagcgaggtgggttc

SEQ ID NO: 72249 - DNA, 1054 bp, Homo sapiens
tctacctggttatggaggtgagtgccttgtggtgccaggacaagtgcaggctgatggccatggccctgggagccccacagggagggacatggctggggggagggtgatgagcaccttttctttttttttgagatggagtctcactgtcgcccaggctggagtgcagtgctgcgatctcagcttactgcaacctccacctccgggttcaagcaatcctcctgcctcagcctcccgagtagctgggagtaattacaggtgtgtgccaccacgcccggctaatttttatacttttagtagagatggggtttcgccacgttggccaggctggtcttgaacctcctgacttcaagcgatctgcccaccttggcctcccaaagtgctcggattacaggcgtgagctgccacgcctgctgagtatcactattgatgtcttccagcagggactgtggggacacctgccctgggctgggcaggtgcctgcgggctcagggagtagtgtccaagtgtgaggggtggggaggctgggcagggctgggaggtgggccctgggccctgctgcagcctgatgcgtgtctggtctcttgcagtactgcaacggtggggacctggccgactacctgcacggtgagtgcacagctgcgccacctgggctgccagccggtcccacagggcccgcacccagggccacactggcccagtctgggaggcagcctggctcgagtgggtccttggctcattgtgagattggctctttcttgtccccctgggcctcttgaggggatgcagggagctgagctgctcccggctgttaaggatgcagtccctccgctggcctcccccttgcttgaggagacagctgtgaccagaatagcccgaggggagccgcacaaaccaggggtgggggctgttgtcttcatagtgtggctggaaggcggctcttggcccacccaaagttgagccctgtggcggatgggaggggatgtgctgcacggggcggggcggggcagagggaaggacagcaggggggcggccgcgcccgtctgttcccaggctc

SEQ ID NO: 72250 - DNA, 1113 bp, Homo sapiens
cgggaagaggggcaggagcgggacccgggcggaaccgcggtggcactgaggctgggcttcggcggcctcccgtctctggagcagctgcagcccggggctgagtggtggggccggcgcgccgggctctgcgcaggagcttcaggtgcgccctggtctcggcggcccgtggtggcttgtgcccctcctgacccggggtttcctcccggcctgcggccctgcctggcgctctccatccgtgtggcgggaccggcctggctgcgcgggactcacccctgggggaggaaacacggcccccaggccctgagccgcctctccccgcagccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcggtcagcccgcgggcaggcaggcgggcccggcggggaggggctccggggccggcgccggtcctgacgcttctctcccgcagctgacttcggcttcgcgcggtacctccagagcaacatgatggcggccacactctgcggctcccccatgtacatggtgtgtttaccttggccgggctgtgccgggtgggcgcctctctgggcttgctggttggttggctggcgtgtggtgcgctctgctctggttggctgtggcctggcgggcaccttctgtggttggcgtgcgggggcctcacactgacccgacttctggtcccgcaggcccccgaggtcatcatgtcccagcactacgacgggaaggcggacctgtggagcatcggcaccatcgtctaccagtgcctgacggggaaggcgcccttccaggtaactgggcttggccctgctccccacgccgcaccgtcagtgcaagtgtccgccagctgcggtcagacgccccctgcgagccctgcccgcgccccacgagctcccctcgggtcctggctggcggggcgggcgtccaggggtccagtggggaaggggcctcggtgtcccccagggagggcggcgccgccggcggtgact

SEQ ID NO: 72251 - DNA, 1601 bp, Homo sapiens
gcaggcttgggatggggatggggtgttggaggggctggtgctgccctgtgacagtcatagggtggcccaggagggagcctccctccttcctgctggtcggggtgtagccggaagtggaggggatatggttgagcttgtccagtctgtgggttggctcgagggtgaggaggagacaggaggatggcccagactgacctatgcatgtttatctcagccccacccgtgcctgtgccctcgtacccaagctcggggtccggcagcagctccagcagcagctccacctcccacctggcctccccgccggtgagttgccgccccaggggcttggcagcttctccctccactcagcagtcaggggctccagccctgggcccccgcggggacgtgctgtgacttctgttgtctgtgtgagtcacgaaagacatggatgagttcattctgtcagatgttgaagccccacaaacgggtgacagcccctcccaacacccacagccctcaggtcccagaggccgatagggcggctgtttggtctggtcctgtctttggttttgtgctgacgtggacagaagcagcgtgtggccttggcccactgacacctgcacccctggcctccctcgtgtcttccattggactcaaagcatgagtagggttgcagggtgatggccccacatgatgatggcactccttgtgtgacatgggaggggtctgcagagcacctgagtcggccatgaacccccgtccctctgtccatctgactgggagcctggctctcaggcatggtgttgtggctggtggtgatgagttcatgtctgggctctcctggcctggccccctgctctgtgaccagggaccggtcctctgaccttggttgtctgcctgtatcatggccgaaagctcagatgtggcgaggggagcgtggcagcgccctgctgtagggagctgtggcatccgcagacctgccctggggcacttggggctttagccaccaccgcacggatggtgtgccctgggccttagcatggtgctggcctcagagcagggcccaccggggtggcagcctctccactggacacgccttccatggtacctcgttctcttggctatgccgatggaaaagtgaggtgcagagggcaggtggtgaacaactccccaaaacagggcctcccagagcttctgggagctgagggcttcaacccacccaggctgcatggtgagagtggctcgtcggggggcctgtccctgcgaggtcaaagctggcctttgagtggagtgctctggaagtacagagaagagcggagcacaggaagaaagacgtgcccagcccttctcagccccagcgccccgatctttactggggctctgggccatcccaggagggggaatttgctcccctgagtgtgtaggtccctgagacctgctcaccagcccctccgttgactctcagtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtcaggggg

SEQ ID NO: 72252 - DNA, 1499 bp, Homo sapiens
gacctctctccaccacagccgggctggcccgttctccagcagcaggtgcggcgcctctgtccccatcccagtccccacgcaggtgcagaactaccagcgcattgagcgaaacctgcagtcacccacccagttccaaacacctcggtgagtgtggagcccccaggtagccaggcgtggctggggccttgtgtggcaggagcccttccacggctcccatagagggacagggtcgtcatccatgtgcagttgtgcaggctgcgcactgcgtaactcagcaccaccatttactttgttgatgtcttgggtttctagagttattttgacagttttctgatcagtaaaatctctctagtttataaaatcaatattgactttggccagttttaacagacagaagtaaatggtgggaggaaagggtacctttcttttaactcacagaaggctgtgtgggccagtgggtgtctggcaggggatggagactttagggtgagggtgccttgggttggcaccccgggcaggaaagctaaggggccaactcctcccacacacccactgtgtggccggttacctggacagagtgcattagaggatgagccatctgtcagcactgtagccacttggcgtggcatggggtcctgggctgctggggcctcccctcctaatacctgccttgtccccaggtcctctgccgtccacaggtcaggcagggctgctgaggcctcccctcctaatatctgccttgtcttcaggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaaggtgcgcctgcaggctggggcctgggaaggggcgtctgtaggcagtgggtgaggaggctgtctctgtcccagctggaccctgacagatctctcttttccccaagttggaaccatccctgagcggccaggctggagcgggacgccctccccacagggagctgagatgcggggtggcaggtcccctcgtccaggtgggtgcagtccggaggggggagggggtgctaggctgacctccctcgctcacgttgtcatcctggtctaaagcccttgctctttccaagtgaaaaggagtgggaaggaagctggtggaacagaagccaactgcctctccacctcctggctgtgtgggctggggcaagtttcttatcccctctgtgccagtcttctgtgctggctgagggtcaggtttaagagtggcgcctcagctactcgggaggctgaggcaggagaaccgcttgaacctgggaggcagaggttgcagtgagccgagatcataccaccgcactccagcctgaatgacagggcgagaccccgtctcaacaaaagaaaaagagtggggccttggagtgcgtctaccccaaggggctccgtgtggtagcagt

SEQ ID NO: 72253 - DNA, 1068 bp, Homo sapiens
cctgcggggctcacccaagctgcccgacttcctgcagcgaaaccccctgccccccatcctgggctcccccaccaaggtaatgggcactgccatgtgtgcaggggcacagagccctggggaagatgtgtgggaatggccagtcctgaacaaagaccgaggaaggcagctctgtaccttttgacccccgcctgggctcatgctcaggctgctcccacatgcctgccagttcctgcggactcggccccttccccaggcaccgggccccagggctgcagacctgcggggcagtcttcaccccatctctgtcctcctaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtgagttgaggggacaggccttggacgggcttctgaggggcagcctctttcccctgcattgttctgctgggtacttctggggggtagaacaggaaaagcccagccttgcccttctgtgggtgcccagtgtggctgggtgccagagagcctggcccacctgtggctggccctagacccacagcaggtccccgtcctgagcctcgccatgcccgcctgtaagctggggtgacaggagcgcctgcctctcgaggtgggccaggagaccgtgcatcatgtgtgtctggcctgcagagggacctctcgaggtccagttagggtggggtgggccgggcacccagcacagccctgcacactcccacaggtctttcagcaccagccgcctcactgacctgctccttaaggcggcgtttgggacacaagccccggacccgggcagcacggagagcctgcaggagaagcccatggagatcggtgtgtgggtgggtggggctcggaggctgtgggatgggggtcggaggctgtgggatgggggtcggaggctgtgggatgggggtcggagg

SEQ ID NO: 72254 - DNA, 3798 bp, Homo sapiens
gggtcacctgccagccccatagcgaggatgggggactgccttgccctttgaggtccttttgggccttgggcccagctgtggggcacagtagcacaccaagccacgcacctaccccattccagacagtggcagctgccctcctcccaggcagatctgggctgggggtcgggatacccagagggtcccttggtgggcaccgcagcccttggcctgaggtggggagctggggacttgggggttgtggtgagtggcaagaggttgaggagtggctctaggggcctgctgtgcttctcctgttggagcattgggatataacaggtgtaaaccgaggcagaggcacattgggccctggaggtgtgggagtctgtgggggatggatgggggccacggtgtctgctggtcctggtgtgcccctcatcgccctctccctgcagcgggccccactggctctgccagctcttctgcccgccacctggtgcctgggccctgcagcgaggccccagcccctgagctccctgctccaggacacggctgcagctttgccgaccccattactgcgaacctggagggggctgtgaccttcgaggcccccgacctccctgaggagaccctcatggaggtgagggctggagtgagcaaaggttcccattctggctggagggtgtgtggggtgtgtggggtgtcgggtgtgtggggtatagggtgtgtggggtgtcgggtgtggggtgtcgggggtgtggggtgtagtgtgtggggtgtagagtgtgtggggtgtggggtgtcgggtgtgtggggtgtcgggtgtgtggggtgtcgggtgtgtggggtgtagggtgtggggtgtagggtgtgtggggtgcagggtgtgtggggtgcagggtgtgtggggtgcagggtgtggggtgcagggtgtgtggggtgtcgggtgtgtggggtgcagggtgtgtggggtgtcggctgtgtggggtgtacggtgtgtggggtgcagggtgtgtggggtgtcgggcgtggcacatcccagctgcccgggctgcagcaggggagggtaccctgccctgcctccccaaggcgtcatcggtgagtctgaagggagacaagccccttccaagcccgggcagcacttgccgccctgacggccgcttcctgcagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatgggggtgggtgccgccagggctggggtggggcgggtggtggcctgggggccaggaccaaccggcctcctctgatctgcctgccgcccccagcttcgcggaacagctggtgctgtacctgaaggtggccgagctactgtcctccggcctgcaaagtgccatcgaccagatccgggccggcaagctctgcctgtcgtccactgtgaagcagggtgagggctgcgaccgctcagcccacatgccgggttggggaggaagcccaccttgcaactgcctgggtgacagggtaacagggaggctgcttgagtaggcccctgtgcagaggtgcagaggccccggggcctggcccagtgtgcagagcacagaggccattgggtcggacagcaccctggagcccagtatgcagagcacagaggccgtggggtcggatggcacccgggacaaggtgcggagcctggccacaccctcaaggccacggggagccagggctgtggcagggagggagggacgtgctcgctcagtgcaccgggcagatcatggccactccagccctgccccgtgtctgctgcaccctgagctgaccaccctcgtcctttgcagtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtacgggacagacagacaccagtggggcaggggccaggaacttccaggcccgccgtctccactgggacgggaccttgatgcccacagcgtggtgagactttggggggtgtcacttctggaggtcttgaaatgacagcattatgcacccccagcctcctgcaggcgctcgcagctcggctgggtgcatccttgattgtacgggtgccgtggcccatgtgcatcctgcctcgccccgactcagtttccccaattgtaaaatgagagacttggtcttcaggcctcgtagtcaggtgtcagcctccagaagcagcacctggtcccggacaacctgcctggaagtgtggtgcactcaggtggtaccacgggcaaagactccctgcttgggctctgaagagctccctctgcctctgaggtggtgcccccttttcgtttattttttgttgtttttttttaagagagggtcttgcactgttgcccaggctgaagtgtagtgtagccgctaactcctgggctgaaatgatcctcttgcctcagcttcccaagatgctgggtattacaggcaaaaactcatgagtgcctgagtctccttttttaagaaaatttaagcatgtagtaaaaatccagtctgaacaaacatgggaaaagtcagcctccctcctgccccccttcccgcccaggcaggccaggcagcagcagtaatgacactgactgagcggcgggcactctgttgtcctggggccgggctgagagcgctggccagggtcatctggttccaggcagtgtctccccttggccctgtgaccatcccctctgcacagcaggctgcaccagcacttatgtctccacgtcactgccctgagcgcctatctgccacccctgggccgctgccgtgggtgcagggcagcccttgctgggagggagtggggtgagctggccctgtccagcctctgtcctcgcccccaggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgtgagtgcccggctgggctgggggctggggactctgggcgtctccctcacactcccctctccctccacaggcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaa

SEQ ID NO: 72255 - DNA, 1139 bp, Homo sapiens
ttgacagtcagttttgatgtcagctcctcggcagggtaggcctgatgacagccctgtccctccctgcctctgccttgcccaaggccacggagggcatctgcagagaggcctgccttccggattccaggcgggcatgccctgcaaaccccgcctgggcctcccttggtctgcccagccctcgattagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtcaccacttgtcttcgttggcttgtcactgttttcagggttctgtcattttctttctcagccgaggcgcaggagcccagggcccctccacaggtgcccacaatggtcgacacagccctgggagcagagccccagggcagaagctggatgtgttgagggacaatgcaaacccctgcgccacaggaagcctctcccgccaggctgggggtcctgcacagggtgaagagagtccagagggcagggcatctgccttggtatagctttgggcacctgctttgactcctttgggggatacacctaggaggggctttcggggccacgtggagctgtgtgttaacttccaagaagcaacacggttcgttcactgcagcctctgagcagctgggcctccaaggccttgccgtgtggttttgatttgcatttccccga

SEQ ID NO: 72256 - DNA, 2087 bp, Homo sapiens
aggaattgatgcaaaaacattccatttttaaaccccaaatgtcagtgagctatcagcaataaaattctaacaaaattttgagcagttgtaaaaattatgttgcctttttttctcaaaatatttcctctcaggtaaaggttgtgacaggaaaggatgggcagactgggactcccgttgctatagcaacccagcttccgccaaaggtttctgctgctttttcatcccagcagcaaccatttcaggtacttttcgatggttctcaaatgtagtctcatcccaaacttttccttcatccagatattttaaccttcgatatactacttgctcttcagcattttttttccagagcccatttcttatttttcaacagtaaaaaatcttcctgcgtatacaattataaaattaaattgcatgagttaatgatgacacagatcttagtgcattactttctttcgtatacttgtaatgcggtagtagctttagcatgcatgtcatctaatagtcctgttgaatgtatgctcaggattccttgtgtgctgtgttttcaatgttggttctttcttgtgtcctttattttgagaacagtgcaaaacagaataagaaaaaaaagattcaagtagatgataaattggtattttccatagctagaggaaatgctgaagtgaaatacacttctgaaatcatcaggaccacaggcttctaaacggatattaagtgaatgcaaactgattatttttaattttttgcaaattcactcagtgttaaattagtaatgccaataatttaaaaacacaggtcactcacgcctgtaatcccagcactttgggagactgaggtgcatggatcacctgaggtcaggaattcgagaccagcctagccaacagggtgaaatgctgtccctactaaaactatgaaaattagctgggcatggtggtgcatgcctataatcccggctactcaggaggctgaggcaggagaattgcttgaacctgggaggcggaggttgcagtgagccgagattgtgtcactgcactccagcctgggcagtagagcaggactccgtctcaaaaacaaacaaacaaacaaacaaaaaccaaacaaaccatcaaatttctactagctttggaatagatagtgttgggttgtgaaagcagtttcatccttgggatttttgttgttactttaaattttgatttaatttcaaatgtacataatagttgcaattaattattttaaaaaccccttatatcctttaccaaatttatcagttgtttttgccccatttgcattattttcattctcatatatatacacatatctaaaacatcatatcctattcttttatctgtaaatacttcagcatgtattagataagaatgtttccttacctaatcacagtacagtgataaatatcaggaaattgtacagtagtacaataatacattctaatccatagtttatattcaaatttcatctcttgtctcaaggatgtccttcatagtgtttctttccccctagtccagtatcaagttgtcatgcctctctggcctttttaatctgggttggtttcttagtctttcatgaccttggctttggcctgggcctgggcgttaaaaagtacagaccaattattttgtacagtgtcctttgatgtgggattgtctgatgttttcttgtgtcctctttggatcatgtatttttgagaagattgctatagaagtaatgatatgtccgtttcaatgtgtcttatcagaagggtgtgatgtcactttgtcctataactagtaatgttaactctgaccacttcgttaaggtggtttctaccaggcctgtccagtggaaatttatttatttttccttttttaaatgatgagtaatttgggggaagatactttgagactatgtaaatatcctgaatctccttaaacttttacccactagttctagcatctgttggtgagtcttgcctgaatcagttattactataaagaatccatgctgggttttctaactccatcattctgtctacatttattagaatcagtaggctgtaatatatcactatcagtatttatttgcttatgttt

SEQ ID NO: 72257 - DNA, 1036 bp, Homo sapiens
tggtcccactatgttgcccaggctggtctcaaactcctgggctcaagtcttcttgcctcagcctcccaaagtgctgggattataagcgtgagccaccgcgcccaactgtctgtcaatatatctaaaggaaaaacgcctagaaatgaaattgctagatcaaagcgcagatgtagttaagtaataatggtgctcaattgcccaccaaaaggacagggccagttttcactgccatcaacaatttctggttctttcacattttgatcgttttattaggtataagtcatttaatcctcattgatctgatgggtgaaacattccttgttctgatatgggtttctttagttttgagcacgctgtgcagcctcattccctgtgtgctgggcatttgtgagtctgctccactgcccgctctccatgctctcgtccgtgtacttgtgatgctcctcatgtgtgcctgtgctttctgagtgctaagcaagcccacctctgcccgtcacacacgttgcagtgttgcctctcaggttgttgcttgtccttggccttttcatgatgctttttcttatatcggcaacattttaatgagaaattgtatttatcagccttatgttttatggcttctggattttagttcatgtatagaaaggcctcccttttccaagatgataaaaacacacatgtttttttctactacttctctggttttatttttacatcaaactgcaccttttttgaaaattattctagagcagtctaagaggcctcgccttgaagtgggtcaccaaggggtagttttccagcacccaggggcggacgcaggcgttcctctccagcaactaatgccgaccgcacaaggtaaggcccagcagcagagccagctccccgctcaggagcaggcagcacactgcggttccagaaaccagcaccagactcagacttgggcagtggaggtagcgtgtttgcagtggggtgcctgaaattgagatacttctctgagtcccagtcgatatcatatgcaaagcccctggagacatattct

SEQ ID NO: 72258 - DNA, 1048 bp, Homo sapiens
caggcgtggtggcaagtgcctgtagtccaagctacttcaaaggcttaggcaggagaatcacttgaacctgggaggtgaaggttgcactgagctgagatcacaccattgcactccagcctgggtgacagagtgagactctgtctcaaaaaaaaaaaaaaaataataataataatagacaactgttattattgtcactcttagtaccaggggtccctccttactcacccatatgttgtgtgaagggcatggtgtcagttatcccttatgatctgcctagcaaccctcaggtaggtggcagcgacccattctaccagtgtggagacacatactcagaggttctggggctggccccaggttacatggcgatgaagtgatgagcggggcttgaccctagctccatgtgagtgcaaaaccatgttggacaccacccaccagacgtgctccctggacgcctgctttgctgcttttgggatgctatatgctctgcaaatgtgtgtaaggtgttactgatccagcttgatacacatgtgtaaggcgttactgatgcagcttgatacacatttcaggtagttaaaatgcccctcctcctccactgattaattttacccagtgtgtttttgggatgtccacagtaaactggtttcggttcctaaggaatagcgaaatgccacagcctcggtgccagccgtcaacagggcactgacagggaggccggggaggactctcagcccccttggttctccactgtttgatgcacatcagggcgtggggagcccactgcagagagtcttcccttccttttgccttctccctcactaacaaaggaatttcctaggtgggctttaagttcagggtttttgtttgtttgttttgaaacagggtctggctctgtcacccaggctggaatgcagtgacacgatctctgctcactgcagcctctacttcctgggcttagatgatcctcctgtccctgccccctgagtagctgggactacaggcgcacaccactacacctggctgatttttgtattgttgtagagatgggatt

SEQ ID NO: 72259 - DNA, 1122 bp, Homo sapiens
tggagtacagtggcacaaacatgactcactgcagtctcaacctcccaggctcaagcagtcctcccacctcagcctcccatgtagctgcgaccaaaggtgcacaccaccacacctggctaatttttaaatttttttgtagagatggggtctttctttgtcaaagcccaggctcatctcaaactcctgggctcaagcagtcctcccacttcagcctcccaaagtgttgggattactggcatgagccactgggcatggcctaaagatagttcataatgaaaactcctatttggttttgtggaagtgggaggatgtattatttgtggacacgttagtgttgggctgtggatacgatgtgatttgtctgcttgcatcgtggagcggaaggtgctggcagtgcgcgtctctggtgctgtgggcgctcaggtatttggcaccgtgggctgccccgacatcttttcttcaccttgctccacttgtgccctgcccttacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggtaagcatgcttaagaaagttgtaaaatgtactccagttggtgaagcacatttagttttaattgtcaagaatgtgatggcgtaaaaccgaatgcctggtcaattcagcatggcttgggaatcagtagacacaagatgaaaaccaagggttagccttttctgttggaagcagactcatgggggcagtctgcgtttttgtgataaagcctgcagtcttgggctgctttcatatgggcagtagacgagggtgggagaggtcacgtgtagcagttaggcggagagggacaagcttgagcgctggggccctgcaggctgtgaggtccctgcagccaccagt

SEQ ID NO: 72260 - DNA, 1334 bp, Homo sapiens
ccagacatcctatggtttcccatgtaaacactttggtagaaacatgaggttttaaagttttagtctgttttatagagctggggcaggactattgctccagcttcttctaaggctcctggaagggtcacatgctcctagacctctcctagaaccactttgacctttgtgttcgaatcttacctttgatattaaactgggaccttgtgctttctctctttcttagtgcctgactgagccttttgcatagtagggcttcaaatttctggggtctgagttggtggaacacactcatcacatgccgaccccaccatcccccatgtatcatctacaggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaaggtgggttggaatgcgtggagctgctgtgctgtgtgcgttggtgggggcttgagtttgcagtggtgtaagtggtggggaggtctccagacccactttttttttttttttttttttttttcccccagacagggtcttgctctgttgtccaggctggaatgtccagctaattttgtgttttttgccacattacccagactggtcttgaatcctgggctcaagtgattgctcgcctcggcctcctggagtgctgggattgcaggcgtgaaccactgtgcctggcagattcactctagaggccttaacctgtgaagtctgggaaggatacttccctgttgtttggagaataactgtgctgtgtaattaagtctctgaggtggtgtcttcagagcccagcatgcgttgttgggatcaagcctgtgctcagtgctcacccactaagcaatgatgtggatttagcttcattttgttgcctggctttgcctggcagttggagttaggatacctgcagtgccacaggttcaggctggtggctggggctgttcagggagctgagaggctaagagttagaaggcacctggtatcagtcaagggacagcaaggggctgtcctaggctttcctgcctggccacacggcctcctgcccttcctcctgggcttctagtctagctttctctttaattttggctgagaatttatttttctcctaactgttgccaaagcaggcgcagagtccttggaagactctggaggccctactgctaacactagaaaagtgagaacaagtggtagatttctagaaaccccaggcctcagtggg

SEQ ID NO: 72261 - DNA, 1118 bp, Homo sapiens
gttttctcatcttaattctctccacccatttgaggttctgttggtgggtatgtgaagtgtctaaacttttggaaagcagtttgacaatttaaagcaaaagctttaaaaatgtgaattatcgcagcccaataatttctataactggtgcagcattcatgaaatgagatgccgacccatgtttattgaatggagagatgttaatcatctattaaatgggaaaagaagattatagcacaatgtggtattctagttttgaggaaaataatgtgtatttggtgaaaagtataaaaacactttctagaaaagtcaagctaaatattgatggtggtttttgcttatagtcatgtttctcctaatccaccctaagagcatacgaggatgtatatgacagtgaattgtatgtaattttagtctgagaagatttaaaaaaagttacatatccttttttttccagcatgacatagagtacaacatacaattcttgcacttttattcaccagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggcgagtgctgccgttgtcatggggtcgtaagaatcagtctgtcggagctggtgaggccacttcccgagaccagagctcgggcaccttgcttaggaagctttcgagcaccagagtcagcaacgtgtgcactctcctgggctgttgcttgttggcctttgaatgagctgctcgtgcctccgtctgtcttgcacaggggatgcacctcagctgtggctgccctctgaggtgcttcatgccgtggaggggctctgggcattgtttcagggttagcgtgagtcaccaccacggttacttctagagcggtcgctcgctcacttgctttccttttttgaaattttaattcttacctcaccacctaatagaacctgggcaggatgtagttagtatgaaataaatgaaaaagcaccaaactgacgaggctggaaaacactgttttcagactctgcttatgtgctttagtgttttgtatgcagaacg

SEQ ID NO: 72262 - DNA, 1060 bp, Homo sapiens
cccaggttcaagcaattctcctgcctcagcctcccgagtagctaggactataggcgcacgccaccacacctggctaattttttttttttgtattttagtagagatggggtttcaccgtgttgcccaggctggtctcaaactcctgagctcaggcattctgtccgccttggcctcccaaagtgctaggattacaggcgtgagctaccgtgccccgcctattactccctttcattatagactcagtctactttgaaaataaactggtgctttatagccttagtctcacgtggggtgttaatttggcagtgacagctgaacacagtgagcattgatcatgtcctcgctcccccgctgccctgccccgaccccaaatggaggctgagggcagcctagcaggcttgccccggggctcccccaacctgtcccatggacactgctgtcttggtttcccattctgagtgtttggatctcatgcttgtggtttttctttcttttctttcaggattcaggaatgtctggaagaaaaagaaaagctagcatatctttgactgatgacgaaggtctgttccccctcagcactatctttgtcatctccagggctgctgatgagatgacacagagctgcagcgacttggggtttagtcttgtcatcttcagctggttggaaagctcaacctttgtatttatccagatgtctctcagtgtatagagtactttttgtatctctagaggacttgggatgttttctggagcaacatggtcgtatctgctttttgaggtttggaaacttgggtgcatcttggagagtgttggggccccatgctcctgtggcacagggccaagcctgtttctgtccttgagaggtggccctggtatgtcctctggtagacccatggttgccagccattgggatttcaggagaaactcatgtgaattttagatgttggagaaacctggttcagatgagaacagatacctgagcactcagtgtgtgagctggggacagcccacggccatgacctatttccaaacccatgtggattgagtacagaagtcctca

SEQ ID NO: 72263 - DNA, 1070 bp, Homo sapiens
tcttttctctgccaggagccaagatctctatggcgagtgaggcgtgaggttcagggctggagggctgaagagagcggagtgggcttgggttggtgattgtggaggacaggagagtcaaggagagtgttaggctgatgtggctgggcctcgtgagatgggcgatgatgacttcacggtgatcccagatggcatgcctgtgggctttccacagtggggctctgcaggaaggtaggagggttgacagcattccgtatgttggcctgaagaaggtctgccatgtgtggaaaaaccagggctgtcattcacagcctgaagtggaaggggaaatacacttccagtttcctgcccatttaattaaatttaacctgagaagtttaaaagctcagtttcaatttctgtaatagctatgcaaaataatttcgaagccttatagtgtgtaatgagtaacagacactcaagtggtgttgcctctcagtgacacttgctgataaccattttagtggacgatgaagaggaaacaattgaagaggaggaagcaaatgaaggcgttgtggaccaccaaacagaactttctaatttagccaaggaaggtaggctgttgctaccttattaaacattcagtaagtaaaaagaaacatttaaaacatgtgagatgtgaataataatatattgagtaacaacagcagcagtgcctgttttatggaaaacagtccctgtgtgcctcctgctgctctctctcctgacctggaggtcctggccctcctgggttgtgtgtcggacactgccctgactgtctttcttccctgccacctgcgtgtgtctccctgaatgtaccgttcatcttgagtgtgtgagaacttcatatgaatgaatccaccacagcttgactgaatgtgccgttcatcctgagtgtgtgagaacttcatgtgaatgaatcccaccacagcttgactgaatgtaccgttcatcttgagtgtgtgagaacttcataccaacgaatcccaccacagcttgactgaatgtaccgttcatcctgagtgtgtgagaacttcatgtgaatgaatccacca

SEQ ID NO: 72264 - DNA, 1005 bp, Homo sapiens
gtcacaacctcggtgaggcgctaagctttcaagtgtgggatgggcctttgagagacagagcacatagcttagccatgagaaaagcttttcctcttcccagtgaaatggtctatcccaactgcagagttgtcagaaaaagcaattcttcatgtgcctgtagtcccagctactcaggagggtgaggcaagaggattgcttaaggccagatgttcaggcgttcaagaccagcttgggtgacctagcgagactcgatctccaaaagaagcaattcttcctcttcctgttttctgtagatcatttttgtggctttctaattggtttatcatgtgactgttgatttcagttttgagaaaaagtttgggtgattattttgacgagctgtcattcttttatttgttcatcactgcaggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaagagtttgctagtttttttaacaatacctatttgctaggacttacctataggccagtgtgtttgatgggagtgtggggacttggctatcttatctacttctttgctcctatctgttgacctgagcaaattgaggctcagaagtattcattttatgaatgaataaaaaactggttcacagttaacatccagtaacaattagtgaaaatctaataaaatacagagactcgtcaggctatgactgaaccttgtgactccagggtcaggtcactgtgcagtgtgtgggcagcagagcaggtggtccacttcccatgctgcttctagactggcatgaacccgccgttgggctctcagccgtgtggggtggtttgtggcatgcatcttggctcactgtatccttttcatgttatcatgtcc

SEQ ID NO: 72265 - DNA, 1517 bp, Homo sapiens
aagtgctgggattgcaggcatgagccaccgcacccggccttggttgggttctgtggtgcgtactgctgtcatggtagcttctgtcacctgcacttgagctgacccttgagctcctcacgtccggcgtggcagaactgagctcgtgttttcccaagcctggctccctccctggtgttcctgttttagggtgtgcgccaccatcgaccaagttgtttgagttggaaatttgccattgctctctcctccctcctcttcccacaagtctgccatctccttcctgagtctctctcccgaccagttacctgtcgtcactatcaccccggtttcctccctcaggccgcctggtgcactgtgctcacaccagagagctactccccaccatggtcccatttcctgcccagccctggtcccagtgtgcgttgtaggtccttctgtctgcccccttcactgggtggtaagccgcacagggcatggacctgggtcctcgtctacccccgctcactgcctgcagggccagtgtaggaccaggcgtcagagctgccgagcgggtgtgtgaggggctttactctgctgcgctcaccctgcccctcactttgctcatcccccttggatgcccccacttctctttcagagcactcggtatgattgtgaatgaagtggagtggctgtctttccgtcagctctggtggggcggatgtcattctcaatggggatggcgaacaagtgcagaggggcctgcctgggatgtggacttgaatggccactctgtctaactcattaagcggacctagaaaatctgctcctgcctgcctttctggagttgggacagtcgatggtgagggtgggactatgtccatgtgccgtttggattgaatgcttcgtgtttctttctccacgggcagcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggtaagtggaggatccagaaagcggaattactgttggatatcttttctaggcacattatagataaaaccattcttggaaatgggttctcaaccagctcttctgcaattgcaattgcagctccgcgatacatggcaccgtctagcagcactgatggcctgccaccccttgccggagtgttccacctccggaaatttacccgagggagacaggctcacagagtggaaagatgcagagggcaggctttcttggcgttgtgtggattgtgggctgtgagaagtagctgagcatgcacgctcatcagcagagcttcaccaagggtgtggcagcacctgtgtattggcacggaggagggtctgcttgccgagtggccgttagagggggcgcgtctggatgcccacgttagggccctgccatagaaatcagttttg

SEQ ID NO: 72266 - DNA, 1053 bp, Homo sapiens
cgtgcgacccagaggcagcggggagggttggctcccagggcccccacagctgacccaggtctatgcgtggtgaaaagaaaggctgctaatgtagttaggttatctgctgctcttgggaccttgctggtgtccttggctgtggtatgcctggctctgcagatgccttttaggctgtgtggtgcagtgcaactgcttgcctccctgagcagcaacctccttgatcgtctttgcagcagttttagggtagggtgggtgtcagggctgcatttgacctggtgcctcgtgtggtggaggctggtgtggccgaaccacacatgtgtcgtgagtgtggcaggcagaggactccacccccacggtgatgtcattgtcttaacaagtgacatgtgagtgattctgaagtgatgcttttgcgggtgtcatgaggctgggagggacagacacgttagatgattaaaacgagatataaatgactcatagtctaaatctagcaattggaaatatccaaaatcctatgcttgggttaaaaagaaaggaaaggaaaggaaataggtatttggagatgaaggggccagctctgcagacagtcttgtgatccttgccattccaggagttctgcagtctttcttgttggcacttctgtatttggcttcactggggactttgagtggatcaccgtcccctcatcagtaccagaggtttctgcttagcttgaggactcacgacccagcaggctgctcctcagagagcctgcagccatcagttaaatgaacagcacccattccagtgggtgctagtctgtctttttaaaatggctttttacaaaaaagtttataaaagtttttaatagagacagaggtctccctgtgttgccaggctggtcttgaactcttgggctcaagggaccctcctgccttggtcccccaaagtggtagaattacaggtgtgagaccacacgcccggcctaaaaatggcttttgatggccgtctctgcctgttacattgtataggggttttgaaaatggccaatatagttcccagcttaaagtgggcaca

SEQ ID NO: 72267 - DNA, 1743 bp, Homo sapiens
tctttccccttccctctgtaaactgcactctgggtgctggtccctgagctggcttcctatgggcagcggtgaaccccggctccatgaggtggcctgtcctctctgtggtctgatgctctgtatcttcttgcctggaccaatgggcatctaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtagacttcacgtagttgtctgctctccgccttatggaggtttttgtgggacaagttcatggcactttcttctcgcgcctctggatgcggtaattgtccctgagtgggaacaggcaccacccgctggctttctgaaggtgccttgtttagttcttgatgagttttagactttttgatggcttgtaatggatgttttccctattgaagaagcttcactcctaggtgataagtgttgatctgatgctcacagccactgggcaggctgtttctgttgacagaggtgcgtgcgtgcagtcgtctaggagactcctgagaacgtctgctcatattgtattttgtgctgtcacttgaacttaattattcttttgaggaagggtagagtagaaaaggccatcaaaagagttaaaagtagtatttcaccacctggccaaaggggccctccacgccatgtccatccaggttttctgagctaaaaataaatgctcagacctgcattgttgccagcattctctatagaaatatgagtggaagctctgttgatgttttctttgtgtgtttaggaaatagtttctaattgatactaatgtttggttgggctgacttctaacagtttctgtttactctgagaaatgtaccgcgtagcgtactgtagctcgaagtgaagataattatcaacaagtaaaattatatttctctcaccctgtaaactatatggcccctctttttttccttaagaggggacttctcatttgagagacggtgtgaaatgtttattttatttctttaaaattcagtttaaaatattgtattttattaagaacctctaacagctttgcacaaacaaaccttatcgattgcagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtaagtggcctcacctttccaggtttctgccatctctctaccccagaggagttgtgttaagaacacggggatgtaggaggagccttgctgtccactcctttgtctttccccagccccatgcccggtgctgcctctcaccagtgcagctgcctccggcatgagtctagcagggagcgcctctgtggaggccacatccggccttctcctgtctgtgctctctctcctgaccccgccatccagctctgcttttctgctgcactcactcactgctttggtgctgtggacggcacttcccagtgttagccccggccttgttcca

SEQ ID NO: 72268 - DNA, 1018 bp, Homo sapiens
cagaacattttgctgtgtccagtgggattagtatgttttcaaaccttacatgtaccctattcattctgtggtggaaattatcctgacttaaagtattatgttatttctcaagtgccacctcaactccttttgttgttggtatagccaaattatgtggaggcctttctggaaagatgcagatgggagagggagtgatgcacagagacacttgagttcaaactaattctctttccttacaagtctctctctcccattgcccaaaaataaagaggaattgtcctagttaagtgccctaagggagaaagcagttgcatattttacatcttcatcaaactagacactgtcttgcgtgggatgagagtcatgttggtggttgccagaggagctgttctttgggagatctgtgaagtgagcaaaactgcttttcctgtgggtcggtcctcacctgtgtatggaacaaggaggattgttgagagattgacacttctatgcacaaatctctgtcttctgttttcattttcccctccttgttcacggttattctgtgggcaagatatctctagacatttttctagcctcttactaactattctttttatcatatcactaataattctggcatggatttctcgggaagaacatttagattcaagtatcaaccattgggaaataagtctttaaacctgttgttcagttgtagccggaaggtagtacctttttgagttgggggcaaatgaccacatctgagttatgttttttcaaaaaaagtgttttaagcaacgctaagttttactttttttttttttaaacagtaaatgttatagattgacgcttaccatctaattcaaattagtatgaagctttatatcttaaagctttatttatgtatgtgatttctttatgtatctagaggcattgctagatcttgtagacaccgtggctcacacctgtaggcccagctgcttgggaggctgaggtgggaggatcgcttgaacccaggagtttgaggctgcagtga

SEQ ID NO: 72269 - DNA, 1052 bp, Homo sapiens
aagctagttatttttttatatttgtaaagatataatctctctttgtgagctaaattggacaggtacttttcacatttttaaagttctctaaagtttaggttcatatgtgagtttccaagtgtattacaaatacatttctgctttttttttttttttggagatggagtttcactcttgttgcccagactggggtgcaatggcctgatcttagttcactgcaacctctgcctcccgggttcaagcaattcttctgcctcagcctcgtgtgtagctcggattacaggcgcccaccaccatgcccagctaattttttttttttttttttttttttttttgcatttctagtagagatgggttttcaccctgttgtccaggctggtctcaaactcctgacctcatgtgatccacccacctcagcctcccaaagtgctgggattacaggcatgtgccactgcacccagctgatttctgctatttttgttgtttcggtagaaaagtaaaatgttccttaatagcttcgttaataatatcaatatctgatatctaaaatcccaaccaattatggttaagtaaagttaaccattaaaatctgacattttgttttctctttttaattaaaataattatttttaagaagtggtagaaaacactacctgataaacatttctgtggtgcttcagtttatgatagatggtcattatatacaagaaacgactgtcaatatgacactcccaaattttttccaaaatgatctgaattcaccttttcctctacgtttcaacaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggtaaggataaggatgagagagcactgatgccaaaaatgacaaaagcgcctcaccatgagccctgctgcccacgggcctgccttgtgcatttaagtgtcaggct

SEQ ID NO: 72270 - DNA, 1109 bp, Homo sapiens
cccacagaggctgggtcgcttggtaacatctctgatggccgccggtttattcatagagatgacctgggaaactatcttctccagagtaaaagaagtcagaaagatgtagtcacacaagatccaaagtggcagcctcgttaaacagcagcagaaaagccacaggcatctgggctaaaaacagggttttgttctatttcttcattctccttgactgctgtgatctgggagtggggatgtccgcctcagtacctcgaacagcatggcaggtcctcagcagctgtgtgtcacccaccttccatgagggacagagggtagatggccttttcttgacatggagcaagataccttgtctcttagtgtgtcgtcatccactgtcggtgatgggttgccactttcctcacagtaactgaactttgcattgatttttttgtgtagatttgattttcagtttgtcaacttatttttgtactgtttggaagtgcctggagtgtgtggctgtgatgtacacatgcctgtcattgacacctagtggacctatgattgcaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaaggtagggtgctctgagcaggagggagacttggcttggatgcttctttctcttccatctaaggcgagtggaaagcattcatgtgtctttgactgtatctcagaacagcacagtctagtgtgtggccatctctgatttctatagatgtgtcctagtgtcagcctgatttattttctttttcttgtgctttcaaaggtattggttggatataaccagcctccactgtccttaggtttttgttttgtttgtgttctcacaagaaatttggaatcatgagaaatcttgcttgtttgtatatcgccagtgtgctccgtttcccctgggagtgggagtgtgtggccgcccacgcagggtctggttctttgtccggcccgagctgccactcctcatcctgtctcgccacctgc

SEQ ID NO: 72271 - DNA, 1051 bp, Homo sapiens
ccgcggaagcgcacactgtcacacgtgcagcagcaccttcttgtgaaccaaggtgggtggaaatgccatccccactttttttagtggttctcagggtgattggaatccaggcgatttttgttttgttttgtttcttatgcttttatgtaatcaaataatttatgatgagcatgtagtaatataatcaagaaagagtagattttcatttaaaggccaggaaagtcttcccaggtggtggtttgctgttgatgaagttgtccatccactatttccctttatcacgtatttagttcctttgtttgtgtctgggttcacgtcttcactttccgtgctgttccctatgatggtttctctttaatatttaggatccttttaatttggaattttctgaaaaaaattttgttttcatctctgaaaatcatgctgttaaagttgtttaatgtgagcttttttgaggtttagcatttagcattttacaggcagatgagcctcatgggaaggcaatagactgcatggtctgttctgtgtccccagtgatggaatcttgaggaagccttgtgtccctgcactgggggtccgtctgtccagtggggtgacatctgcagctcacggtcgtaattgaacacctcttgtgggtctggtagtgtaccggggttagaaagagaaaaacgcccataattacatgagaatgaggtgtctcatgagtgttaacaagccagtctgtgaagtgatcagttctgcctgttgggctcagtgaaagcttcagagaagatagatgctggaggtacatctggaaggaccaggtgggacatttccaggttgagactggtgggagaaaaacgggatggcgggtggaaggatgaggtggcacagcgaagagtcttccggaggggcctcctgtcagctctctgggaggcgggagagctaagattggaggggctggctgagagcggcctttggtgccccacgaaggcatgttctgagcaggggtagctggaggagggacgtggattcgttgatcaccatctgcatgctgtgcccacctgttgtc

SEQ ID NO: 72272 - DNA, 1014 bp, Homo sapiens
taaaaaccatacctccatgtcagatgtcttttgcccacatctgctagtaactatagatgtgtgttcctagctgtttcagcagatgaacagtggcatctcgtcattctaacttgtgtatcttgcactgtggtaaagctgtcttgtatgttcatagtcatccatgctacatttcgcggtggacttgctccggctgctgtaacgttgggctgtccgtctgctgtctgtttcctggacagcagcctctgtcctgctgtgtctgtcaggagctgtgggcagtggtgtgcatcgggtctgagatggagcctccttgggcctttcttgttctccaagcttccttggccctgggtgccctggcacgctttgcctgcatcagtgctcagctcttccatggggcctgcctgtccaactcgatagtaaggttagcaaggcccaggaggtttcccactcattttctgtattccctaagtgccttatcattttcacctgtaagaggacctcagggaaggagtggattacctttatggagagtgggtgattatagtggaggcatctccattaactttacatgggatagctctttttcaaactaccctcatttaaaaagtctatcaaggcaatctaaacatagactttcctcaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcaggtttgggcatgttttcctttacaactacatattttaaaaatttgacgcttctataaaatatttattgtttactgcaagaaaaatcactttttgattcaaatgttggttagtggattgtataaggaacttgacttttattaacttgctattaaccctattcaaaaaatatacttttggaacagcttacaccaattgaaaaatatgctttaaattacc

SEQ ID NO: 72273 - DNA, 1435 bp, Homo sapiens
gccatgtgaccttgggcactttgcacacctgttttgttccctctccctcttggggtgattatggggcttacgtgagagaacacctggaaaggattagcatggactggagagtgtcacagcagtcggccgcgacagccacttaatgccgctgctgttgggttatgcctgaacttggaaagaaggcccaggaaaaggaagtttgtgttcagccatggggagtttagcctcagattcccacccagtgagccctgtgtcccacgcagccgtctgtccatgctgcctaattcagatgcactctcgtcaatttcattgcagagtaaaaacaaccgtcctctccgtacgagccagatctatgcccaggatgagaatgccacacacacccagctgtacacgagccactttgacttaatgaaaatgactgctggcaagaggagtcccccaatcaaacctctgtatgtttcctgagtgctcattttatgttcattatgactgagtagattgcgtgaagcttggttttgatgtgtttttaacatacccttcttcagatatttcctttatttaataattgctgtctcactgtctatacttcaggcttggcatgaatccctttcagaagaaccccaagcacgcgtctgtgttggcagaaaggtatttctctattcgtgacacatttgttactgtttggaaggatttcattccagtgtcatctaagttcagtgagttcagcaaatcgttgtgcacttagcgtgttcaggcatcagctggacgtggcagtgcgcagaacctgcaggagagaggtgcttttcctgccgtgggctagggtatgcataggacggcccctgccctgtctctgtgttacagggattgtccttgctggccctcagtggggaaagacgctgacagatgtgatgagtgtgccagggccatgtggccaaccacaaggggctttcttcctcacaccccacctctcaggcactgattttgttcgccatatcttaagaacacaccacatttaggggtgtgtgtacctgccctgaagttatacaggggaaaagaggaatgaatgaatggatgggtacagaagtgggtagatgcaagaaagtaaatggggtaatggatggtggaaccccagtgtggaaccttactgccaggcacatgggtgtctgtagcgtttctgactgtcggactctttccataaaatgttggaaaggaggtctgctgggatgaaatgatgtgcatctggtttaggcactgttgtctgtaggctccaaccctacagggtcggtgggtttctccccgtgtgcggagacgagagagcgtagaaataaagacacaagacagagataaaagacagctgggactgggggaccactactaccaagacatggagaccagtagtggccccaaatgccaggctgcactgatatttattgga

SEQ ID NO: 72274 - DNA, 1049 bp, Homo sapiens
aaatggtaacttaagagaaaatgcgggacgggaggctgaggcagtcattttgaagtgagggacaggctgatgtcgagtgctcgctgaaggaacaggaagtgaaaagccttctgtgggaaaaacgggacaggatgcggttactggttcaggagatggagggaagtgaaggtgatgtcccgtgagatcactgacatctgaacgcagcagcatgtgtgatgagcctgcaggtcttgcgggagcttcagaagcgcgggctgacctgtgacttgacatttccctgcggcgtgcagatctctcagttttcctttcctgttgggccactttaaactttgttgatctttgtaaattttctcatggcatgacctcttgtggagaagtatttggaaagacataccgtgtcctgaatttctctggactctcccattatttctactgtttagacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggtgcccgccccagcacaccctcccgtcctgggcttgagcctggtttcacaggcctctctggtggcagtggtcgccagcgacccgtgttctttcctcacacccacccacttgagcgtgccatcacgtgttctagcacaaacgtgccttggcgctttccaggcgcaaggctgggtcctcaattgaactgttaacattctgaaatttccgtcttaatttaagtgtaatttgtgaacccagaaacattttaatgtagttaagggatggcttacttgtctccatagagtttcatagtttgttattttctgtagaggtgagtcagttggaacagagcttggcgtgagcctcaagctcttttcccagtgtgctgactaaggggcttttgctgcctgcaggacagaccgtggtggcccagc

SEQ ID NO: 72275 - DNA, 1060 bp, Homo sapiens
tgcgcatggacaaggatctgcatctcacactcatcattgccgctgatttgctcagaggagtaacctgcctggcaatgatggtaaaggaaatgcctgctgccttaaaaaggagaaataacgcccatgccgcatctccccttaatagaggcaagcagctcttgctggggggtacagcggcctctgctccatttgcttaaaagggggaggtgcaaggaatgaggctctaattaggtgtcttaaaaaattaacacatgaggcgccgatggtcgttgtgggagtcggtctcggtccggcaccccagaactccaactggcagacaggcatgtgtgactgcttcagcgactgtggagtctgcctctgtggcacgttttgtttcccgtgccttgggtgtcaagttgcagctgatatgaatgaatgctgtgtggagcaagcgtcgcaatgaggactctctacaggacgtgatatggcatccctggatctatttgtgatgattatatggcaaccctttgcggtcctccttgtactctttgccaaatcaagagagatatcaacagaaggagagtcatgcgtactttctaaaaactgatggtgaaaagctcctaccgaagcaacaaaattcagcagacacctcttcagcttgagttcttcaccatcttttgcaactgaaatatgatggatatgtttaagtacaactgatggcatgaaaaaaatcaaatgtttgatttattataaatgaacgttgtccctgagcttagctaaatggtgcgacttagtttctccctgctttcatattatcgaatttcctgtcttatagactttttaaattacatttgaaatataaaccaaataaaagattttactgataagaaaaaaaagttaacacatggcagaacaactcagcaacttctagaatgagaaatttagaaaggtttgatgcaactcactcaagtgagttgtttcgagtttggtgaggcgaaggtggctgcctacctgccgctttttgcagctgccttatcacaacactgatcccgttgcgttgatggaagcactgtgaccctgg

SEQ ID NO: 72276 - DNA, 1018 bp, Homo sapiens
aaggcctctgtggggtgggggtgcccactccagggtcagcctggggctctctaaaaggtgcttccttctgcaaattggcttcctgtgccccagccccatggcagccagttcccagaaaggcctgagctgccccccgcagggccggtgctgccacggcccctgctcctggcacgtcgggcccacaatgctgcgtgtcccggcaggctcatcagcacggacgccaccgcgcgaggcatcgacgtgcagggtgtggagctggtggtgaactacgacgccccccagtacctgagaacctacgtgcaccggtgagcgctggcgcagcggccactggggggtctggggctttgtgagctcctgggcgttgatgtgggaccgtcttgactggcgtggggtggggttggtgtggagagaagctgtcgttccgtcagactcttgaaggctcaggggccagtctggagatagctgcgtttgattccagggttgggaggacagctcgcgctgggaaaactggacaggccttcacactgctcctgaaagtgcaggtgaggctgcgagggtcttgggagtttctgctgttggtgggtgttaaggggctggcccaagaacccccttccaccatgagcttctctccaggagaggagattcctccgaatgctaactgaagctggggcacctgagttgcagcggcacgagctctccagcaagctgctgcagccgctggttcctcggtacgaggaggccctgtcccagctggaggagtctgtcaaggtaagggcaccagagtccggcatgaaaccctctggggagggcgtttgcagagagggcgtcgtcaccacacgtggagaaaagagggaaaaagaggaaagcgagaaggcaacagagggtcacacaggttgtcctcgagcttctggcccaagggcggggagcccctgggcaccagtggtggaaacacgtggcaccagggagggctgtcagcggggccagggcctggtttctgcatgcacagggcttcctgtcc

SEQ ID NO: 72277 - DNA, 1127 bp, Homo sapiens
ctggactacgacgacacccgctaccacaccatgcaggcagccgtggatgccgtggcccgggtcactggccagcaccccgaggtgggtgatggggtcctgtcgccagcatcatgctgttgcctcccagggaggcagggactggggggcggcgtccaggcactcaggccaggctccgcaggtgccccccgccttttggaacaatgccttcacgctgctgtctgccgtgagcctgccccgccgggagcccaccgtctccagcttctatgtgaagcgggcgggtgagtgtgctgagagtcaggggcggacagggctgagccttggtctgcctcccctgcgggtcaggtgacctttgccctcgctttccctgcagagctgtgggacacctggaaggttgctcacctgaaggtgagttgcttctggagagccgggcaccctcccgggtttgggggtgtgtgtggggtgcatgtgagaccccatggaggctgccgccttcctcaccagaggaaactcccagggtacaggtggcagcttgcacggccaccaggtcactcgaagtgtgggaggtgacgagacctgtgaactcgggaccctcccttgggtcagaggccaccgccgcctcttggagtcaagcctctggtgccacctgtgggccccgtgggctgttttgggcgcagcccccctcttggccatggtcttgccaaagctgctttcttggctgttctgagactccagcctcgagggcaaggcgtacctgacttgaatggggacaggaagaaggaaggcagggtcagaaaagtggagagcaggcttgtgttggctcaggctgggcttcggggtgccctggcagctgctcgggctctggtctggggtggggagggcggcgagtgcagtctggaccccgttgcaggagcacaggagggttttccaggccatgtggctcagcttcctcaagcacaaggtaggggccaggccggggagggggcgggggcggcatccgggtctcccccagggcggaggcctcaccccgacccgccggcccccgcccacccgcccctcacccccacctgccggcccccgcccagctgcccctcagcctctacaagaaggtgctgctgattgtgcatgac

SEQ ID NO: 72278 - DNA, 1001 bp, Homo sapiens
ccagcatatcgctctgcctggttcaggacgtgctagggagcagtgctggatcttagggaggtggtgataaaatggatactccgcgggccatcccgttccctcctcccttcgagggctctgctgagaaggggagaaggagggttaatctcaagacccctcttggtgactgctgcctgctgcatggttaatagattggccaaaaatattgcttgtctggctgacggacagtatttgctgagcaaatactgctcctcttacatgaactcagctgagcagagaaggaaattaaatgctgtctgagagttggggcaggcgctgtctccccaggactggcatgggcaggaatgctagcaagttgccctgcaccagggccgagacccgcccagcgaggtgtgccccgtgcagcacttactttgggggaccctcatctgctggactttgactcccagaatcaccccatttccaacccctctcacttttccaggggcttgggagcccatggcctgggatcccccagtctcagaagctgagctttgggaaaaggggagatgcctactgcaggcccctgaagcagcaagtcctcttcaagttctcatccaaactctggggactgtagagagccttgggtcagggccggtggccagggaagtggccccagaacaggtgccgcatcgtgtcccgagtgcacagtcagagctggggcttcgtgtcccaagtgcacggacagagctggggctcctgtgggcccaggacggggtgggtggtggccaggctcatcacacaggctggccatcctctgtcctgcacattattagatggctccagggctggcacacgccattgctctgtgctgggacgggatggccctggggctgtcttctgccctctcagtggtgataatgacacagactgtacgtgtactgagcaatactgcaagccaggccctgcgctcggctcctgcactgcagctgagaccacgaggatgcccactttccagagct

SEQ ID NO: 72279 - DNA, 1016 bp, Homo sapiens
tttctgttgtcttcctctaaatctaaatccaaatgacttgcctttccttttattcttttcgttattgtgaggaagtctgtttgtacagagagtgcatggacgggacatatgttggttttgaagaggtgacctcccgggtctgagtgatgcgtcccactcagtgtgttgaccaccatcctgatgcgtcctcatgccccaacctgcggcagccccgcatttccttagggacagagggggcagctgcctgctttcccccacctgccagcaatggtgtggtccgtccttctgggggcccttctagaatccttggcagaccccactggtggccggggcaggctccagccctttgtcacctccctcctggcaaactgccgccctgggccatcttccctggtgccacctcagccctccacccccggcccttatggccacccagaggaatcctgcggaaggcctttggtttgaagggtgagactgcgggccacagccaggtgtgatccgtggtcttccagtaaatcggagctggagggaggaacgtccgagtgcacagcaggactgacctccaggcctggcacgtgacagtggcctcccagtcgggctggtcagagggtgactgggcagcctctttcaccctccaggctcagcccctatcagacggttctccaggcgtggctggactggaaccctgggataaaaccagggccaagcagtagctccactgcagtcctcacaccagcctgccccttacaccatcccccacctccctgcttcaggcctcgagcccgctatccccatgcctgcctgtccccgccccctcctgtccccgccccctaccgtccctgccctctcctgtccccgccccctcctgtccccgccccctcctgtcctcaccctctcctgtccccgccccctcctgttctcaccctctcctgtccccgccctctcctgtccacctgccgtgccccctgcattcacacccgtcctggcaccactccatcccaggcagcactgctgtt

SEQ ID NO: 72280 - DNA, 1310 bp, Homo sapiens
gtcccaaatccacagacccgtctgggagcactggccagaacccctcaggccctctggaatatggtgtcacctgggggagcacttcctgtgggctgtcacctgggggagcacttcttgtggggcctgggtgtcccctggagaggctcctgtggtccctggcccccactgcagggcactcgctcttgaaaggtagccctggtctcagcagggaggggcagtcctgggcagccctgggctggcctcctgtgaagcttactggagactccctgctggactaagctttttctcgtctggccccttcgatggctgagccctgggaaactcccatcccccatcccgcagcagcatctcacctgccatcgtccttcccctcccatcccccgtcccacagcagccatcttcctttccctctgaggtgcccctcccaagtggggaggctccttcccaagagctgctcaggtgggtgctgtcctgggcccaaggccctggggtcccgccaattaactggcgtttccctgtctccctgcagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcaggtgagcaggtccctccccgaccggaagctctgcggcgggtcagtgctcaccgccccagggccatgccagcacctggacaccacgccacgtggcccccgggcctgcctggcagcgcgcccatcgttgtcaggcttggggtgcaggacacgtggacagggctggggcctagcagaggcaggagccggctgggtcacggaggggccgtgacgtgcccagggccacagcaggagaggtgcctgtctggggcagcaaggcgcgcgttccgggctggggcgccaagctgataggccggccccgtttccctgccgtgtccatcaggctccgccgactacaggtgtccagagtgtctataaggagggggtccaggctcattgccgagggctgtcctgtccacacgcagcgccatccgctcacgtgtgcggcgtggggaagggaatacttggtcccggcagtggctgcaggcacgtgactgtggtcagtggtcaggtgcgtggcccagctgggaacagggctctgcctgccctgcccaggggcctcctgcccaggaggggctgtcagagcaggtgggggcttccccagcgcg

SEQ ID NO: 72281 - DNA, 3226 bp, Homo sapiens
atgcaggtgtgctccccagaaggggggccgctcccagccagccactgggaccagaacggcccggcccagcgccagcaacagctccagcccagccagtccagccagccccaggggtccctcccagccccgtcggcactcccggaccctgggcagccctgccagccctcccagcggccactcctgggtcagcgcagctggccccagcggtcacttctgggcctgaaacagccctgccagccccggcggtcacttctgggccccggtcagccctgccggccccagcggctccttccatccccagatcagctctgccagccccagcggtcacgcccggcccagccctgccggccgcattgggcactcccaggccccaggcagtgctgcaggcgcctgcggtccctgctgaccccgtgtcaccactgccggcgcctgcggtccctcctggccccacggtccctcctggtcccctgcctctactgccggcgcctgcggttcctcctggccccaaggcaccgctgcaggcgcctgcggtccctgctgaccctgtggcaccgctgccgacccctgcggccgtgggccagcccgtgtcactgtggccagcccggtagggcatcctcaggacagcgcagccggcccctgtggtcgctgctagcccagtgccagcggtaccagcccccgcggccactcctcaccctccgaccacgccgacggcccgccagcttcctcccaggacagtgctgctgcccccggcgggccttcctagccccgtgtcagtacggccagccccgaaggtccctgctgggccagcccagccgcccccggcggtcgctgctgcgccccaggcagccccagcggttagtggaagccccagagcagcccggcccactcacgccttcactcctgggcccgggacggccgaggcagcagaagcagccgctcatgggcccggagcagccctgcccacccaagcggccgctcatgggcccagagcagccctgccagcccctgcggccgctcatgggccccaacaagccctgcaaaccccagccgttgctccccattcccgatcgcccttcactcctggggcagccgggcccaccctgccggcctctcctggggctcctgtgccagccgcggcggtccctattggatctggtgccggcccgtcagccccggctctcgctcctggccctgggccatccctgccggcccctgcggtcccggtggacccgatcctgtgcccccgggatggcccgtcaggccccatctgtgagccctggagcctgatgcctgcaggcacctccccatatgggttttccagcccactccagtgtgatctgcaccctggcagggccccaagggccaaggccgcattgcccttcgggctggagatgctttgccggactagcctgaggccttgtctagacagggctgagctgtttgtcgttggaaattgaggctcggccagaggcgggagcccctacagtgccacgatcaggctgaggctcaccacaccaggaagagagatgaacccgcgtctgcctgccgccccgccatgctccctctccccccactggcgtcacagtgcccccacccgcgttgctgcctgtggtgtgcgtgccctgggaggggaacacagcccctgagggcggggaccttgctgggggcccctcagcgtctttctgtgcctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcaggaggtgctggtgtccacctccagggcccccaagctacagggggcacatgggcccatctggtgggtcaggacctgcaggggacccggaggctcccacccccacctctcaggactctgcctccaccacccccgtgggcatgcactgaagggttgcctgcagggtctccaggcgagggggaccccacagggtgggcagcgccttctcccggcttccccacagtcccctgcagcgtcccgtctggctgttgacctacatgtggtcgggcacacctcacactacaaggctacccctgggcccatccctgccccttccacggcccccacctgtggtcaggtgttgccaccccctcaggacctggtctcaaggcagccccactcgagtcttctggagtccaaggcacgccactcgcccaaaagggagggggtgtttgggggggctttgactgtctccagacctcaggggagctgggcaggctctaaccagtggtcctccagagagcagcgttgaccacctggacccctgcgccacgtgacaggaggctctggtcctgcaggcctggtcttgcccagctgggctgcctcaggtgtcaggaaggggatgggtgtccctggctcccaggccaggcagctgctgacctccagcaccccgcacttgctcatgaggaccccacccccgcaggccctcccgggtcctgaccagcctctggtgcagcatctgctttggcctccgggccccctcgctccccacccacccgggccccttcctccggtgctcacctggggcctccatcccagaagcgcagggcttatttttctgattaaagaaaataaaaagtgccgtgccactattttttataacagcatcagcgtttgtaatttaaacagacgagcatgtgtcttacgtgatttattcccacaaagggcttttgtgctgggcttggctcgggattcattgcactctgaccgaacagaggggagacctggagcatctgttcctgaccttcctgcccacccatctgaggcctggaatgggggtttgtactgtgctcagcatgggggcaccggcctccagatccccccaccgcaaggctactgtgtgggccagtgtgacaggggtcgagacccccctctcggctcatgcctggggggcacccatccccgggatcagtgtcctggggactggtgagggagggtggttcagctcagagtcctctgcatggcctgggcacgcgtgagggagcatggttcagcccagcatcctctgcacagcctgtcaggtgcttgtgttctgct

SEQ ID NO: 72282 - DNA, 1052 bp, Homo sapiens
gtgtccgggggagcgggtgtgtttcagtgtgtgctgtgcctccccgtgggtgcacgggtgtgtttcagtgtgtgcctgagagaagcaggtgtgtttcagtgtgtgccgtgcctccctgtgggtgcacgggtgtgtttcagggtgtgcccgggggaagcaggtgtgtttcagtgtgtgccgtgcctccccgtgggtacacgggtgtgtttcagggtgtgccatgcctccccgtgggtgcacatggcacggtggagggctccttgcacatgtgcctggacttgctgtgggaatggcctgggaggctgggcgccgacccctgccccccggacctggaggcccagcaccatctccccggcccccatcaccactgtcccctgccctcctcatgactgtgtttcattttcccttaagtatcaggaggaacattaatgacaacataaaacccagagctccataaaagccatttctacagattgacggcctgctgggctcgtgggagggtgggggcctggactctgcccaccccatccctgcagcccccgaaatttccaggccgtagaggctccctcactaaaccacagcagctttttatagggtgtgtaattaaaccaggaatgacccagtgtggccaggccagaggggacacagcctggtggggacggccccccactgtctctgtcccacagcttctgctggtggcagagcaggaagcggcaagggagcggcatgggcggcgcggccacaggccaggagtggaccccaggatccctggacccagcctcatgggcaggaattggccacttggctgggtcacagcaggggctcagccaggccctttgcacccccaccccagctcccctgaggctgccctttcacctgaggttctgtctaaagccctgggctcagctctaccatcctgggctcttctctgccaccctgggctcggctctgccaccctgggctcttctctgccaccctgggctctgccaccctgggctcttctctgccaccctaagctctgccaccctgggcttggctctgccaccctgggc

SEQ ID NO: 72283 - DNA, 1033 bp, Homo sapiens
aaatgggctaaggccacctggctccggctgctgggaggcacctgggtcaagtggggtgtcctgatgcagactccatgggcaggaggactgtggcccccacataggtgccagactgtgagtgtcagtgacatctccgagtgctgggcaggactcctgtcggctcactgtgggtcagggggagggccgggtcttaagctctggaaggtgggctctgccccctgttgctggtgaggtgtgcacgtggccacctcctgtggccaccccagctggtctgaggtccccagggcacctgggtctctctgccctgagccactgggtgcccttctgcttctgggtctccactcattattcaagtcttctccccagagcactctgtgtttcctgagaaagcccgttattaacttgccagctgcttgcagcttaacccccacagccgaggcacacaagtgacagatggcggggtggggggtggggctggggggtggggggagggggaaggggggaggggctggcctgctgcactggggatggggttcccctccaagccgcaggagcctgggaggaccctgagggctgcagagggtcctgtgcgtgtgcactgggccccagcacacacatacctgtttcagaccctggtgcatacagatgggccctgccatgtgcaggtgtgcacccggggccttggtccagtgtggccctcagttgcccatgctgtcagccctgcgggccccttgtgtccagtgtgggggggggggtgcaggtgagagcccggggtgcaggtgagagcccaggctccaggcagagagcagggaggtgcctggcctccttggaagtgctcttccccggcactgaggactggaggcaggtggaggccagaccaccccaggggtggaggaccaagaaccggtcccatgggacgcatgcccaggagcaggacaggacccaggagcaggacaggacccaggagcaggacaggacccaggagcaggcgaggggcccaggcgagggtctggattgtgctgaagcctgggac

SEQ ID NO: 72284 - DNA, 1039 bp, Homo sapiens
acagcccccccaggcccttcctgtccccactggcaaggtcctccatcagggtcacagatgcccaccctgcacaaactgaggtgtggagaaatccgtccccttgcctcccctccagcccatgtgtgctgagcgtgtccatggccgggcatgcacacagggagaaagatgggaaagacctgggtaagggaagccaaggagtcgctgtcccaggcggggtgttaagcgcagtgcaggagggtgggagggggggccaggccagccgaagcaggcataggtttgaacagaggggccggtgagaggccctgaggcccctgaggaaggagcccaccccgtgtgcttgggggcatgcctgggacagggaggctggaggtgggtgggaggagcagagacccagccaggtgggacactgcagatgcccaccagccgctggggtcccgctgccctcgctctgtgccagggcccgatacaggcgctgtctttacaaggcaggtttgtgacactcattacggggctccttgggcctcttctgagcagccacaacttgtacagaagcaataaaaacccatcagcctctccctggagtcagagagccacggtctcctcccaacccagcctctccctggagtcagagagctgcagtctcctcccgacccagcctctccctggagtcagagagctgcagtctcctcccgacccagcctctccctggagtcagagagccacagtctcctcccgacccagccacagtctcctcccgacccagcctctccctggagtcagagagcctcagtctcctcctgacccagcctctccctggagtcagagagcctcagtctcctcccgacccagcctctccctggagtcagagagccacagtctcctcccgacccagcctctccctggagtcagagagcctcagtctcctcccgacccagcctctccctgtagtcagagagccacagtctcctcccgacccagcctctccctggagtcagagagccacagtctcctcccaacctctgagcatagaagggtcttt

SEQ ID NO: 72285 - DNA, 1019 bp, Homo sapiens
ctgcactgtgctcactggggtctcctggggatggtggctgggctgggtggagggttcagggtggctttgctgacgtgcctggcttctgggccttggtggctcaaggcccaggcagctgtggccagcccttgcagagccttagccaggctggcagcaccattccagcacattctgcaggtcagagccccccagcccagcccaggttctaggggaggggttggaccctggcctggaggggcctcatgagtgccgcctttcaccccacccacagctccctgcagcgctcccaggtatgggggccacagccatccaccaggcaggacagccccacagggcagggagatgcctgaccaaggagggtggcacaggcagtgaaggtggcggcgcacagccctgctggagagggccaggccagagtctggggtgcccatcaagctgaaatccaattatgagaacaggccgggctgctgtgacacgggggttaggaattaatgttaacactgtttctggttaagactttttgtgttgataaataattcatgaggcagttagcactttgagcctgacaacacgagaatatattaatacggtcggctccaagaaaggtcagccacgtgcttggggccagggggccatcttttattcattccctgacacaggctcattaattattctggcccagccggagctgtgctcggagggacactaatgagaaaaaggagagtggatttgagatccacacgccatccgctgtggggacgtagagggagagatggaaagaaacactggtgaggcctctgaggcgggatggggcctgcagcctggctccctgacagtgctggttgggtgtgaagaggtgagcggagctgatccgcaggtgtgtggggcactggctgccacatcccagctctcccagagagatgaggaacaggagcagatgcagccagtatcagagagcaggaggtgcatggggaagtgaggctgaggctgtgggtgccccaagcacactaggcccagcg

SEQ ID NO: 72286 - DNA, 1055 bp, Homo sapiens
ccatgccttcccatgatggcaccccctggccacccgctgcgtaacgatggcagacgcagttacagtgttggtttctgaaccgtaagctctggataaatgtgcctctgaacaccaccgtcaagtccctaactggattatgtatatttggcctggaagcctgatacttaatatcagcctgctctccggtgaatgcctttcttcccccggataatctattcccactccgcttccttctagacttctaacctcactacatctttcatatcagagctactctcctttctaaacaaaacacagacctgcccctggttctgagtctagtttcacccccaaactggggcgcagggctgtggggcggggctcggggctcggggctgggttttcggccccgttgacccaggccaggatctctgcctgttccaggatggtcagtgctgaaggcggcctcaggactgaggttagaaagtggggttggaagcctcgtttgtggcaggaagatggcttctcctgtgattccagtggtgaggtcccaagagaggagccggccacattgagactggccgtagcccaattggagctggccagttgctgcccctcaattccttcttcctgctcccccaactccccagccccctggggtctccagtcagcagggagagtgggcacagcttggcgggaccgaggcctgctgggcagccgcttcccgtgccctgtacccagagaaggagctgatggcagcacagcttctcagggggctgaggatgcactggatccatctgtgccgagtccccagagcagggcctggaagaggggactggggatggcatcctcccagggccaggcacgcaggaaggggctgagctagggttctgcctgagtctgtcttctctcctcccctccccccgcccgttccctctctgtgggcctcaccatctggaccccccatggacagaaatgacctcgtcacagggccccttcacggcctttgtcctcacggcccctcctggctggctttgcccaggccagcaccctgggcctgaccttaaccctgactt

SEQ ID NO: 72287 - DNA, 1115 bp, Homo sapiens
agcaccagctccacgcggccatgtttgccgcacccccgacactgcccccgcccccggcgctgccggccagcagcctggtcctcccaggacacccggccggtaggtgtctcggccacaatctcgcccagggcaggggttggggggtgcggggacacggccaccggggaggggcgcacagcctggccctccacctgctgtggtctctgcggaccctgcgcgcctctctgagtggttcccccaggtgtgcctttccccaggagtctctgctgggccacaggccatctgtgtgcggggacaggcaggacacgtgcccatgcacgtacagacgcgtgttcacactgagacgggcgcacgggcctcccctcctggggccaggcctcccccgcagcctgctgggtcctgagccctgggaggagggggccgcacatcaagcaggcgccatcccagtggaaccccgaccgcgaaggcttcctccctcggcccccaggcgcttcctgaggctccgagtcagcccggcccaggctggggacggccccgtgtcccgggatgggaccaggatgctggcctgcgggtggctggaccctggctcccggggaggggctcaccgtgttctctcttgcctctagatgccagcctggcggtctcattcagccagccaatcatgtattgccagcctcattcgggaattctgattggtacttggtcacaggctcctctcttacctgcacccctgggcccgcacgtggcgagcggccaccccggcttggcctgccgaccccgggagtgccaggtgactatccgcctcgccccgccgggagcccgcggccaacgtgcctctctgtctctctctctttttctcttgtagatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccggtgcgtaggcccgcgtgctggcagggggcggg

SEQ ID NO: 72288 - DNA, 1328 bp, Homo sapiens
ccacagaggagggcagatcctgcaagaggccggcggtccagggagagggcgcacacagggtctgcccagccctcacgcctgcccccacgtagtgccagagtaccccagcatcatcatggccagtgaaaccaccccagtgccagagcacactgcagggaccaggaggggccggcccaggccagcctgagtgcgggtcagaggcaggacaggcagaggcagcgcagtcaccaggacagtggggtcttgtttggctacacccctcctggctctgggcccctctgctcccatgggagggcatgggcatccccagtctccacccaagcctggccctgcctcccacagccgcctggcagcgtgggcacctgaagtgtggccagtgcaggtgaggggcacatgttgtagtttcatataatttttaacacatttaactttgaaaactgataccaaattcagtcactgagaaacttttcagcatatttggaacaacttgggcacgtgagcatgctttttcagtttctttttttttttcttgagatagagtctcgctctgtcacccaggctagagtgcagtggcatgatctcggctcactgtaacctccacctcccggcttcaagtgattctcctgtctcagcctcctgagcagctgggattacaggcgcccgccactgcgcccagctaatttttgtatttttagtaaagacggggtttcgccatgttggccaggctggtctcgaactcctgacctcaggtgatccgcccgtatcagcctcccaaagtgctgggattacaggcgtgagccaccgtgcctggccttaacttttaaaagaatctaaatacaaaaaaagtaagttattttccatgacagcgtagcatcccagctgccatgtgccaagtacgtaccacagttcagaggacgtgagctctcccgttcagcttttttgctgatcatgtgtaacatttccgtcatcctgagtagagaatacacccttgaaatccatcccacctgctccccttactggactggctcacacccagtccctgtggcccctcaggcctgggctccctgtgttcagggccagtccccgggcaggcggccctcacccgttctatcctcccaggagatgcagctggacccccacaagctggaggtgggtgcaaagctggacctgttcggcagaccccctgccccgggcgtgtttgcaggcttccactacccacaggacctggcccggcccctcttccccagcacaggtgagactggagtcgggccaggtggggggcacagaaacctcccgctcgtgcccagctgagcctgccttcctgtgcc

SEQ ID NO: 72289 - DNA, 1165 bp, Homo sapiens
tctacagattccaagaacactgcaccatccacacaaacgtccacagcatcgcccttgcggctggagccggccagtcctgaagcccacaggagccgcccaggagtgctgttctgctggcccaggggctctgctgggggacccaacccctccacggacccaggggctgggaggtcgctggcggaaccttcctcccccaaccagcagagccgccgggaagcgcttgcatagttgaaggaaagttgctgccattaaacttctgataatgtttacagccagcagcgcctgggtttttgtgaccatgttagacaaacaaccagaggggtttctggaaacggtttttataaagtctatctagattaagaatttagtaacgtcatatatttatatcaacagactatttacacgtttcgtttgcttttaaaaaaacaaaccaaaaaagaaattacacttctgcataataaggcaaaaaaacaaagttttgtacattattattttaatataatctgtaacttcggttccaagtaccaagggggggccagggctggcctgagtgggggcctcacagtgcgctggacaaagtgaccggtttttctccataaataagacaaagaaaccctggggatctggagaaggatctgaggccattaaactgcaaatcccaaccgaaaacgaagaagcaaaagtttcttttttggttcttttaaacgtctaaagagcataaaattaagaaaaatacaaatccattacaaacacttctcatctgtggggggaaaaggtacaaacgcgatttttttttcccaacagccgaatcccaaactcggaaaacaaaagatcaccctcagaaaagccgacacccaagtccccgcctccgcaggctgcgggtggagaggcggcgccgccccaggatcggcgggagctgtgcttgagttctaggaactgatggagagacggacagcggtgcgctccgctcggagaggcgtctgcggccccggggctaccgcgcctccacctccgggggatttcgggacggggagtagtcgcgcgcctcgcccggcccgaggccccccagcggagtagtccggctccgcggcggcccggggggcgtggggggcccggccgccgtcaccagggggggcggtgcgccgagggcggcggcggcgggcgg

SEQ ID NO: 72290 - DNA, 1047 bp, Homo sapiens
ccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtcccccagcagagcccctgggccagcagaacagcactcctgggcggctcctgtgggcttcaggactggccggctccagccgcaagggcgatgctgtggacgtttgtgtggatggtgcagtgttcttggaat

SEQ ID NO: 72291 - DNA, 1034 bp, Homo sapiens
tttacacacacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaactgtggtcgcgtgttctgtggtgttggggggccaggctcacccaggctgacccctgcagccgtgcgtccctcctgcagcaccttgggatgctgggcgcctcggcggccccacgctgtccggtgccatcgccccggaagtgaagcacagcaggtcccagcttcccagccctgctgccaccccggctctgcccagccccctcccccagtgccacctctcccggtggaaaccccagctcctggctctgccggatgccccattgtgctccttcgttcttgggggtgtcacgcggcctcccgtcgtcccacccccagcgaccccgctggccgccttccctcacatccacggggttttctgcatagaaggtgctcttagttcccgcctttgtgccagagagttctggccccgcagggacttgtgggattggctttgccctggctgtgcccgaaggaacaggagctcagagggcaggagccaggtgcagaggtggcagcccccaccctccagtgcagtgagcgccaggcccacctgccttgagtgatggtcaggaaagctccaggtgcacacctggccttgacctgagtgtcacccccaccctgtccctgccaattcactcctcactaaggggccccagggctgcaacctaagaaggaggcctcgtggg

SEQ ID NO: 72292 - DNA, 1510 bp, Homo sapiens
gcactgaggggcccatggggcagctcaggggtactggtgggcgtccagtgtctgaggcacaaggggtgccagcagccagccccatggccagtgtcaataattcagcaagcgccacaccggatgggttgcgctgatcgcatttcttttcctctgcctgagcggggccagctggtcaggagggaggagggactggtcccctgtaccccaggccctctctgtgcaggtgggagcccaccctggccccaccctgcctgcgcttgccctgccttgtgtgcgagctctgtgaagctctccccagccttctccacgataaagcccagcttgaagatggggcagtagaggtcggaggcctcgtggaacgtgcagcgcttcaggtacccgtctgtgcggtcggcgatgttgcccctgaggaggcggcaggaggcgagacctgcaccccaaataccccattcccagaaggcagccctcaggctgggccgtcaccacaccccgcggctcttacttggagaagtggaatttggggtagtggatgctgttcttgatgaggatggtgaaatttggggccatcgtacccagaaattggctgaggaggcacagaagggttgtttagtcccctcttcccgcaaagcccccgcctggcattggcccccacccctccccagatcttgtcactcctgccccgcccgtttggcctctggtcaggggaaaaggatcagaggggaggctgggccccaggccggggcgcaggtgcacctgacagaggccccatcttccaccgggcaccagccgaacacctcgcaggtcttggagggcccctggtaatagggcacacagcgcccagtcctcaggcctgggaggcagaggtcactgaggcattagcggggacgcagccctgccccacccgcccagccccagctggcgcacaccgaccgtttcccagcatgtccagctccccagccacgcagtcggcgtcggagaggcaggtggcgttgtggacccttatgctctagggtggaggcggcccagtcagggaccccgcaagggacagctggcccgcctagctgaggcggggtcccccagcgccgcgggatcccctcacctcggggcaggttccctgggtctgggagtgggtggcctcgaccctggtgatgatgctgaacacgctgcccccctgggctcagaaagagggggcggtcggccaggcggcagccgctgccccctccgcccactagggtagggtgcacggcggggcggggggcagggggcggcccgcacctcggggggcttcacgtactcctccacgtcccacactttgtgctcggacgtggtgatccccttgaccttggtgatgatggagctctcggggcccgtctcgctctcctggtagcttttctgcacgatgaatacgtacctgcgggcaggggcggcgccggctccggaggcgaccctgggaaggctgagtcccgcccgcaggcacggcaggggccctcccgcgacccgggtccgctct

SEQ ID NO: 72293 - DNA, 1042 bp, Homo sapiens
cagtggctcatgcctgtaatcccagcactttagggggctgaggcgggtggatcacgtgaggtcaagagtttgagaccagcctggccaacatggtgaaaccccatctctactaaaaatacaaaaagtagccaggtgtggtgcgcacacctttaataccagctactcaggaagctgaggcaggagaatcacttgaacccaggaggcggaggttgcagtgagctgagattgcgccattgcactacagtctgggcaacaagaatgaaactgtgtctcaaaaaaaaaaaaaaaaaagggtaagtgccaggtgacaggcccggagtagtttttggagaagcttgctgatgccaggggccctgcctttgcttgtgttgggagctgtctttcacgcgctacccagtgagaggcttagtgtacatggccccatttatacagttttctctctgacaatgaactcaggtgtcagcgagtgttccttctcatttccacttctcacttctctaatttacttttagctcatctaaaggctgcagataaaattattaacaatgacattttagcctcatctgtgaggcaatctgaccagccatgggtcccctcagattctagggtgtttgcagcagcccgactcagggcctgtggtgtgtgtgcctctccacagcgtacatcgtggccgtgtaccactgcatgaaggacgggctgaggcgcagtgctccagggagcacccccgtgaggaggaggggggccagccagctctcccaggaggccgagggggcggtcggagcccttcccggtgagcagtcttttgtcttttgaggccactgccatgtgccagtgacctaactcctctgtgtgccatgggtggtccccggtgccagtcccccaggtgggaggtccccagtgccagacaggtcccagacccctccctcagcatccttatacttccaggaatgatcaccttctctcaggattatgtcgcaaatgagctcactcagagcttcttcaccatcactcagaagattcagaagaaagtcacaggctctcg

SEQ ID NO: 72294 - DNA, 1029 bp, Homo sapiens
cggatgtgtgtaaatgcccaggtgcgggccaggctgtgggtgagtggaggtggctgtcgggagcagtctggggaaggggtcacgtctggctggggctcatggtgtttgcaaggttgagacgtgggtggtcagctggtgcaggagtggccagagagtggctgggtgggttgagaggaggcctgtgtcctccacaggggccctcatagtggactgagaggaagctgtgggtaccagagccaggggctcagatgtcagagggaaagccctttgtaaggacgcagacgcttctgggagctggcaggatgaagccaagactgcccaggacacctggatgggagcgattctggttggagttgggggataaaccctgattgaagggattcagaacaaagtgggagggtagaaactcaggcagtgtagaccgctctgaggaggggatcagcgtgtggtcagggcaggtggcagtgggtgtcggtgtctacacagacgtggatggtgccgtggcacgaacacaggctgcgcgggaggctgggtctgtgatggggtcgtgccgtcccaggagattcatggactcagaggagagaacagtcaccgggaagctctggctggttctttcgtccttggggggtgggagttcaacaattaaagtgaactctggaagagcagagtgaagctcacagtcccaggtcacgagcacttctgtgtgccaggcgcttcccacaaagcactttgtactgggagccaccctgggggattcacgcaggctccaggggatgccttgactgcgaggaaggcctctggtcaaacggggcagatggacccaggttggaggagccttcgctgtggcatcctacccctctaccaggccgcgatggtgcaaacacagccgcgttgtctcatgtgttacagcaagactcccagaaagcagggggagcagaggatgagcaggaaaatgaggacgatgaggaggaaagagatggggaggaggaggaagaggcggaggaatccaacgtggaggatttactggaa

SEQ ID NO: 72295 - DNA, 1013 bp, Homo sapiens
tccttaaatggatctaatgtgcagaggattgggtcagcgctagggaggcttaaccgaggagtgacaaggatgacgatagcttaaaagagcttggcagtgggaagcactgtggttggttaccagcaggtgcaggtcacctaaggccgcagagcagaggcagaacaccctgtgggccatccccagcacgaggaggcacccagctctctttgtggcgccagctcccaggggcctggtgggcctccttagttttacgtttaccacatttccccaggaagcctgagggatgatgtggtctgaatgaactttcaaattcagtgttaagtaagtggagggtacagatagatacaaggggaaataaaggaaagttgagaacaaggtcgatttcactgaagcagcgtcttcaatgcttcctctgcagcatccattcaaaggagaccttccattctctgacaatttctttctctcgatgctgggaatttcttctctggatggatccatctaactatggcggaatcaaaggaaaagtttcatctcgtattcactgtggactggtaagcgagctgcagtgtggcacccgagccagctttgggggtcgcgttcattcctgcagcaagtgctgagtgctcagggccccggcgggcctggccgtgagcagcagacactgcacccgcatcctgccctcatgaacacggggagggaccatgcgcagacaagcacgtcagtgtggagtgtggcgtcagccctggtgatggcaaggcttgccgtgggcaacagggaggtggaggcccatgaggtggtgacagggaatccgagagctgatgaagtgcaccatagttgtgcgagcataaggcgcctccagcggatggacaccagggaggcaaagcacaagtcagtggagcagtggttgcagatgcaggcagagagctgacagagccaggcaacttgggcatggcagggcagggcctcggctttcgtggggatgggagcttctgtgtgggtgatgttggagcttt

SEQ ID NO: 72296 - DNA, 2246 bp, Homo sapiens
ggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcaggtatagaccttgatccaaggggagggcagtggctctgctgatggcccagggagggggtgtccagctgggccctgaggtctgggatgggagggttagagtgggcctggagtttcctgcccatcgtagggaggcctaaggccctgtgctgggagctgcaagctacctggaaggtggccccgtctgtgggttccagtgtgtcctgtgatgtgctgtatgtccgtgtggcctttcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtagggaggagctggtgctgcctctgcagtcatctgggcagcctgaggtggctttcccatgatctagcctggcctccagcctccatctcctcagtaccttatggggatgttctaggaattcctcaaaacaacgtgtgtgagcgctgagcaccgagcctggggcagagcgagtgccgggaatggagctgctggtgtccttgtcacgatgagcttgtctgcccgcgaggtccatgttgcggggacaaaccaagtggcattggttagagattgtgaactctgtctccgtaggctctttggttgttaacagctttattgggatgtaaagttacgccatccaactcacccatttaaagtgcagaattcaatgacttttagtggcatgactattgccagtcaatagtgacattttctttttttttcttttttttaattttactttgatttctgggatccatgtgcagaaagtgcaggtttgttacataagtaagcacatgccatggtggtttgctgcacccatcaccccgtcacctgggcattaggccccacatgcattagctgtttatcctgatattccccctcccctcacccccccattcggatattttcatcactccaaaaagaaacctggcatcccttacctgtcaccatcctcccccagccctcagtagccactgatccacttcctgtctctgggtttgcctgtttgggcatttgatgtaaatggaaccctacagtaggtgggtctttgtgctgggcttcttccacctgcagaaactgcgagggttttcatgtggccatgagtgcgctgaggctcttagatggcatctccacccgaactccccgttgttaatgtgtcggctcagcacatttcttgactggatgctgtgaatcacgtaagaagtgacacgtagttggggagatgaggtgtgcatatttgtacctacacaaggaggttttctggagaaggtgaaactcgattccagccaggtgattcagtagaatgtgcatatagaaagtagacgcagagccaggtgtggtggttcacacctgtaatccccgcactttgggagaccgaggtgggcggataacaagaggaaagcggacgcagaggcatcgagaccacagagaacaggtgggactgtggggtttctacaccttcctttcgatgcgtggtgctgtggtgctgtggccgtgtggaagtgccctaacttttgggatgtttccctttatgactatcagctcatctcgagggaggttctggcgctgtgtgaatattctgtcctcaacgtttgactggatggtgtcagcatccatgtctcgtggggtccatggggctccaggatgatatcttcagattctgttcctctgtgtgtattagctgtttcctttataacgaagagctttgtgcagatcaggtagaaatgaactctattccttaaaaagcaagatacgagagggataatacgctttttttttttttaagcaagataaatgctttttccctttaaattatttttaattttcaaggtagggcatggcaaaatgggtttattcctttcatttttcctctctttttaaagtattactatggattagaggatttttgtttaacttttttgtttctgtttttgagaaggtctctcactccatcacccaggctggagtgcagtggcatgatcttgcctcactgcagccttgtactcttgggctcaag

SEQ ID NO: 72297 - DNA, 1309 bp, Homo sapiens
gcactttctccggaaatggctcaagagctcttcccttcaagactttgatattcgagcagtgagtgccagttgcgttctctactcttaaaagtttacaaggaaagctagacagagcagaatatgtctgagttggattatgttttttgtctggcgtcttcactcttgacttcctcctttctgataagtaataggtgagcacctaataaccttttagggcaaaactgaaaacatgaagtgcctggggccctttagctgttctattggatggactaaggccaggggtgttggctcagccacctactagctctgtgatctagaggagtcagtgaagctccctgccttggtgtcctctgttgtgcaatgggcacctttcatcatagagtttctgagaggattaaataagacacagtggttagccctgtgctcagcatgaagtgagccccactcttggctgctgccacctgctgttctctgtgcccgtttcctgcacatgcagattctggattgggactactacattgagcggctgggaagcgccatccagaagatcatcaccatccctgcggccctgcagcaggtaagggcggggtcagtggcacgggctgtggggctaaaaactgtgcagttagacaagggtctctctctgatgggtgttggcctcacacaggtaaagaacccagtgccacgtgtcaaacaccccgactggctgcacaaaaaactgctggagaagaatgatgtctacaagcagaagaagatcagtgagctcttcaccctggagggcaggagacaggtgacggtggggccccaaggctgggctgggcgggatccttgtgacacacaggactccaggcttcttgcgctgctgtgtgtgctgtagtgaagcttctgttcaagcatcgaaaatggactttttctgaaaatgtgcccattggcactttactctctaactctgagtgtcactcttttgttaataggacaccattgtgaggctgaggtgagggcaaggaactgtctccttatgtgaaaatattagggtgcactacttagactcagtgccttgggcaaatcactgtctcttgaagccccagttttctgaatgtgaaatgaatatcttccctatggaaacacttagaaacacaggacacagtgtaataaaaggtacagtgaaagtcagaagagcaaaaggaaaattcttaaatgctgaaaattaaaagtaagctataaatcagagcagtatacaaactcacatgacaagaacaaggttctttgaccaggtgcggtggctcacacctgtaatcccagcactttg

SEQ ID NO: 72298 - DNA, 1507 bp, Homo sapiens
cgtacagccctgtgggtttggacaagtgcatagtgtgtgtgtccagcaccacgaagcaacacaaaacagctgcaacccctttgtcagcaaatcctctccctaccccgaaaccctggcaacccacaatgtgttttttgtactataattttgctttgtcgaaaatgtcatgtaaagggaagcatacggcctgtagcattttgggtctggcttcttggacctaacagatacacctgagtttcaccacttggttgcatgcatcagaacttccttccttcctgctgccaagtcgtgttagttatgtggaaaagcctcggtttgtcaatccatccactcctggagggacaccaggtggtttccaggtttgggccatcatgagtgaagctgccccctcttcactcttgtttctcaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtgggactctcatagcttttgtgctttagaaaggacatggattgagatagattaaatttagcccagaaaggaggttggatcaggagccaggatagaaacagacctgggttcttgtgatcttactgattccgtttgcaccagctctgtctgcccgcctgctgtattctggctctgtggctgcaggcccttcagccattttccttttagagaagcagtggcctaagggagagagacgtttgctgcctcgtggatgacaggtggagggttggaaagggaagaggcgggcagagaggatgaggcacagctggtggctccccagcgctccttgccactgctgtgcttgccttttttttttttttcaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggtaaaggcctaccctccaccctcacctgctctgagggatgaaggatgaagcaagaaggggaccccgtgcttcctgggctcctggagaccaaggtgaccgaagaacacagggccagtcctaatgaaatcccaagacctcctgagcacaattacccccttggagttcccctcaacttctgcatccagggacacaactctgagggaaacgtttttctaaatagcgtgataagcctggcatggtgatgcgtgcctgtggtcccagctacttgggaggatcacttgagaccaggaagtagaggccacagtgagccgtgactgcaccactgcactccagcctgggatatttgtttatttctatgttactttgtattttttatattttt

SEQ ID NO: 72299 - DNA, 1040 bp, Homo sapiens
cacacgcatcgtgttggtttgtggtggtgtgggagtgtgggtgtgttgtggggacggcttagtctcctgcctgaggggcttctgcaggccttactgtggcgctcctgtgccccctcccatacggctcttcagtcgtaaatacacacccagtggggaggatataagcgtccctggaggagggctgtcagagtttctggacctgtattagagccatcacagcagcaaatagatatcgtggagcaggtgcttcgagacagtgtatccacagctgctccataagcttctgcccactgtgttagcgttgctgatgggctgtgtttgctggtgggccgcacctgcagcagttacgcctgaggtttcctgtcgtggtttttctctggcgattgtctgtttccttcattccttctactgtatcaattgggatcctgtagggaagcgttgctatccttctcttccatttgttctcgtttatttgtctgcttattgacatcagtgtggatttgcggatcagagtggacatcccagggttattgttcataggaccggagtggcttcctgctccacgtgttccccttgggccactggggcctcctagtttgtggcgtgttcttgggacacgccctcttctggtctttgtttctggagcactttcctacttcttggtactgtaaggtccaccagcctcatcttgtattttccctgctccaacctggagtcagccagttctccgagaagaatgatgtaaaaacccgagatggggtgcttgctgtgctcactgttcctgggagtgtcatagcttccagtctctcatagtggaggcagccaggaagtatgtctctagtaacgcacgcacacagaactgtttatttctgtgtctgtctgtctgcatggatgcatttaaacacatgagtctgcccctttcttattagtgacttctttctccttcagtgataaacctgtttcgaatttctcaatatatgtgtttgttcaatcctagagtccatgtaaagtagttttagaattgctaacagacttgtgtc

SEQ ID NO: 72300 - DNA, 1991 bp, Homo sapiens
cttaaggaatttgcttttgttccttaaatacccagcctttaaaaaccttttctcatgttgggtggggaatttgatgagacatctgtggtcttagctgcatttcttgattgattttaccaggcacccccgagtagctcttgttccctagaaactgtgctgaagcgtttaggatgtcagaccgtgaaatctacaatgttcaaatgattctgtcaacacagagagacagaataaaggaagtgtgacaaaatattgacagttggccagtctaggagaagaatgtacactcttcattgtactggttttttaggttttctatagatttgaaaattttcaaaatactaaaaacctgggctattgactttgtagaatgtgaaatggaagaatctgtgaggtgctccatgttcatgtgcttctcaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaaggggtaggtgggcccgggcccgggagaggcttatgggaggaatggatgagtccacgtttagggcagcttcaggtgtaggctgctgtgcatggagggccgttcatctgattcaaggaatgttggagggagaaggctttgggctggggtggggctgggaggttgaagagagtgggggccacgctgactttgagggtctgggtgtccatgagtgatgcgtgctgtggggtgtatgtgtctctgcatcatgggctggagacacgacttgccattttccagcgcgttcatgtctcccagcgtggatcctcactcagggacttgcagagtgtcgggcagttgcttcacagcatgtctgcgtgtccgggaggggcagagaagcaactgacaaggggcatggggctggtgccgggaggggagggtgggacagctgacagcagggctgggacccaggctggaggagggttgggcctggcagctaggcctgggctttctctgagaagctggaggtgagaatggggcttgggaggaggtgtgaagagagtagagaaggcgtgaatgggtctgggtggtattaagagtcctgctgaggctggagtcctgaacggctggacgcagtggcacatactgcacccttccagatccttcctgggcaccaaggtggggacagagaggtgtcctcgggcagagccagattccaccttagttctgtcctggtgcacgcacatttggctgcttcccttgtccctgtcgcatctctcctttcctcctccctactcctcactgcctctgataccccctggaggagccatgccagccccacccaccagtttgtggtgtcctctcagggctcgctggtactccatggagatggctggcatcgtctgcttcacaggggccaacatcatcacccaggcacgggagctgatcgagcagattgggtgagtgcagaaggggagccgtggggctgggagcaggtcctgggggcaagcatgggcaggaaggaaggagggaaggctggaggccacacactgggcaggaaggaaggagggaaggctggaggccacacactgggcaggaaggaaggagggaaggctggaggccacacactgggtgaaaaggaaaggggaactcacgaccttgctcctctctttctctgaaggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggtgagtctggggcctctggtcctgaagctctggctggcctggcgtcagtgccctgatgtcactggctctgcagcacctcacagtgtgcatgccttcctggcacccagcactgctcacattgcttttc

SEQ ID NO: 72301 - DNA, 1023 bp, Homo sapiens
agagatggggtcttgccatgttgcctaggctggtctcaaactcctgggctcaagtgatccgcctgcctcggcctcccaaagtgctgggattacaggtgtgagccaccgtgcccgcccacctttttcggtatgagaaactagcagtgtatctgagctgttgctcctttgtggtgacgtagaagccatgttcttcagcacccctgtgccctggctccctctgctctgggagatctcacccacctgctctgcccatctccgtcgtgcttagattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgagctctgaggggctgcaagctttggcctctgtgagggcagtttcagtcggctcatgaagtgggcactcttggctccttgcctgggatcctctgagcaggcacttgcactcggatggtaacgtgcaattgtttttgacttggaagagttgatggccacgaaggatgcagaccatcatccaccctggtctgaggcctcagaaggaccctaaaggatgatttctaaagtgattatttagagcaggggtcagcaagctacagctggctggccgtttgagtacatcaagttttacgaacccaactgccttcgcctattgtttatctctttcccgctgtcatgggaggtgaggagttcctagaaactctaaggccttctcatctatggtattcaccatccggcccctcgtgtttaactgacgtatttcatccggtaggaacatggaaaatgcatagcaacacctctgttttgataccaacgggtcattattttatatctgatcagattgagccattttttttctgagagaccttcactgtagactcagcacggcccctgctgtgcggccccctggcatcctgcactgccctgctgaactcatcgtcacatgt

SEQ ID NO: 72302 - DNA, 1045 bp, Homo sapiens
tccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatggtgtgcttcttccctgggattcagattcttcccactcttgtgctgtggtaggacccagaagctgcaggggctgaaataaagccccttctccccatcctgtcccacggcccctcaccgggtgtggcttctctggcccagcaccccccgggggcttctttagggcagtgcactgcagattgtgcacatgagtccttccggagctttctcgggcacaacctgccacgtgcagccacagcgtcaaacctgaggcaggctagtgtgggtgtgtttcccctctgaccccgtcgtctcactgttgtgctagaatcctgccgcctttgacttcctgctgcagcgggttgagaagaccttgcgccacgcccttgaggaagaggagaaagtgcctgtggagcaagtcaccaactttgaagaggtaaccatcagggaggcaggaagagccagtctgtgtttggcgccttcttcacagaccacgtctttcagcagcacgtttattgtgcacctgctgcgtgtggtgctgtggacggatgacacagggtctctggtgggacagggcagtcatggttgtgacgtgtgatgctgtcacaaggtcggagggcttcatgagaggtggggtgtgagctgctcctgaaatgcagtaacatggaaggtgggtcctggtgggatgtatcccgtgtcctgttttaaagcattaggactttattttataggcactggggagccattggaggttttaaattttatttactttttgttgttgagacttaaaaatgacagtaaattcctacaaatgacaggattagtgactgtaaaatctgtttacataatggttagaaagcacacttacaaagtgtgttatgtgactggagagggagacaccagttcttctc

SEQ ID NO: 72303 - DNA, 2373 bp, Homo sapiens
ttccagaaggacagccagggggagtacaaggcgccccagtgcatccacatggactgcctcaggtaggggccacagagcagcatggctcctcactgctgtccgtgagcgagatctgaaggcctcttgcagactgtgctgtcaccacatctcatgggaggagggtggcctccgagaggccgtttcaggtcacccaagagtatggcagctgcaaccctgccagggcccgggatgtgctgtctttgactgttgactgacaattcatcagtgaccaggcacattgagcatcagcctctggggtggggaagccgctggaaagacgcactcagctgacaggtcccagacctaggacctcatggagctgctctgcccaggcaaggttgggatgtggcagcccggctgcctcacaggacaagcctcacgggacaaccacagattccatatgagctagggtgggaggcagctcagagcttcggagagtcacggcgttcgggggctctgacatgactggttgggaagacaggtggatgtggaaatgccaacagaaggaggctggaagggaaggaagggaagggagggaggaaaggagggaagggaaggaagggaagggagggagggaaggaagggaagggagggagggaaggaagggaatggaggggcctccacggcctctgtattctgcacagtgccactggggtgcttgcagcctgaatgcgtttctgtttagctctgatgctcagcacttggcttggagagggaggccaggaggctggggccggtttagcgtgtgacggtgtgacagtcctgatccaaggcagggagtgagggttgtgaggattcaggatctgtcatgtggggcagggggaggcccagggatgctggttcttagggaggggttggcacctggggtttttgtgccatccgtggagacagggaatgggtagagaaggggcttgaggcaggaggtgaccctgctaccgatatgctagcctggaagccccacccatatgggggccctgaagaccaccatgaggcttggtttgggctcgcactgtagattgggactcactgggttgcgggtgggtcttggtgaaagctggggtagtggatgaactgaaggcaagaggtaaagtgagagaagaaggccacagggtggaggctgcggggggtggagaccggacatgacccctggacagctgctccagggaatgcgtctgtagggaggaggtagagacaggttccgggtagagtgtggggggccttcttttcttaatttttattttttatttattttttaaatttttattcttcttggcatctgatcacatcttgccttctattaaaggagggtgggcttgagtgtttccgtgctgaagggacagtgtgaggagagaagatcagtgtggttgatagaactaggccccaggggtgcagacctgaggtctggggagaggcccaaggaggtggggcgcccgtcggagaggccacaaactctgctgaggatgggaggaaggcgagggccggaaggaccagtcctggtgcttccttgtgttgtggataggtctgtgagattaactagatcctgatgaagggttttcacaaggtgtctacaccatgtggggccttggtgtgaggctcctgggtgcctgttaggaacttgcatctgtctgtgtggtgcccagttttgccagttctcaggggttcccgggctgcatgttagaatcatcctggcttctgttctcattctccttccaggtgggtgaagagggacagttaccttcctgtgggcagtcataatctcaaggcggccgccaaggccaagctaggctatgatcccgtggagctagacccggaggacatgtgccggatggccacggagcagccccaggcacgtaagccacatcccggctgcccctgctgccgtgtgcacgcatccagatggccacggagcagccccaggcatgtgagccacatcccggctccccctgctgccgtgtgcacgcatgtatgccagcccgctccacccagcaggctgtgtctccgggacacacgtgttttgtcctgtgccggtctccttactgtgtgtgcggcaggctggtcaggccaggctttgctttctgtgcttcacacttgaccctgggctcttgatttttgatggccctgctctctggcgttctctcctcagactctggccacgtattctgtgtcagatgctgtcgccacttactacctgtacatgaagtacgtccacccattcatctttgctctgtgcaccattattcccatggagcccgacgaggtgagcattatctgtcctgtcggcaccctggcctcctcagcccttgccccattccaaatgcactggagctgaatgga

SEQ ID NO: 72304 - DNA, 2522 bp, Homo sapiens
tgagatggagtctcgctctgttgcccaggctggagtgcagtggcgcaatctgggttcactgcaacctccgcctcctgggttcaagtgattctcctgcctcagcctcccaggtatctggggttacagacatgcgccaccacgcctggctaatttttgtatttttagtagagatgaggtttcgtcgtgttggccaggctcgtctcgaactcctgacctcgggtgatccgccttccttggcctcccaaagtgctgggattacaggcgtgagctgccacgcctggcccagtccaagccattcttaaaggaaggactgccttggtcgttgaaaccacatcaatttaccttttgtgtttcctcggtttgaactctggtctcacctcttcctactgagttggaactctggtctcacctcctccagaccctggcagctgagttagttgctctcttgttaattcctagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggtgagtggggcagggttgggtcgctgctcacatgaatttcctaacagccaggagatgatcattatgggtgaatccacagaagaatagactttcctggatgtagaactctagttagcacactgtgtgttttgcaggctcattggtacaatgtcagataccgaggaaatgcttttccggtagaaatcacccgccgagatgaccttgttgaacgacctgtaagttttgcttgtgttaccttcatcctaaaatttccagttttctggagagaatattcttcagtgctggagagtgaatctgactcaaagatatgtttgctgcttttcccccaaatactttattaaaggaaatatggagttagaatttttcatcagtttctgacagtatcatttccttttttgttgtatatcactgtatgacatcagtgtttgagctaggcaggatttggacactcgagggaaagctgggacttccgtttgggtagttgatagtgaagggacatggtgaaaaatggatttgtaactagaaggccttggttcaaacatgactttgtggtgttgggaaagtctttgtattcagttttctcttttccgaaatgaagatatcatctctgtgccacagttacctttcagagttgtcataaccaccagaatgaggtgatgtcttttgaagagtttttctcctaaagttctgtgattttaggcttgtcctgtgatcagctgctctcttaggtatgtcagttttcataccatagggagtcgtgatactcttgatgtaggttggttagtcttagggtccttctcccagctctagagccttttgactcttttaacaaccagagggaggtagagcaggctgggggtgggtgttcagggaggcctaatggggagtttagagcttggctttatgcttattttgtccccacaggaccctgtggttttggcatttgacattgagacgaccaaactgcccctcaagtttcctgatgctgagacagaccagattatgatgatttcctacatgatcgatggccaggtgagcaggtggcttctgggaagtaagctcctgggatggggaccttgtctggtccccatactacagcagcatctgccccactgttagtatttgttgagtgaataatgagttagtccaggaatgggagcaaccaagccgttccgacctccagctgtaccctcccctttcgagtgggaatccacacacagagcgtctcttctcaggaagcttaaagcactttcacattgctgtggacttctttgtagtgagaatctctaggcagagtgtgtgggcagggtgggaacgccatttcttggctttgcagcctctgacttgtgctgattgctaatgaacttggctagggctacctcatcaccaacagggagattgtttcagaagatattgaagattttgagttcacccccaagccagaatatgaaggccccttttgtgtcttcaatgaacccgatgaggtaaggaggtatcacttgggaaactacccggtattgtgggaagaacggacatgtggatctttccaaggcctcaggcattccgtcagatcagaattgcagctccatgagctttgttctcagggtatgaccgtcttttctgccagagacgggcggaggggcggggcaggaataagggccaacatgaggctgctgcttctgaactttgggagaggaatttggaatagcttgaagaagagaaagagcagacctctgactgctgtgacttgggttcaggctcatctgatccaaaggtggtttgaacacgtccaggagaccaaacccaccatcatggtcacctacaacggggacttttttgactggtgagtctgtgtcttctctatgagtaactgggcagcatttgagagggagggcgttgcgtggtgcaggggcgcttccca

SEQ ID NO: 72305 - DNA, 2225 bp, Homo sapiens
tttcaggaatatatataccctgtcatatccgaaacacttaacactaggtgggatgagggttgcagaagtaggtggcagtcggatcacaaggtcaggagatcgagaccatcctggctaacacggtgaaaccccgtctctactaaaaatacaaaaaattagccaggcgtggtggctgtcgcctgtggtcccagctactcgggaggctgaggcaggagaatggcgtgaacccgggaggcggagcttgcagtgagccgagatcacaccactgcactccagcctaggcgacagagcaagactccgtctcaaaaaaaaagaaaaaaaagaaaaaaagaagcagcagcaggtggcattacaaattaagcacggggttcccttctttcactcagggatgatggcgccacttcctcagtttcggcactcaagcgcctggaacggagtcagtggacggataagatggatttgcggtttggttttgagcggctgaaggagcctggtgagaagacaggctggctcattaacatgcatcctgtaagcactaggtccttctcccacccaggaatatggctgcaacccttctggtcatagcgtggtccttatctaaagagtgggggacacatgagggaactttgagtgaatcaggtgggagatgtgaaggttcccagctctcctttcctctttaacgtcattgagggccacagagaggccactgtgagaagccggaggtgatgggcatctcttttagccatcagaataaagctttcaaggattatgagggagaaattgagagagatccccatttggaggccgttacagtgtggttcttgtgaataaggctggtagtgttaatgtaggggtggagtaaagacctagatgagagggtttgtttctaaagtgctgagtttcccgaaaggtaggaggaaagtttctctaactgtgtagaggatggtcttgtgtctgtgttgactgattctcttgtagaccgagattttagatgaagataagcgcttaggcagtgcagtggattactactttattcaagatgacggaagcagatttaaggtaagcccctgactgcgacaagctaaaacccacttttatgggtgttcatgtagctctgtgactgtcagggagggcatgggaggcttccagtgcacagcagcccatagcccagcagaactcgggcccctggaggccccatcagtcatcacgtaagatgtcctgagagaggtcagttcaggaagactctgaatggtgagaagtagcgtgtctttcagattcttgcccctgtgaaaagtgcgcattctgacttcctgtatgctaccaaggtcaaggctaccctggccctaggctgttcatgggatataggagcaagcaatgtgttttcacttttctctcgctttcttctttctcatcacccctggatgggttggtgactcttaacaggtggctttgccctataaaccgtatttctacattgcgaccagaaaggtgagtgtgtttcatagactcaggtcagacgacctgtgtgtcattctgtggtgggctttgcaactgggaaataggcaaggaaggaaatgtattttaccaatggaaagccttttcattctgatcctgattagggttgtgagcgagaagtttcatcttttctctccaagaagtttcagggcaaaattgcaaaagtggagactgtccccaaagaggatctggacttggtgagtatcacccagactttccaggggtaaatgaggccagagtctacattgttcctggcaggtgggatcggaagaggtagaaattcaggtcatctgttgggtgatggggcggtgtggtgaccgtctataaaattccttccaaagagctctagtggtgttagttggtgccacgtgcagagttggacaaggtgccttgaagtcgccaactctttgacttgtgtgtttacctttgagtgtttaccctctcacccataaagtcctatttctcttgaaccaatgagcgtgatctcttcgcattatagccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccaggtaaactttggtcttgtgagcaaagcatcagcggttcagaacgacaagatggatag

SEQ ID NO: 72306 - DNA, 1083 bp, Homo sapiens
caggctggtcttgaactcctgagctcaagtgatcctcccaccctggcctcctgagtagctgggaatacaggtgtgagccactgtgcccagccagaaaatctttaattgacaaatatttaagggacaagagggttttaagaaattaaaaggatgtatgaagtgaagtgagttgtgaacagaacctgggtgccctcctcatccacgtgcctcagtcgccctcgtgcctgaccggctttgccaatggagcctggaccctcagcacgggtcagctgtgggtgcgaacatggtggtctgggtcaggcctctttcaagtccccacaacaggcctgacttgtgcgtgagacgctttcaccttaaaccccacgccatcctgggggttcatggtcaggtataaaaccctgcagagaagtcaggctgtctgatcccaactctccccttctcagcctggtcacaagtcagttcccagatgcagcattgcaggtttctactttccgccggtctccttgggaacaaaacgttaagtgtgtgcggcctgtgcagggaggacagagggaaggagaggccggagccctcaggatcgagtgatcttgtcgggaggcatgaaccccgtgtccccgagggtcctgagcgcaactcggccgttgggtcggatcaccaggtgggtgatgctgccattattgagggagagccggagccagccttcaggaggaaactgcagtgctctggggagagagagagagagagaaagagcacgttagagccagggggctctgtccttaaaacgggctgagctaggccgggcatggtggctcacacctgtaatcccagcactttgggaggccaggcgggtggatcacaaggtcaggagatcgagaccatcccagctaacacggtgaaaccccatctctactaaaaatacaaaaaattagctgggcgtgatagcaggcacctgtagtcccagctacttgggaggctgaggcagaagaatggcgtgaacccgggaggcggagcttgcagtgagctgagatcgcgccactgcactccagcctgggtgacagagcgagattctgtctaaaaaaaaaa

SEQ ID NO: 72307 - DNA, 1042 bp, Homo sapiens
acccttattgagtaaaatacttcagattgacagctcaatcttagtttgcctccagttaatcttttatgcttagggattaaatgtgtggttttttttttgtttttttttttttggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaggactagttgtgagtgtgttaaaagcgtggaacttcggccgggcgcggtggccacgcctgtaatcccagcacttcaggaggcccaggcaggtggatcatgaggtcgggagttcaagaccagcctgaccaacatgctgaaacctcgtctctactaaaaatacaaaaattagccaggtgtggcaggcgcctgtaatcccagctactcaggaggctgaggcaggagaatcgcttgaacccggaaggcggagcttgcagtgagccgagatcgctccactgcactccagcctgggccacagagcaagacaccatctaataagaaaaaaaaaaaaggaaacttgtgcagtgtgagaaacgatggtgtcaccagaaccctttgcacagtgtcctgtctccccgtggctgacgcctctgcccgcatcgcaccggctgcctgctcagaggacttccgccagtggcctgggcc

SEQ ID NO: 72308 - DNA, 1037 bp, Homo sapiens
tgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgattttgtatgtggaccactgctcctgatttcccaggtcttaggccacctttgactgtttctccgtttgtttgtgggcagcgattccagtcccaacgg

SEQ ID NO: 72309 - DNA, 1151 bp, Homo sapiens
tgttgtggctctctgcacacaggacagagctctggttgggtggaaaagctgaacgggtcagctcctgacaagctgagggctagaagggtggaagcagcagggtttctactcagatcacacaggattctccgggaaacccccatgagcttgactctcccagtgcccgcggtgccagggttcagcagtgcctctcctccacccagacgcatgtgcccacggtgccagggttcagcagtgtgtctcctccgcccgggcgcgtgtgcccgcggtgccagggttcagcagtgcgtctcttccacccgggcgtgtgtgcccgcggtgccagggttcaccagtgcctctcctccgcccgggcgcatgtgcctgagtctggggccattattctccgacttttgctgttcatctccgggcctgtgcccgtctgctaacagttctttcttgctttccgcagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgtt

SEQ ID NO: 72310 - DNA, 1018 bp, Homo sapiens
ccgtgatcatgaacacgtccgtctgtgggagttgaactgtgtgacctgggttgctggcgtgagggtctgtcgggctgaggcctccttcctgcctgcagccggttcacggctcctgagagctgtgccgggtcctgcttacctgtgaggaggcgtgctgtttcagaaaatgcaccgtatgatttcagctgccagttaaggataaaggaaaattataaccatgattgcagacattgctttggtacttgaagctttagtggcttttttctgtgtagttctgagtattttttctggtttcacagctggttaattgtgttttgtttcttacagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggtaagcatgtgcaggcgtggctgtggcagctgggaggggccccccatggccggggtctgacgggatgcgcacatctgtttctcgtctcttggtgtttttaacgtaaaggtctggtactttcccttaggttagtattttttgagacggaacctctctttgttacccaagctggagtgcagtggcgcaatcttggctcactgcaacctccacctcctgggttcaagcgattcttctgcctcagcctcctgagtagctgggactacaggcgcccgccaccacgcctggctaattttcgtattttttttttttttagtggagatgcggtttcaccgtattgaccaggctggtctcgaactcctgacctcgtgatccactagagtgctgggaaggttaatgttaaatgggttgtgtgtcggggagggtacatgaaaaataatggcatcgctttgagcagtattgctgtttctgcttgtgtttgcattatccaaaatctaatatag

SEQ ID NO: 72311 - DNA, 1549 bp, Homo sapiens
tgcgctggtaccttttcctctccttgcagacagttagaaaatgtcgagtagcgcaaacaagaagtaaatttacccataatcccagagtgtgttctcctagctgtctccttagacttttagaaagaccacactcttcacacgttttctgagtgtgagctttattaaatctttagcattaagatactattctactttactgagtttaaaactatttttctgaaatcattgtaatgataaggaaatgttgcgatcaaataagatttagacacacttttttttccaataggtaatttgtgaaagaagcaaaaataaatctgtggaactgaaggagcggatcagagagtatttaaagggtaagatggggagttggtgcctggatcgtggggtccacgccgggaagggccttggagcgttgggggacacagcagagctttgctttcctgagctccccgggcgtgtgccggctcccctcggaagcctctcctcgggatcatcctttcttctcctgagctctcctagctcatttgccaccttttttctgttatcccttctctgaagtcttgtatctgttccttgagctttctgtgagagaacttttttgaggttgtgtgtcgctgcctgttgctggtggcctcatccctggatccatcggtctctctcgcagtagcttcattgtgatggcttctcttcaggtggagcctgcagttggcaaagaacagctcagggagaggcagggtccagagctccttggctgggtggctggcctggcttttgtgtgtctctttgcctgtgttggggtgggggtcgctccctgtcactccttcgattctgaagctgcctccttcctcctcctgtactcctggtgcacgcccaggctcctgtcttggctccgggacactccctccccactcgcctccgggacgttccctccccactcgcctctgggagagaggcctttgctttctgggccgccctcttctagtcagcagcttctagttgttggcccctgtgccttgcggtttgtaggtgccaggcatgtgaaaacggctggtttcagggatggcttttccctgccatcttcctctgttttcagtgaattttggaagatgacacttctagaagcgcctcttctttgccatcttagctcgaagtctggagcttctgcttgctggtgagattgaagcagacgctgaggtcctttcacccacctgcctgctttcctctctctcggattccattcctatccaaaactctgtctctatttaaagcagggtccgcaaatgactgcttttaaaaataaaattttatcagcataaagctgtcaccaccatttgcacactgtccgggttctttcccagcacacagtgacttgtggcctactgagcctaattatttactgtctgacattttatagaagtttaccaagcgtgatctaaggtgtgaagagcctctgcttgtcccctgatctgttcccgtcctaggtataatttattaattacacttcttcagtgtgtgtagctgtgcacaggaaatgaatcctgcatgctgt

SEQ ID NO: 72312 - DNA, 1043 bp, Homo sapiens
ccggacacttcacagccagaatcttggtaatcagaggtgacgagagaaggtgtttctggctgtgctaggtgtaaatgaattctgttttctacacggtgcagtggagctgcctgtgggatgtccaagtgaggtgactgggagggagttggcccttcaggtcttgggctcaggggcactgttgaccatgaggcccgctggtctgtaggccacagttgaaggtgacattgagactgcccagagcataaggaaggatagaggtgcagctgtgggagctccaggcagatggtgtggagacctgtgacaccatccggggaaggagggcgtgacgcagcgtcatggacggagacctgggttcccagccagggcgcgatgcagcatcgtcagcagtgaaaaaaatttcgtttactgtggtgtcacaggccgcagagacttctttgagtacagaccaaattcgtgcgctttgctttattctggttgtggtcctcatctgtgtatttcacttcctgggcatgttttacatgacattgtactgggccctgaatggttaaagctgctgttcactgtttatggagaatttaagctcctccagggtctgggcacccaggtcagtatgctaagctcaagccttggcacgaagtgggtatgtgctagaatgccaattatttttccattataaaagcagagtcttttatggcctttttgtttgtgagtctttttttttttaaaaaagtataagccaggctcggtgactcacacctgtaatcccagcactttgggaggcaaaggcaggtggatcacctgaggtcaggagttcgagaccagtctcaccaatatggtgaaaccccatctctactaaatattaaaaaaaaaaaaaaaatagctgggtgtggtggcgggtgcctgtagtcccaggtactggggagcctgaggcaggagaatcggttaaacccgggaggcagaggttgcagtgagccaagatcacgccagtgagactccgtctcaaaataaataaatgaatgaatgaatgaatgaatatgtatttt

SEQ ID NO: 72313 - DNA, 1268 bp, Homo sapiens
acaaagttcaccaaacttggcctcattcacagagcctttcccagcaagattgtggcagggtctggctgctcttccacttgctgtgctcatgggggcgcgctggctgccgttgtaggctggggcccccagtgagattgtggccgggtctggctgctctccctcacttgctctgctgacgggcacgctggctgccattgattgcgttgcatgctggggccggtggccgtgggcccttctcgtcttttctcacctgtgcctcccagttggcccagaagcctctgtggaaagctgcttatccctcatcagagggtgcatgggtgatgagtgacttttggtgaaactgattgttcttaaattctgtctcttactgacagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggtaggtctcggcggttccctcgggcaggtgtgcggtcccggccgttccatcgcagcactcgcacagggcgtgtccacacatcagataggaagctcagagcatgcggttctctttcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatggtgcgtgcacaccctccactcacgctttctttatttaattggttaaaagtctttccccaaaagaatgctttatcgacaagttactcattagtataataactttggggaaaagatacatcaattacacccctgcaacctgccttcttaccacatcccactggacaaagggcaccgagcgctggggttccctggcccctgcattgtcgtcgtgtgtgcgatgctgtccccgagggtgtctgaactgtctggggacacggttgtcagaggacatttcctctgccgaacaggacaccttgagctgagcagcacttcccctcccgggagtggcagagctgtgcacaccacaggcaggccctcagtgtcctaccaagagccactgaggcacagagctgcc

SEQ ID NO: 72314 - DNA, 1095 bp, Homo sapiens
aggcgggagaatcgcttgaacctgggaggcagaggttgcaagagccaagatcgtgccactgcacttgagcttgagcgacagagcgagactccgtctccaaaaaaaaaaataaagtaaaaaataaaaaggcgttccctgttcaaaattgtgtttaaaattctcttatgttcttggctgacataattatagtttttttttttaatttgccttttaataatttttatttagatctttatatgaaatttagtttttaggatagaatcttggcatatagaattacatatatgaacataatatatatcatgttacatgcatatatgcacactgtcgagcttgttaattgttctattttggctagcttaggccctttttcttcaggattaaagatctgaactaagccaggcgactgggtagcagatgtggaagctgatggttaggcccagggcatggccaggtgacagctctccagtcactcttctctgattttcatttgttacttttcttacccagaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaaggtaaatcatgcagccgttcacatcttgatgttcctgtcacattgatcccaccctgttttgtgccttctttcctctgatgtggtaacttgttttctccatgagggtagagtcgatggggtctcagtggaccaggaggccatgctggctctgatgctcgtgtaattagcatcttgactctggagaagctgaaaagaacgctgtggccgcttccatctgtccccgtgtctgttggatttttttcttttttttttgtaaagagacagggtcttgttcttttgccagcctggagtgcagtctggtgctatcatggcccactgcagcctcaaactcctgggcttaagcaatccacctgctttagcctcccaagtagctgagaaa

SEQ ID NO: 72315 - DNA, 1083 bp, Homo sapiens
atagcaccactgcactccagcctgtgcgacagagggagacaccatctcgaaaaaaaaaagaaaaattctttttttttttttgagctggagtttcgctcttgttgtctaagctggagtgcaggggtgtgatctcggctaattgcagcctccgcctcctgggttcaagcgattctccagcctcagcctcccaagtagctgggattacaggcatccgccaccacacccggctaattttttgtattttcagtagagacgtggtttcaccatgttggccgggctggtctcgaactcctgacctcagatgatccgcccgcctcagcctcccaaaatgctgggattacaggcgtgagccaccgcgtccagccaagaaaaaaagtttttaatgaaagaaacagaaactgatgccattatataatgaaccctagtacccatcacccagcttcagcaggtgttagtattttgtgactctttgatttttttgtcttgggcctaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatggtaatgggaccgtgtgtaggatttcctcacacagatagcacatacgcggaggggcgggatgacgtctgaaaatggaaaactacagattaagaaggaaaaaatccaatcccctccatctcatcaccccagtt

SEQ ID NO: 72316 - DNA, 1050 bp, Homo sapiens
ctgctccaggacgggacgacggccgcaaacagtactcgggctcggagcacacgaacccggaggccgcttcgttctcggagacgcacagcgccccacggacgccaggccggggccgggaggcgcgaagaagcgccgccccgcgcccggccccgccctggtggcctccccgggccccagccccggcccccgccagcacattgcgctccccgcgcctcgccggtcccaggaccccgcgtcgggctgcccgcgccccgcctgccgcgcccgcccgtccgctcgcccgttcccgcccgcttgggtcccagggccggggccgcgccctcgccgggcctccgcgagcggggccgccgtccgtgtcccccgcgccgccccggccgcctcgagcgcggcgccgtcaggcagggcgcgggcagcccggcgcggggtcctgggacgggcgcggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtaaggcccaggcggtcgctgggtccccgcaccctggccccttccccgccccgacgccctcctcgggcctggggtcccggccgcgcccctggagccggcagcagttgggcgaggcggccggggaaaccagggccggtcgggaaaggccattccggccgcggaaagggcagttgcggggacttggcttcccgggccgggggcggaggggccacgccgggttcgggggtgagagctttcccgggccctggagcagcctccggggaaggcggcgggggcccggcgaggcgttagcggagactcttgctgcggtctctcgagacctggggagggatggcccaaaggagggcggcgcggggaggaaacccctgggtcccggatgtgtt

SEQ ID NO: 72317 - DNA, 1039 bp, Homo sapiens
ctgctgtattttatttctgagagtgctgggattacaagtgtgagccaccgcgcccggcctgctgtattttatttctgagcaagggcggcccctgaagcggtgtcgtgagtcctgctttgctttattactgagccacaagcaaggggattacctgttggaagcaaagccgtgcaactgaagtcaggagagagccagactccttggaatagaggagacgtctatgaggccggtgtgactgccttgtgcaccacgcagtctctcaacaggcagtgatgtcacctgtggataaacagtggtgtgtctcagtcgatggagtcttagatttgatgaaatgtatctttacctcaaaaaagttatgcccccgataagtggtaaacatttttgttgaagccagcttgacccccaggtacgccccccacgccccgccgcccagcgtccgctcacagcctctgtctttggcaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcaggtctgtccgtgtcgggttgactcatttgatggggaggattcggccaaagtgcttgtcgggagggtggggcctgtgtctggggcggggcctgtgtctggggcggggtctgtctgggtcggggcctgtgtctggggtggggccaaggtgggagaggcttttggaagaacagctgggaacaaggcccacctggagcataggtcccagaggggcagtccggtgaggcctgataagtccaggtggtgatggtgcatgaagggagggagtgaggaggccccgtgaggcacccagcttctccccattgccatgggctccc

SEQ ID NO: 72318 - DNA, 1068 bp, Homo sapiens
aggtgggagttgggctgtcggtcagacgctgctgctgctgcagacctgaccctgtgtttgccctgctggttcttctataccaggattgtgcgtgaaaaaaagaccctccatagtgtccatcaaaattacttgaaacccgaacaggaaaagggcatacgctctcggaggagggtcaggcgcagccatgtgggcttcattccttctccaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtaatgcattctgctgtgttttgttttgaatcagaaccctccttgcaggaatgatgctgattatttgcttctttctttctttcttttttttttgaaacagtctcgctgtgttgcccaggctggagtgcagtgggatgatctgcgctcactgcaacctccacctcccaggttcaggcaattcttgtgcctcagcctcctgagtagctgggattacaggtgtgcgccaccatgcccagctaatttttgtatttgtagtagagatggggtttcgccatgttggccaggctagtctcaaactcctaacctcaagtgatccacccgcctcggtctcccacagtgctgggattacaggctgaaccaccatgcctggctaatttttgtatttgtagtagagatggggttttgccatgttggccaggctagtctcgaactcctaacctcaagtgatccgcccacctcagtctcccacagtgctgggattataggcctga

SEQ ID NO: 72319 - DNA, 1035 bp, Homo sapiens
gtggtgcgatcttggctcactgcaacctctgcctaccaagttcaagcaattctcctgcctcagcctcccgagtagctgggattacaggcactcgtcaccataccctgctaattttttgtatttttagtagagacggggtctcgccatgttggccaggccagtctcaaactcttgacctcaggtgatccgcctgcctcggcctcccaaagtgctgggattacaggcgtgagcctcatctttataaaatggggatagtgtcacctactcgatagccttgtggaaaaattaaagaagaagaaatggtgtaaaaccccaaggcagtgtatggagggaggttctgtgctggatgttgctgggctggtctcgttgccgatcttgccagttgtacagggagctctctgcagcctcacgtggtttctcatctcctgcgactgctcccacctctctgtggcattagctgggctgcccggctgggatgagaagaatcacgttgcgtcagccatagtgcttcaagggcttagtagagaagaactgaaaagaatttcaagtttcaagttaggaatttgtgttttccctaagaagtgtaccccgatgtgaggctgtgttcactgcgggggcctctggtctcttacccggtagcaccaagcaccgctcttgtgagagcatgtccgggtctcactcccgaaaggaggcagctgtcgccacacgagaaagtcggggaggctctgctcaccagtgggtccaagtccttctcacggggttgctggcctgggctgggcctggcctcggtctcctggttggggggcggccaagctgcccatcctgggccctcagtctgcagtcggtagacaggatgaggaggtggatggggcccatgccagggcggtgggtttctctgcagagcacggggccaccggctgctgttcactattaaggtttcctgcctttttaaaaacaagtttcctgggctcaggctgacatgttggatcaggaagcagccttcatgcagattcaggaggcaaagacgatggtgga

SEQ ID NO: 72320 - DNA, 1259 bp, Homo sapiens
ccactgaccctgtggggctggtccctacagaagtctgatgaggaggtacttgctgggatgtgttttaaacgtgttgaggtcacagtcactgaagagtgtgctttagaccagaggtggtcatgctggtcactagagtggggccttgcggcagtgagaccaccacggatcggaggcctggccgcaccctgtgtggtgaggggctggggaggtggtgctctctggttgtcagcggagggagtagtgatcggtgccacctttctgaatggcagttttaagtatgctgcttgtggattttaaatgtaatttttgtacttttgttttcttctcagtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcaggtggtggggacagcagaggtgggcggggtgggtggaggtgggtggggccaacagaggggggtgtggggcgggcagaggtgggtggggcggtagcagaggtgggtggggccaacagagggggcggggtgggcagagacgggcagggcaggcagagggcctggcctgagatgttgcttcccgggcccacggctctccgcactggaacaggtgatacacagcttttcttcctgattctatccttagtcttgacatgaacatttaattcataaca

SEQ ID NO: 72321 - DNA, 1012 bp, Homo sapiens
acgttagagcgtagaggtgtggagggcgggttcacgttagagtgtggaggtgtggagggcaggttcaccttacaggaaggacgtggacaccagaggggctgtgggccttatcctggccaccccgcctgtgggacggggcccatgggctgctcctctcagagtgaagcctttgtgggatgagaaagtgccgtgctcatgagtctggatcctcttctctcctactccagctgcatgtctgaaaagcgacgtcaccttgttgttaaagccatggtggtccagcgtgctctgtctttccaggtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgtaagcatccgttaccccgcttttcccaccctccacgtccgcgtcgctcagccccttgggagcaggtgccctgcgcactcactgtctgagctgttgtgtgcctgtgcctgccgtgtgccatctgagtcccacgtggggctgtgagtttagcaaggagagcttcaagttagagagtgaagatgcaggtggagtcaaggttctgctgtggtctgactggcagcagtgctgacgcttttgcgttaaaggccagcctgcatgtcctgtgtcacccaggtgcttggtaagcagacggtgggcatccagtctgttgttttggttttttttggtttgctttttttttctgagacagagtctcgctctttcgcccaggccggactgcagtggcgctgtctcggctcactgcaatctccgcctcctgggttcatgccattcacctgcctcg

SEQ ID NO: 72322 - DNA, 1415 bp, Homo sapiens
accgtgtgtgcctacgcgtgcagaccctcctggcccctcaggtaaaggaaccgacggtgtgtgcctgcgcgtgcagaccctcctggccccgcaggtaaagtgtctcgtctaccccctctgccatcactgtacctcacgtggcctccaccacagcacgtcatgtctgccattgcgtgtgtgcccattacatggcgagatccttgaagacagagactcattccccgtctgcctcccaccaccttgaacactcccaactcctaaagtgccaacacaggtttaatttgccgaattaaatcttcagttctgctgattctgctgagtacattcctctgctacaaagctaatggttccaaaacaaaatgattaagtatttgaatcctggagcatcaacactgccttttaaaatacagcaaagtctaaactagtccagctgaaacatctgtgagcttcagttccaatgagggagtccagggagttagaaactggaagagcaccttttttcagtggccgggaagatggcggacattcagactgagcgtgcctaccaaaagcagccgaccatctttcaaaacaagaagagggtcctgctgggagaaactggcaaggagaagctcctgcggtactacaagaacattggtctgggcttcaagacacccaaagaggctactgagggcacctacattgacaagaaatgccccttcactggtgatgtctccattcgagggcggatcctctctggcgtggtgaccaagatgaagacgcagaggaccactgtcatccgccgagactacctgcactacatccgcaagtacaaccacttcgagaagcaccacaagaacatgtctgtacacctgttcccctgcttcagggacgtccagatcggtgacatcgtcacagtgggcgagtgccggccttgccggcctctgagcaagacagtgcacctcaacgtgctccaggtcaccaaggctgccagcaccaagaagcagttccagaagttctgaggctggacatcagcccgctccccacaatgaaataaagttattttctcattctccaaaaaaaaaaaaaaaaaagaaactggaagagcagcatcacggccacggcccagacaggcaccaccacctgaacagaaggaaggatgggatgaccagcaggactggactcagccattacaggtggaacatgcagaggagaactgctgcagaggagaactgctgcagaggcccacagtgacgacgcctgggccttacactgaccaagaaggaacacagccaaagacgctcaggttccaccgagagggcacgccaacatggtgacagccaaccgcaccgagctgagtccagtgcaatcacagattctgctcacttaattcccctgctggtgtccaagcagcccacctctccagaacagagacc

SEQ ID NO: 72323 - DNA, 1312 bp, Homo sapiens
tgagcagaatctgtgattgcactggactcagctcggtgcggttggctgtcaccatgttggcgtgccctctcggtggaacctgagcgtctttggctgtgttccttcttggtcagtgtaaggcccaggcgtcgtcactgtgggcctctgcagcagttctcctctgcagcagttctcctctgcatgttccacctgtaatggctgagtccagtcctgctggtcatcccatccttccttctgttcaggtggtggtgcctgtctgggccgtggccgtgatgctgctcttccagtttcttttttttttttttttttggagaatgagaaaataactttatttcattgtggggagcgggctgatgtccagcctcagaacttctggaactgcttcttggtgctggcagccttggtgacctggagcacgttgaggtgcactgtcttgctcagaggccggcaaggccggcactcgcccactgtgacgatgtcaccgatctggacgtccctgaagcaggggaacaggtgtacagacatgttcttgtggtgcttctcgaagtggttgtacttgcggatgtagtgcaggtagtctcggcggatgacagtggtcctctgcgtcttcatcttggtcaccacgccagagaggatccgccctcgaatggagacatcaccagtgaaggggcatttcttgtcaatgtaggtgccctcagtagcctctttgggtgtcttgaagcccagaccaatgttcttgtagtaccgcaggagcttctccttgccagtttctcccagcaggaccctcttcttgttttgaaagatggtcggctgcttttggtaggcacgctcagtctgaatgtccgccatcttcccggccactgaaaaaaggtgctcttccagtttctaactccctggactccctcattggaactgaagctcacagatgtttcagctggactagtttagactttgctgtattttaaaaggcagtgttgatgctccaggattcaaatacttaatcattttgttttggaaccattagctttgtagcagaggaatgtactcagcagaatcagcagaactgaagatttaattcggcaaattaaacctgtgttggcactttaggagttgggagtgttcaaggtggtgggaggcagacggggaatgagtctctgtcttcaaggatctcgccatgtaatgggcacacacgcaatggcagacatgacgtgctgtggtggaggccacgtgaggtacagtgatggcagagggggtagacgagacactttacctgcggggccaggagggtctgcacgcgcaggcacacaccgtc

SEQ ID NO: 72324 - DNA, 1048 bp, Homo sapiens
gcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgct

SEQ ID NO: 72325 - DNA, 1028 bp, Homo sapiens
ttagaaacccacgttacactcatgagtaactgcaaatagacccagggcctaaaacaaccacagccctgtatggcctgacgtcctgccggctcctgactgaggccaaattctgcttagaacattgagcaaagtgcaaacagggtgtctgtaaagaaaagagtgctggccgagcgtggtggctcatgcctgcaatcctagcactttgggaggccgaggtcaagagttcgagaccagcctggccaacatggtgaaaccccgtctctactaaaacacaaaaaattagccgggcgtggtggcgggtgcctgtaatcccagctactcaggaggctaaggcagaagaattgctcgaactcaggaggcagaggttgcagtgagccgagattgcaccactgcactccagcctgggcaaaaacagcgaaactgtctcaaaaaaaaaaaagagaggcagaagccaagaagccaacccagacagaactagagccatgaggaagtcgggggctccttacctggcaactcggaagcaggaatgttctgccgatactgataggtcagctcacggaagctgcgcaggccacagcagtaacacagaacggtgtctcccgtgactctgtaatctggaagaaacacagccagttacccagcaacaccatcttcccaacagcagcgcacggacttcacagcagtgggagactaacgcactgaccataaatggggtgaagacaacgggcgacacattaggaaaataagaacaaagccaatctagatacgaatttatttttattgagacggagtctcgctctgtcgccctggctggagtgcagtggtgcgatctcggctcactgcaagctccgcctcccgggttcacgccattctcctgcctcagcctcctgagtagctgggactacaggtgcccgccaccacaccgggctaattttttgtatttttagtagagactgggtttcaccgtgttagccaggatggtctcgatctcctgacctcgtgatccacccgcctcggcctcccaaagt

SEQ ID NO: 72326 - DNA, 1052 bp, Homo sapiens
gtgggaggatcccttgaagccaggagtttgaaaccatcctgggcaacatggtgagaccctgtctctacaaaaataaaaaataaattagccgggcctggtggtgtgcacctgtagtcctagctactcaggaggctgaggtgggtggatcccttgaacccaggaggcggaggttgcagtgagctgtgattgttcccctgtactccagcctgggccacagagcgagactccatctctaaaaaataacaaaccagaaaatgtgagcctcgccttttttcagggatacaactcctcgccatcacagtccatcacaacctgggtggcgttagctggatgtggccccgccccgatttccatgagacccctcctgaacaatgtttccagaaagagttgagctcctgagcctggtgctgacgaattgtgttggagacagccctcagcgctgagtgcgtgtaacgagtgtcctctctccacaggtgcggtctgcctgcagcctttctgccacctgtactggggctgcacccggaccggctgctacggctgcctggccccgttttgtggtaatactggctcttcaggccccagttgctttgacctttgcatgttctcttggtgaacttgagggcaggggatggtggggtccatagcctgatgtttatagggatgaggccactgttggtcatcaaatgatacctattcctggctggactgcagaggtgtgtcaaattcgtgttagctcaaaatcaagccttaacagaattattaggggagatactcccaggacagaatccttgcagcggggttctgctgttacgataccaagaccaggtgctggggagactcggagagctgatctttttaaggagggagtggaatggaaatcatttctgcttgtcctctgtttaaaattgagttttatcattgaacttcttattctttctagaatctgtaatgaaaagaaatatgtttatcctcagtgtcgggcagacagtgctttcctgcgacatcattataaacaggtaacattgccccttcatctcggcagagctcaacct

SEQ ID NO: 72327 - DNA, 1024 bp, Homo sapiens
agccgggcgtggtggtgggcacctgtagtcccagctactcaggaggctgaggaaggagaatggcatgaacccgggaggcggagcttgcagtgagccgagatcgcgccactgcactccagcctgggcgacagagcgagactctgtctcgaaaaaaaaaagactgcatgtatttccttctcggttacgacagttagaacacatccctttctcctgtggacggggaccttgacctgaacctgcgtgtatttccttcttggttacgacagaacacatccctttctcctgtagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgaggtgcgaccgtgttcacccttggctcacggaacatggcactgcaggttcttcgtcccgtgtggggcagggctgggcatgagacaagcctgcaggtcctgtttggcctggcatctgctgaggttactctgtcacccagataagtgggtggagtgggtggagtgggtggagctttctcagcccactgcaacctctccctcccaggattgagcggttctctgacctcagccttctgagttgctgggactacaggtgcacaccactatgcctggctgactttttttttttttttaatgttctaaatattttttattcctttttttttttttttttttttttttttttagatggagtctcgctctgtcaccaggctggagtgcagtggcacagtcttggctcactacaacctcagcctcccgggttcagacgattctcctacctcagcttcctgagcagctgggactgcaggcgtgtgccaccatgcccggctaatttttttgtattttttagtagagacagggtttcaccatgttggccaggctagtcttgaactcctgacttcaggtgatctgcccacgt

SEQ ID NO: 72328 - DNA, 1052 bp, Homo sapiens
tcatatgaccacgggtatgtgggtttgccctgcgttagactcggtgctcgagggctaagcctggtcacagacatctccgcatttgtttctctgcaaatgggctccttgcccccagctccaccccacgtagagataggcacaaatagagttaagatgtgagttgagtgagcacacactcctcgtaagccacttgtcattcctaaactacgacatctcaggctgccagctgcactgggctccagtcagtgacaccttacaggcatggttctctcctgagctggatggatcagcacctatcttgtttgattcctctcacagggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggaggttagtgtctggttgtgtgtgtcctcagtcctctcgtgtgctcctggggcatgcgggggccgctgccatgctccgtgctgtggggcattgcttcctgcaggggcatgtggaccctgcctcaggttgatgcctgtaacacctccggcattttcattcagaaaacctgggcctgtttttttgcggtttgcataatccagatagaactgtgatttgctacaggctgttctcttggtctggaaatagtgcattctgaattgcagaattaatctcaaaatcctccttcctggccaggtgcagtagttcatatccgtaatcctaacactgggaggccaaggcaggagaatcacttgaggtcaggcgttcgagaccagcctgggcgacagagcaagactttatctctaaaaataaaaatcaagcctgacaccgtggctcccgcctataatctcagcactttgggaggccaaggtggacggatcatctgaggtcaggagttcaagaccagcctggccaacatggtgaaactccgtctctactaaaaatgcaaaaattagctgggtgtggtggtg

SEQ ID NO: 72329 - DNA, 1519 bp, Homo sapiens
cgccccgcggatcagctgagggagccgcaatgtctcttgacagcggcggcggcgcagccggttccgggttcggcgcggggcgggggtaagcgcggctggcgagggggctgcggcgggcggcgaagggggacctggttgcggccgtgggagggggcgcccgccggcgtccaggccgggctgcggggctgcgtgggcgcgggcggccgggccggggcccgcggggtggggcgggcgccgagtctcggcctctggggtcgggagtctccatgggcgtttccggggtctccgcagatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggtgcggggctgaggccggggccgggggccggggccgggcagagccaccgggttgcgggcaggccacacgggcggcggtgcagtgtgcgctccagatttttccgtggagtgaaatgtcatgtaagaactggtatttattcggtgttctgcccaccgattcttgcgcatgattcacgcacatcatttagccttcgttacaactgtataagttagttgtgttcatatactctccagaatgcaatattgtcacgttcgttgccgtacagagtatcttttctgactgtaatggaacgaaattaaaaataatagaaggaaaagtggaaaattcacagatatgtggacatgaaacaccacactcttaaagcaaccggtgggtcaaataagtctttacaacggggaccttgttttgagacaaatgaaacaaaaatagaatacaccaaaaggtatttaggatgcagccaaggcagtactcagagggaaatttatagctgtagtgcttatattaaaaaagatctcaagtcccagcccctagaatatttatttatttaataaacctggaaagctaaaaacttgaacaaagtcatacaacgggtgagagaaagttccctcagcctccacattcactgcctccagtctcccaagtgaccatctggttgtttgatttcctctgaagcctttgtatggggagagaaatgcgctggtcctgtcaacaaaaatgtttagtttgtctgaaaattaatgaattagctccgacattatactctaaaaaggagcgaggatgggaaatatttgctgtttggaagcaattttttttttttttttggttaatttcaccccttataatgtgcttgcacctggttttttttgtttttttgtttgtttttttgagataagagtcttgctctgtggcccagactggggtgcagtggtgtgatctcagctcactgcaccctctgcctcccggttcaagtgattctcccgcctcagcctcggagtagctgggactacaggcgtgcgccaccatgcctggctaatttttgtatttttagtagagatgagctttcgccatattgcccaggctggt

SEQ ID NO: 72330 - DNA, 1682 bp, Homo sapiens
gataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatacaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggagagaagaactatcgatgcagtgattgtgaggaggccttctttaagaagtcagagttaataagacatcaaaaaattcacttaggagagaaaccatatggatgcattcaatgtgggaaaaccttctttgggaagtcccagctcctaacgcatcacagaacacacactggggagaagccttatgaatgcagtgagtgtgggaaggccttcacccagaagtcaagcctgatatcacatcagagaacacatacaggtgagaaaccctatgaatgcagtgaatgcaggaaaaccttcagtgagaagtcaagtctcattcatcatcagagaacccatactggagaaaagccctttgaatgtagtgaatgtaggaaagcttttgcctggaagccacagcttcttaggcatcagagaattcatacaggggagaaaccctatgaatgcagtgaatgtgggaaagcatttgttcagaaagtgcagctcattaagcatcaaagaaatcacacaggagagaaaacctatggatgcagcgattgtgcaaaagctttctttgagaaggcacagctgattatacatcagagaattcatacaggagagagaccatataaatgtggtgaatgtgggaaatctttcacaagaaagtcacaccttatgaggcatcagaggat

SEQ ID NO: 72331 - DNA, 1052 bp, Homo sapiens
tatactttccttcggtttctaacgcagcacttcttcatctgaggtagttgggtctaggtgtgtctatatgggcatcagtgggaggcaatatctgcaattaaatatggcatttatgcttgcaaatttgtctagagaggttctcaaagatgttcatgactcaataaaagttacatgccattggggtgcgggccctgcgggacgggacgagggcggggcgccaaccgcgagcacccccgcctccccccgggctctgctggcctctgcgcgctggggccgcctctccttccgcaggggcagcggggtctcctggaagccccggagcctcatggaagcccgggagggcggcggagcggggcccgcagcgcggggcccggaggggcagccggcgcccgaagccagggtgcacttccgagtggcgaggttcatcatgcaggcaagtgtcaagctagggatgcggtccattcccattgccactgcttgcaccatttaccataagttcttctgcgagaccagcctggacgcctgtgacccttacctgattgccatgtcttccatttacttggccggcaaagtggaagagcagcacctgcagactcgtgacatcatcaatgtgtccaacaggtactttaacccaagcggtgagcccctggaattggactcccgcttctgggagctccgggacagcattgtgcagtgtcagcttctcatgctgagagttctgcgcttccaggtctccttccagcatccacacaagtacctgctccactacctgctttccctcaagaagtggctgaaccgccacagctggcagcggatccccgttgccgtcactgcctgggccctgctgcgggacagctaccacgggggtctgtgcctccgcttccaggaccagcacatcaccgtggcggtgctctacctggccctgcaggtctgcggagttgaggtgcccgctgaggtcgaggctgagaagccgtggtggcaggtgtttggtgacgaccttaccaatcattgataatattgtatctgatctcattcagatttataccacggac

SEQ ID NO: 72332 - DNA, 1077 bp, Homo sapiens
tttatggctgcacagttttccatggtatttatgtatcacattttctttttttgttgttgtttttttaagtgttaaataatctttatttgatattacacataaaccacacaaaatgcctttgaataagtaaaaggaaccatcttaaatacaaggaattctaattacattggcatagttaaggccaaaaatacaaagaagacattgctaccttatcttcaacccttgcctttaagaggcaaataaacacaaaatacaggtgcatcttgcttggttctgagacagtgaaggaatttccccagtatttaaatatattcacataaccagtcatataaatctaaatataaaccaatataaatataaatataaaaccaatcttcaataagttttaagatggtactcaccatctttgtgaaaagttgaacattattaacaaagtctaatcatatctttagaaggagtaaacagtgatagcattcactgaattggaattactattaatattcaaaaaccaaacttattcatttaaccacaagccagtcttagttttaaatcaggactgcccaaaaaatattctgacagtcattcataatctgaattctggtgtatgagatctattatatcataggacacataaaaaagtcatgagacatttctgttttgtaatataaggtataaggcagtggccaattattactcactagtagcttttttgagataagctatcaagtctgccctttctgcattgttcttaatgctggcaaagatcatttttgttccaggaatgtacttcctgggattctcaaaatactctatcagtgtttcctctccccaggtgatgcctttgttcttatcagtctctgtgtaagataatccaatggcctgacctgtcttccacctgaagagaccatggagattaggcccagtcttttgcttgcctcccttttccacggtgtggcactgggcacacttctgaacaaaaattttcttgcctttctcaacatcacccatatttaattctctctttcatcactggcactacaaagattcccgctcagaagccagacatcccactctatg

SEQ ID NO: 72333 - DNA, 1047 bp, Homo sapiens
tgtagtagtttaccaaaattatgtttccaccatatcaaagtaaacaattcatgcctttatagggtcaggcctacaatgaataggtatggtggttcacagaattttaaaaacagagttaaagggaagtgatgtacattctgggggcattagggtagggagatgaatcaaaaaatacccctagtaatactttttatttaatactacaaaagctttgcaaatggaaaccatgcaattacttgccttagttcttttgtcataaaaacaatcacttggttggttatattgtagctattacttatatagcaacacttcttcaattagcagtctagacattttataaacagaaatcttggaccaattgataatatttctgactgtatcaatattttagtgctataaaatactatgtgaatctcttaaaaatctgacattttacagtctgtattagacatactgtttttataatgttttacttctgccttaagatttaggttttttaagtgtatttttgccctgaattaagtattaatttgatggaaactctgcttttaaaatcattatttgctgggttctaataaattaaaaattaaacttgaaaaaaaagagaataactatttctcaggtagagaaacattccatctttccaagatgtccttccttagtgttctgatggtataatagttgaatattttaatattccatcctgtcattggcctggatcctgcttaggaatgtggtagtcattataaggaaaacttgggactgtaacatccccccaaactgggaaggcgtcgagagactaaagaataatttgggcaagtccagcttgatgaatagatgagtttactaggacttacatactggacattcctaagcagctctagagtcaccctgcctcccgtctctaagctgcctttcagctaatgttctgactgtttgcctactctgtgtgcacgatgacagtgttttctttgacatgttctcaggtatgccctgggatgtttgggttctcagggatccctgctcctcagctgggcaccagggcct

SEQ ID NO: 72334 - DNA, 1008 bp, Homo sapiens
ttgttttggccgaagagacgaagcagtttgggatgtggtgtgtggtgatcacaaggctgcaggcagctggtgaagggagctgctgcgctttggcgtgatatgatagtgaagtaatgcttctcgtcgtagtccactgtccacgccatcgttacagtgttttccaaaaccgtaaccaactccctggtttaaaatcttccggaattttcatttgcccttggagtaaaatctcaatcttacccagagggtggcatttaaaggccttcataacctgatcagcatcatccctctctcccctatgcgttgtatagctcgcagccacacagaaatacttggaattcatcacaccatgccttggtgtttcctgttctcctggcctggacagttctctgccctcttcttctggtgaaatcttactcaaatgcttccaaggcctcggggtgtagctctctgggaaagctttttttgaccctaacctctgcagagtgaggagcttctcatctctgctctttttactttttgtattgacctctatgaaggcatttaagccattatcgttctttgtttgtctctcctgctatatgtggtctcctttaatccaaggggaagcatggacaataagaaaacaatctgtttcagtagatggatgtgaggtaaacaaaggtcccacagtggtcattctgtatgttgtgttttcattgtctgttatttcccattggtcatatgctgccttgtgtcaattttttgcgcattcattcagcattttttatcaactactgtatgccaggtgctgtgttaggtccggacaatatagagattttaattgaagcatacacagttgctaatagtggaaacttttcctatgaggagttaagtaattaagagctgatgtcattaatattgttatttgcaataaagatggaaatgtttttatgtataatttctccaaatatattgtaagcactttgaggtgaaaggatgagccactgttagactattttgtatcacttg

SEQ ID NO: 72335 - DNA, 1342 bp, Homo sapiens
gattacaggcgcccaccaccacacccagctaatttttttgtgttttttagtagagaaaaggtttcaccatgttggccaggctggtcttcaactcctgacctcaggtgatgcgcttgcctcggcctcccaaaatgctgggattacgggcatgagccactgcgcctggcccataatttttgtatttttagtagagacaaggtttcaccatgttggtcaggctgttctcaaactcctgggctcaagcagtctgcccaccttgacctcccaaagtgctgggattataggcatgatcccactgcacctggtcaatactttttttcttaagccacttttctcaggagatgtgtgtactttagaatgtgaaaatttccacttagaagcaattttcaagttctttcatgtcttctcatcagttttttttttttttttggaaatttaatcaagttagcaatctgctttatttgcctccttttattttctataacagggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcaggtactatgttttgtctcatatttgtttttacatacataaatttattgtaaattttaactctcaaagtatgtgtagtaaatgatttacaaataacaaagtgtaccgtattctttagtgtaaattccatgtagccaattctcacagactgctttcagtgatttttgctgggttcttctttctgtacccaacctacagttgcagttgacaaacaagaatagtttggagatgaatattgatattttcctttaagttaagagtaaggtcaaggtggagaaaaaagagacatgccaaactatcatttgttcgtccgtgacatgagcaacttgtttttgtatatttattctgcattattaactatgtcttatgcctgctttttctgctagttaaaacaaattatctggtgaggacctggtttaaaaaaaaaaaaaacaacttagaactatatagtgaagatatctcacattaagagaatgattctcatgattttataggctgaacattgatctttctccctacaatttaagtttcaactatgttttttaaaatacctagtcttttcttaaatgaccaaaacaatattagttttgactgtgtgtagtagttgttaataataatagcaataacagaagtgcctggcatttattgagcatgtgtgtatactacataactaccatacactgggtcagcactggtttagta

SEQ ID NO: 72336 - DNA, 1618 bp, Homo sapiens
cagataacacatgaacttgggaagtaagatttgtgtgcagtcttgcttgttctgtacataactgtcaaacgtaggagcaagtttaaggacattccaggatccagggtcttagaaaacgttttgtatttgcattggtaactactttgttggcagccaagaaagtctgtaaaaattactttcttggtggttttggaaatgttgaaattcaaatcatttatagcccaccatacctgagtcctttcactcccactttgggttgggcgctcagcagcactgagtttctgtgcacccctgccttccagactcacacttgccctcaccgccaagacctgtttgctgagtcagagatagaggtagcatacgatttcagcttaggtaagcagttttaagaagttgagattctgcttggaacaaaaaatattcttaccaaatttcattagtactacttttcaaaacctttaaaatcaatatgttaatgaatattttaatctgttttgtattttatagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggtaagggccacgggaggcagcagaaaacccatgttgagtggtcaagacatttcacaagcaaggaaagggaaacagtcaagctataagaaagtgtttatgaccatgggcggtcataaatgaagatcctccagcttttggacaccgcagcttatctcttagtctctggtttgtttctcttagaatgattatgactagaaaattaaaggctaatttgtgaacaaaaatcaggatggtttttagaggtactcagatgatatatgga

SEQ ID NO: 72337 - DNA, 1098 bp, Homo sapiens
agtatttatatatgcaatatttatcaagggctataaaaaacatcatttttttcatccattatttccagttttgggaatgtattttaaggaaatcattttaaagaaggaaaagctgtgcatacatagttatttatggcagtattatcttcattagtgctacagcaaaatagaacaacttagaaaatgcagtggagaagaaaaccctacataaatgtgaacacagtcatgtaaaaatatgtgtgtaatgtaaacaaaaatgaattttaaaaaagattatccatgtaaaagtacgaggaccagaagggggaacatggagaagtacaatagtcatggttggttaagactatgggtggaaaactttcttataattttctttttttttttttaataataaaattcctaaaagagggttggaaaactgatgttgggtttggaatttgatattttgtgaattattatatggttgactgaggaagcaaaattcttttgtgtgaagaggatttaatgatcagttatcatgtaccacagtatacaagggtgattccctgaagccacaaacctgtattttccggttctcaaataaatttacagtgtcaactctttatccattcttgttttggatatcatgtcattttcaggacaaagaaaccaaaagaaatgaatccaaagaaaaatatcagaaaaggcatgattctgacaaggaagaaaaaggcagaaaagagccaaaaggattaaagagtgagtgtaaatattaacgttttgccatttacgttgctatcttttatacaaataaccagttacctaaatttattatataaaaatttatataattttttttccttattttcaccttgtttttcctttttaatatgatgagggatctgattagaattactgagactggaaattagttgtggcagaaaaataaatgtgtttttatagcaagatgctaaattttaaaaaaccttttaatatattcattatatgtaactctgtgtcatttgtgtaaatataatattgaatacgcattttggatcacttcaagatagaccataatagaaaatccattatatatataaatattggaacaaatacttt

SEQ ID NO: 72338 - DNA, 1018 bp, Homo sapiens
attctcatctgcttggcacacgctgtctaaaacctcctgatcaccttctgcagcaatgtatgcccaagtatccgtttcgtctctggtgtttctcctttctttaagtgactgtttgttttccttggttttgtgatcgtctatggttttaaaatccagtggtatttcttcccttttccgattattctcagaaacatcatttttttcttctggagttaatttaaataaatcaaatgcatttctgatttccttaagtgctaacgaaaaaattaaaatagatggttaagtatgagtcacaaatttctgttacattcaaaagaaaatctaacttagtgttaaagcaacaagatattttcttaatttttactaacatctaccttgcttataaagcctggtctgatttactgtcaaagccacaaaatcgtttcagctggtctttctactggctgctcaatattcagaaaggatgtccagtgtgaatggctgttaagcagatgttctgaactactcacctgcagttgtgacaaaggcctactgaaggcagtgagtctcagagtgatccaagtcacaccagcacctttcccacagctaaagacaccagactgtctatagctggatgttgaagcttgtaccaaaatggcttctggtggcaagtgagggaaacagcagggtgccagagcactgcctgtgtacctggtaaaactgtacctgacgctaccagcttttaactaaagaagaaagtgggaagaaaactggcaggtactagacctgacataagaaataaccccaaaaagaagagaattaggatgaattctattataaactctgggtacacagcagacaggttttattatcagggaatattgaaaactggactctagtgagtacccttatgaatgggacaaacagtagttccatttaaggctgtatgttcacagtaaaaatgtatctgaaactgacatacaagatactaggaggaaaaaaggttaacaaggccaggtccagttttacagtattttga

SEQ ID NO: 72339 - DNA, 1087 bp, Homo sapiens
gccattttggtacaagcttcaacatccagctatagacagtctggtgtctttagctgtgggaaaggtgctggtgtgacttggatcactctgagactcactgccttcagtaggcctttgtcacaactgcaggtgagtagttcagaacatctgcttaacagccattcacactggacatcctttctgaatattgagcagccagtagaaagaccagctgaaacgattttgtggctttgacagtaaatcagaccaggctttataagcaaggtagatgttagtaaaaattaagaaaatatcttgttgctttaacactaagttagattttcttttgaatgtaacagaaatttgtgactcatacttaaccatctattttaattttttcgttagcacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcaggtgagtttggaatcattttgcagaatttttcaaggtagtgcaccatattattttactgtactcttctctgtatttctgatctcaacgatcaaaaaataatggagtcgaagagtttatttggatctcctgaataaataacattttatattgaagacgggtcattctgtgacttctcaatggatcaaacaatttttctgagttcctataatgttctcagcacgtatagaaattaaaagatttctgattttctaccttacctactcttacctggcagccccattttatatcttactatttaatagatttctttcaggaaattatcaaatataaacttatttgtattttacccttttaatgttgtagcaagtaacactaaataagattatattataaatgctgtcctgaggacattggagctggtcaagaagaagaatacagactacag

SEQ ID NO: 72340 - DNA, 1200 bp, Homo sapiens
aggggcctgtgggagtctggaaggatccataagcagtgcctttgactcacatgctgggatagctcacatgctgagaatggctttatctgtacatggttggaagcagtgtatgtccaagaagaatggtgtaagggagaagagtcacattagaattgcatttcctcttaccagatccccgatccctccttcctttgagctacttagtcttaaaattcctcctttgctattttacaatgacagcttacctatttatctttatgccttcagagtaccatggcttctaaatgtggatcgttcatattacttcccaaagaaaattggggattttatcaattaaaagaccccattatacaatgacttgtgttaaaagtgtacataaagctttggttaagacaccacaaatttcataaacaacattgtgggttttttatacttcagacaaatgtatgttaacaaggctattgtgtgttccagatggcaggcagcagattctgagtttgggcatggacctgcagttggaatggatgaagttggaagatttccaaaagcaccttgatgggaaagatgagaattttgctgcaacagatgcaattccaagtagtgagtagttttggaaatattgaaatccctttcacaaatctagatttataaaatctaacttattttttctttcattttagatgtgttaagggatgctgtgaaaaatggggattatattactgtaaaagttgcacttaattcaaatgaagaatataacctggaccaagaggtaatatgtcgttgaaaaatctcatgaaaggaaaatggaaagtaacacttgaaagaattcagtttaacttttcatttattttaattacaaaaggctgggcgtggtggtgcacacctgtaatcccagcactttgggaggccgaggcaggaggattgcttgagcccaggaattcaagaccagcctgggctccatggtgaaaccccaactctacaaaaaatacaaaaattagctggacatggtggtgtacacctttggtcccagttacttgggtggctgaggtgacaggatcacctgagcctgggaggtcaaggctgtggtaagtggagatcacaccactgcaccccagcctgggcaacagagcaagactcccatctcaaaaaaaaaaaaaataatgcacgttcactttgtaaaataaaaaaattgtagaaccc

SEQ ID NO: 72341 - DNA, 1113 bp, Homo sapiens
cactttattgctaaaaaatgctgacacaacaacacaaaatgagcacatgctgtggggtaatgatgtgaataaacgtgcttgtggcagggttaccacaaaccttccctttgtaaaaaacacagtccctgtgaagtgcagtaaagcaaagctcagtgaaacaaggtaggcctatagaggaaagttgtaaaattttatgcaaacattcatatgtgaaaagatactctaaaagctagtagcttctgatggttgggatattttagtgaaaatcctaagtagatgcctaaatcagtgcctattagtgatttcacattgaaacatctcgagtgagaagacttggttctgaaattgttctgactaaagattaacacgttttttatttaacaaaccaacacaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaaggtttgtggcttcttatgcatcagtttcagagctttcatggtattcctgccgatggactgagaggatctctttggtagtgaaatatagcagtcacatggtcacatcgctttttttttttttttagacggagtctcgctctgtcgccgaggctggagtgcagtggcacgatctcagctcactgcaagctccacctcccgggttcactcctgcctcagcctcctgagtagctgggactacaggcaggtacctgccaccacacccggctaatttctttgtatttttagtagagatggggtttcaccatgttagccaggatggtctcgatctcctgacctcgtgatctgcctgccttggcctcccaaagtgctggtattacaggcgtgagccaccgcgcctggctgtcacacggtcccatagctttttaaaaatttatttttagaaataaggtctcactctgtcacacaggttggagtgcaggtggcaccatcataactcactgtagcttcaaactcctggactcaagcaatcctctcgcctcagcctcccaagtagctgggactaagtgtgtaccaccacac

SEQ ID NO: 72342 - DNA, 1021 bp, Homo sapiens
ggagtaactttttaattttgtttcagttgatctgtgacatgtaatgaatggatttatcatcagtagtacattgtaatcacatttcaaaatgtgatttatctcgttggaagtaatttatattaaaatactctgattaaagtactaatattttaatcttagataatttaatttttttgaataaatggtatttgtattccttttggttaataatttaattgaaatgtttccatatattatctttttaaaggatttatatgcagaggttcttaggttggagctagcggttccattcgcagttgctggcagcacagtgagtggccacgtttgggcctctgtggggcggggtgcacccccgtggccccacgggaatgctgcagcccgcaaccacttgtgatagaacctgctgggtatttttcctgatgactaaaaatttcaaaatatctgaaaactgtcttttaaataatttgggaaattaaatttgcctttttttcttttcatagaactttttaacaacagtggctattcttttggaagcaggagcttttgtaaatgtccagcaaagcaatggtgagactgcactgatgaaggtaaatccctcctgcaggtcatccctttcttcactacgttggcaggtgctcgtgttggcatctgccactgccaggcactgtgctggggactgagaacagagtgggtaccaagacagtcctagagtcagccgcttgcaggggagaaggagaagcgggctggcagggtagcagtgagagctcagtatgggcagtggtgtgatcagaacaggcacagagagccatgaggtcacagggaagtgctccgagctgggccctggggaccctgacaatccttagggtggatgaggcaggtgccacactgtgtcctaaatggcagtcaagtcagccgggagggagcactccggccgcagctggagcagcagggaggctgctggcctcgaaagtgcaggcctaggggtgggacggagttcctcgtgcactctgtgtgttcgtca

SEQ ID NO: 72343 - DNA, 1054 bp, Homo sapiens
tgagaggtgtttttgagattcctgagacaaagttgtctacagtgaaggccaggcttacgtatctctgcgcctcgctgaggggctggctcacgggggacagcgtggcatggacagagggcagcagcaggggactgcttagcaaggcctggtgtctgttctgtcttgggactgaagcatcctttttgaagttgcccatttcctgaaaactcagtgctaagatattaactgaatgtagcacacagatttttatgttggcccctgagtcaaagatactccccacttgcatttaagcaatgctgtgtgactcctaacgctgtggcctgacgggccccaaaagttctctatccttcttccatggcctgtgccctctcttcacagaaccgctaagcatgtatggagaagggaccagcacccatgccacagtttacagctaagtaattgttactcctttttacctgacgtaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacgtaagtgagaagcgactgtgccatagttaagtcacatatcatacatctgtttatgtagacatattataattggagtggcctgtgtgtaactgctcagaaaaacatccagcacaagtcctgatggttttgtttccagtagatcacagatttaataaatggcatatgaattatttttctgcaagttatttaactctcagaaaatttcaaacttaacactggcctatctgggagtattttccttaaatattaagtatgctcttaatttggttagcaaaggttttcttaaaaacatttaaacttggccgggcgcagtggctcacgcttgtaatcctagtactttgggaggccgaggcgggtggatcacttaaggtcaggagtttgagaccatcctggccaacatgatgaaaccctggctctactaaaaatacaaaaatt

SEQ ID NO: 72344 - DNA, 1028 bp, Homo sapiens
attatttggtctttgcaggttggcctctttcatttagcaataggcattcaagattccttccatgtcttgatagtgcatttctgtttagcactgactaatattctgttgttggttgtcaagatttactagtttattcaagttcattctttttcaaataaattctcaatcatattttattttattgcaggttcatacttataacacaatttagtatttctatcacttaagaactcttggcaacacatatcagaaacttgcatgtatcagacagtagcgaactcaaggcggtgtttatgtagcaggtctcgggtgggcctctgggaccgcgcctgttgaactcagtgctgctgatggctgcagtcccaactcctctggtcacacggggggtttgcatagatccagcaagtagagtgacccactttcctgatttgcccagtactgaggggttcccctttctgattttccactgattcattagacaactatgtattaagcatagactttgtgccaggcactgttctaaaggctggggagatggaaatggcagtggagggaagagacttgccttcttagaacttcaattccactgagatggacaacaagacagacacatgggtgtcaggtgcttggtggaagtagagctggaaagcggaggcaggcagagctgcaggtctttgtttggaaggttggcctgggaagccctcactggtattcgacaggcttgtggttcttttctacattaacgttaacacgtactatttttttttcttagactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggtaagccgatgcctcccttcacacttttctatgtgaagtgtgacactatattaacagatttttagacagaatcctttcttggaacaaaactttaaggaaat

SEQ ID NO: 72345 - DNA, 1024 bp, Homo sapiens
acagacatgagccaccatgcctggccaatttttggttatgtattaatcagaaaaattggaaggggcaaaagggtatgtggaagaaaatggaaaaccactcagacccacacccaaagatgcccaccacaggaatgtccctgggacgtgtgcacattcagcagcagtgtttaaataccagttaaataacttcagtgtagaaaatcatacgtaagtcttttccaggaactgtcagcagagattacttgggcaaaaggtaaaaagagttctgtggttgaaaaatgccaggtgacacgagctttgagagggccagcctcctctgagcctccaggcagagtgggtgatgcctgtctgaccaggcccagctcaggggcctgcttccatctggtgttgagtgttcctctggggactgaaggttgcctttgaagtaattcacacacatctcccattttcaggctctggcatcctgctgtttatcttccatgcaaactttttgggtaaagaagttattgctcggctctgtggaccgtgtagtgtacaagctgtagttctgaatgataaatttcagcttcctgtttttctggtaagatactctgtatttcactactgaaaagtacattcttctaatcaaaagcacagatgacttaattttaaattcctgtgtcttaataaaatataagcattcagaaaacgatccagtaatagtggttgggaatgaggcaatacccataaagtaaaattatcctaagttttgtcagtaggaatttttcctgcttattttttgccttaaattgtgctcaccatactgtcttagggccagcattgttctgaatataaatacttaatgatctcaaagattctttgtacataattactttgccactgttagaattatttccttggactgaattaagcaaaatttgctagatatagacattttaacacttgtactgtatattgctgggggcattctaatccagtttcccagattgattctgtcatttgtatatttttaataaatcaaggg

SEQ ID NO: 72346 - DNA, 1081 bp, Homo sapiens
ttaattcaagaaataattccaagtgcttataattttatattactgttttattagagagactattttgtccagcttcctttcatacaagagaggttagggaccggcctaaagacatacatttggcaactccataccaaggcctagatcatgattcagatggctccatcctctagagaggcatctttctcagctgcaacctagttcttttcctgccgcattattatgtctaacacattgtaaactgagagagggtgcacctagcatcactaccccagggagtgcctgtctctaggacaggtacaccaggattcttggaattttttttctaatgttgataaagtaatctggagcaacaacttgagtagtgacactaaatgtgaagaaaggactgtcaccttggcagagggtgcttctgtcaaccttatgaagagtttattgggacctgcaacagggctgaatgagtaaacaaaatgactgtcctacaatggaaagagaaaaaaaaagtcagtgttttcaaacttacaccagaagcccttaaaacaccaatgatgtaaaagaatcataaataagttttattttttatttcataagtcaagatgttgtggaggaggccaaggcggacaatcgcttgagcccagaagtttgagaccagcctggccaacatggtgaaaccccatctctacaaaaaatacaaaaaattagccggatgtggtggcgtgcatttttagtcccaggtagttaggaggctgaggtgggaggattgcttgtgcctgggaagtcaagactccagtgagctgtaatccgcgccactgcactccagcctggacaacagagcgagaccctgtcttcaaaaaaaaaaaaaaagtgatttatttttcccttgatttattaaaaatatacaaatgacagaatcaatctgggaaactggattagaatgcccccagcaatatacagtacaagtgttaaaatgtctatatctagcaaattttgcttaattcagtccaaggaaataattctaacagtggcaaagtaattatgtacaaagaatctttgagatcattaagtatttatattcagaaca

SEQ ID NO: 72347 - DNA, 1020 bp, Homo sapiens
ctccctggctcaagcaatcctttcacctcagcctcctgagtatctgggactacaggcttgttccaccccatgttacccaggctggtcttgaactcctggacttaagcaatcctccaacctcagcctccaaagcgctgggattataggtgtgagccaccacgctctgctaaaagttcacatttaatactctcttttaggtctcatagtgtactggtttacattcttactacatcttagattctcttgttaccctttgaaaagatgataagtgactacagcatatttacaaagtgactgccatctccaccttttgtgcttggggaatgtgtggcaactgtctactagaaaaagatcaggcctcccaaccctttcaagggcagcaaacccacactttatttggtgcttgggtaacttgaatataacatggctcccttgctgtaagcaaatgttttagagctgaatttttcctttttttttttttttttttaagcacagaagttcaccagggctagtagaaaatttcaagttaagaaaataactcttgctgggtgcggtggctcatgcctgtaatccaagcactttgggaggccgaggcgggcggatcacctgaggtcaggagttcaagaccagcctgaccaacatggataaaccccatctctactaaaaatacaaaattagctgggtgccatggcgggtgtctgtaatcccagctactcaggaggctgaggcaggagaatcacttgaacccaggaggcagagcttgcagtgagccgagatcgcaccattgcactccagcctgggcaacaagagcgaaactccgtctccagaaaaaagaaagtgaagtctttaattttcttaaataatcctcatatgtactatccacattgtggaaaaactgaaatacgcagtctggacactgcactgagattccggcatactggcacagacacagctatgtcgcatcttacagactacaacagacaacaggcttaactgcaagaggtttacagacaaaacttt

SEQ ID NO: 72348 - DNA, 1050 bp, Homo sapiens
tgaggtatcaacaatctgtacaagagggcctgtggaaataaggagggacttagccaattaaattcttaataaattattagcagatctgaaaattatttggtatttaggacttaatactgtttactgtagaagataaaatgaagctgattttaattcagttgatgttctttgaggaaatggagagtattttgaattaaaaagaaaatccttactgaatggaaataatcagcacgcagcactacatggtatcgaaacctcaattactgttatgaatttactaaatgagttaactctgatttttctcattgtttattgaaatcagttcttaaaaaggctgaatctgatttcattgtatttctagggtgataaaagaaaatgtggctgaagttacccgaagttcagcttgcagtgtaattcagaagagttaagaccagaagtactggaatcatacttcctttcaggtcagtccgtatctgctcattattttctaacagatccttgagtattcgtttcttcctagttttttctagtcaattcttcctgattctgattctgtggactgtaatgaagatatgtaatggtcccagtgttttgagtcagtagaatatttatgaacagtttataggtgaagctgaagcctctatagcttggcctgtcttcgtaggaaaccctggcatcatatctcagcaaggctagaggggactctcagcttcgccttgccctcctctttcctcactggtgtaatgcgtatattaatttgtcttcaggtaaaactggactaagaggggaaatgactaagaggggaaatgacatagaggtcttggagtgaggagagagaaaaaaaaggtctttgtaaaaaaatttcctgttgatttttaatgacctccaaacctagaattttaaacttgtgttcctttggaaaatatgtaatctcttttttttttttttttttgagacggagtcttgctctgtcgcccaggctggagtgcagtggcacgatcttggctcactgcaagctctgcctcccgggttcatgccattctcctgcct

SEQ ID NO: 72349 - DNA, 1102 bp, Homo sapiens
tttggttacataaaattttcatgtgtgttttcccagtgttcagtgtctttgccatttccttaattttgcatcctcgttatcatcctgtttttattttgcttttgtcttcactctaggcttccctctggaggcctgccttttcctgctctagtctgaactggctgctgtctagagcagccggagcagaactgtacccttcagacctcagtgcttctctgggttggatgtgctcttggctggattatcattaattgaacacctgacagctcatgtcgacagttgactataagttttctgtttgtcctttaatagttattttcctttggctagtgcacacactgacacataaaatagcctgggtgctagtgtaggaatactacaatgagtttcctttttttttttttttaagagtttatcacaccattaaaagtaacttatgtattaaaatgctaatttaatgtgaatgtgtctttgatgccatataaactaataagcgaacactgtatttggtcaacaaaatgaatggtttctaaacaatctatagggtccataaattaattgcaagagattatgtcattgttatatttgtgaagggcctagattgcttgagctgagttagtagacgctcgagtcatagattaggaataattgattctacagtaggtctgggtggcatggaatataagctccgtccagcaaggatttgctccatcgaagataaacgcagccagcgtggggtagatatgaggtgctcctgtcttccagcaactccagacaactgatacatgttagaagacagcacattaattatgaaacaatgcagaaaagatcttaagggagaaagaaaggatgacaaacatcaataatggtaggagcacctttcagcagtcaacttggactttacttacatatgcatgaattgagaggcagacggaaggaaaaattcaagaatacacaatacaaaataagtgttggaatcttgttctcaataaagcatacatcttgttatcagttttgggagcatcgtgtgacaggaggttatctagtattatctgtaagaatcacctgctatgtgtacagttcagtagtagtgctaggtata

SEQ ID NO: 72350 - DNA, 1257 bp, Homo sapiens
aacttatgttctgctgtttgtgctacaggccttaaagtcaactaaagtctaggggttcatgtcatgaactttttgacatatgaatggatgaaatattccctaggttggctgaaaatatagatctcatagtttgaattattttggaattacttgaatgatatagaagactaacctatcacagccagtttctatttcttttctgtaggtcataaacacagcatagatacacatgttaaataatttagcagtgcttgaaaccctcttagttacatactgacttcctacagtttgctatgtagactgtagtttcttgcagtttgaagtgtgaacacagtggacccatcctttgccctgatagcatttgtgtaatagagtgacaaataatatcttaccatgtagcgataaaggcagtagagaaaatgacagctactcttttagttaaggggcctagaaaatagctatcttaggagacaaaggggaaagaaaatgatttttatttagtttgtgctcattgaattgagttgtgctgaagtaagcggccacagttctgcctgaagctgaaccatcctagtagtagtggcatttggctgttgagtccttggaatgggactagtgagatgaggaactaaagtttttattgtaattgacttaaattcagttattgatagaatattaagcatacttggaacgacttgattatattaatctacttttgtatctttgattttatgtaatctaaatacagttaagtatttttgaggaaaattttgcatctgaattagatttgcagacttacgaagaaaagaatgtaaaatttctcaacttttaaatgtggcatatgccgaagtgataatattttgactacattgggttcaataaaatatatataattaagctaatttcacctgttgcttttttccctcctttaatgtggcttctaggaagtttaatatttcacatgtggtttgaaatatttttcttggccctgatcttagaagaataatttagtcacattttaattttttcctttcaatgattgtaatctctgaatcccattacataggctataattatgtaatttattgttccttttaaaatgaataaggttgaaatttaaagttttagtgtgtgtgtgtgtgtatgtgtgtatgtatatatatatatatggttttttttttttttttttttttttttttgagatggagtctcgctctgtcacccaggctggagtgcagtggtgcgatctcggctcactgc

SEQ ID NO: 72351 - DNA, 2470 bp, Homo sapiens
atgaactttaaaagagatggtattctgcttgtacacataaataaaatttcagttctgtcttgtggaatataaatcactcaaatttcacatgaggtagttcagtctcaaaattaagaatagaattagaattaagtaggttcaagtggaaatgtacttagtttgaacacatttcattttagattttcttcatattttaatataaatttagtcaataagacaaattattcattaaatacgaggtcctacattgtgttgatagtaatataagtggaccttatattttttaaatgctttgtttaagtgttttgttgatggtgttgaagactttgaaatagataccttaatctaaattttatcttaatttttatttttatttcattgtctaaatttttatctaaaattttttctagctctttattacaccaagacagcttcacatttttatttatatattgtacatctcatgtaaggaattaccgtatataagctagtgtcataacttaagtagccacattcattcagtatgttttatgttttctctctgactggatctctgatacattctttcctgttctagctgcttttatgcaaaagggcattatatgtttgtcaatcaaccaggcttctgtgactgtttagaagaattatgtaaatatataatcctgtgcctgttcactttgccatgtttggaatacaagttatttacattattatctttatggttatttaaataatttactttttgcaagttatttgtattatttattacgtgaaaattgagaaaacatcttagtgtacctttcgtggttaacttttcctcaggatatttttacattattagataatgtaaatcagtattaagtttcagacattctttagatttaaatatgttgcctggtgtttttatgtattgagaaaaagtaaactaaattctacatagtcattctgtatgacttttagtaatttctgacctttttggtgttagaggcaataatagtaagttgcttagttgttaatcactgtatgttaattctttgagttgattagaaaatatgttcccagacttgaatgctttacacattaggataactttggagtgagaagttcagataactgaaaatggtaatgggagtaattgtctacaaaaacttttcttagtcatataagattttatgaggtgccatgtcattcagaatttcactatatccattaattcattgtaacagcatgtatcaaggggacctactgtgtattggttagttttctagggcttaagatacaacagtggaaaaaaacttgtcctctaaattaagggacagcagccacagacatccttctgaagttagtggttctcacacttgagcatgcattagaatcacctgggaggctcattaaaacacagatctctggactttattccagagtggtctgtaggcctcaggtggagccaaagaacgttcatttctagtaagttcctatgtgatgacgctgctactgttggtaagaacccctttgagcatctgttttcagatattgtgcctcaaaagaggctattctgattgtgatttttgttgttgctgtagttgactgtcccagtacactgtagattggataagatccctgacaatcaaaacaccctcagacatttacagctattgccagttgataagcactgcaaaagtccattatttctgactaggaaacatattagctattgagtgttatttaatgcataaattcatttatcatacatttttgaactaggattttaaaacctagttaattcaaatgaagagggtatgtggagaagtgtactttgaagattttgtgaaacaagtttcctcttagcagattctcagcataccagtatgagatgaaataatgtaactgtttttgtatcggtatgtttggacatgcttctggctgctggatgaaggtgctagaaaactgtcctgtctttacttaccctcatggtgaatatgaatagaatgatagtttggtggattaaaatgatggcctgactttctctttggtgtaagcttgttttgcttttctagcttgaagataaaagatttgataagtgtatttcccaagaccataagtatatatattaaaatattttctttgtagcgtcagatatgtgtgtgtgtgtgcgtatgtgtgtgtgtgtgtgcgtgtgtgtgtgataaaggcctactcaaaattatgcagcacaataaaaaattaaattggttcataatgagagcatctatttgctgtattgacagttgtttgttccaaaaaattgtgactgtaccagtgcaaagaaacagtcacctgatttcagtcctttaatatcccagaaagtagattctataacattgactttgatgtgtgtatgttaagaatatctatatgtaggaaataagtatagagatttgtttcttaattgtaatccggatatcacctggggactctctgactctgcttc

SEQ ID NO: 72352 - DNA, 5909 bp, Homo sapiens
gacagggtttcactatgttggccaggctggtctcaaactcctgacctcgtgatccgcccgcctcggcctcccaaagtgctgggattacaggcgtgagccaccgcgtccagctgagatagtttttaagtagtccaagaattaggattactgtctgtggcatgctgtggtacctcagtatatagcaaatgcatatgttaattacagatatttttctgtgctttttaatttgtttccatcttttaccagcattctaacgttcaagcattttatgatagtgttcttttcctgtgtggactccttatatttgatggggacaaaagtccaatatgtatgaacacacagttttcagtaaatatttttgataaaaatattacctgtcatgatttattgcaaagaatttggctgtaaattaacattaaagtttttgtgtatttccaaaccaccattgtggcattcttttcacagaattttaaattatatttagtaaatttaaagtagacagttttttgtcttgatctgagagtgtgaagatatctttgtgtggattaaatactatgaaaacaaggtttttcagttgtaatttttattatatttaaatatattagtagcaagaatgataccttttatcatttctattaaagtctgtcactatataaatcggactttaggcaaaccgttttctcatttagtgtttgttaatgcttgttgtaaataacattttgaaagggaaattgtttggttatctattttgaaaaggcagtttagttttgaaactactgtatgaaatcttgaggcgccaatgctgctaagaaagaaagaaagcactgcctgttagactcagacctgtcatcagttgtaaatccaccgtgatcagagacgttaaaagcaatgcattgtatgtcttagagttgaatgcagcatttatcattattttatttgcttcaagaatttggagaaattggacatgctggcagttggattttttaaaatgatagtttatacagggagatgaggcagtgcacggctactatgaacagatggcgcttaacacagtgattgcatttatttccttcagtagaggctttattttatagtgatatgtttgaaagctagtaaaaacttatactactttggttaagtttttgtgtggcatataatcatcaatagaaacatagaagtaacattaactgtcccatttttttattgtctccctgaaattgtaaactttatttaaatatcacccttggtctgttttgcactgacattttactgctacacttcagggagttctatccaacctttcagattaatatgtatgattattgtgaagtttttcaaaatacttaattcagatgtttaaatgtgcttattagtgcatgttattacattaatttttaaaactattttcccatgataatctttcaaggaaaacactctcagaagtttccatactgaaatcataattctttgtgtatgtttgtattagtgctttctatcttcaaggaattgatgtgaagatttttttttagaatgtttacttttaaaaaaccgaattgatgctgctccccagttttatttctctgatttttttaagaacgtatttttcttacatagcgtagtttcatgcaatataaacttttgaaaaaaggaatcagagatttattataatattgtttaggcttaagattacatttgcttctgtcacgaaatcagttctttgttctttaaattggggcatagcattagcaatatgtaaatcttcagatgctgcatttttttaaaaaaaacatagtaactaattaaattgctcctttcttccttctatgtgtgatcctgattctgctggactttctgccgaacttcatgacaccaccacttgggattttgccaatttttcttgtcacttatatttggcgtgttccaaatggacttcatattctattccttattgtgtggtatcatagcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagtttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaactgttattagtggtattctcttacggtcttactaaactttgctgtaacagtaatgctttggttgctttaactaatcctatcattaaaaatgaaaatgattttgctttttaatttgcgcaagtagcactaaagatagaagcttaattaatgaaagctaatgtcaataaggggtagatagagtagtatatgtgggggtgggagggtatgggagtttaatttgtataaaccactgatgttctgtgaaatcggaatttccagctacatttcatatagcttctgaatattcaggtattctgagacagattattaaggatatctttgtcctgtgctgatttttccaaataaatctttttcatcttgaaaaaaactgtttgaaggcaaatctcttttgcttataaaaaataatgtctagttttaaacatatctgccattatttatttggttttaatatctagaccttacccgattattatcgtacagttagtgttaaacattctttaaaataaaacaatactgttgggttggctgtgaagtgaggatttgctgtgtgatttgtggtgaattaggcatttcttgagaatgtaggtttctagaagtattaaaagatggcttgactctgcagtgttgtaaatatttccctaaaatttggacatttctccagtaaaacgtgtctgatgggttaggaccatttgtctccaaggaatggcagtggttttctttttaattgtttgtttgtgtttttcaagataatgctgagagacatccaaggagtacagttcaagaggtgattttaaaaagcagataattacttgagaatggctagagtcattggaatctgattagctcctttcactatcaaatacctattttgattttcaatactagggagaaactgattttatcacattataatgtttattgcaaaacaaagtcataactctttaaaaatgtgtatgttggtcatgtttatttaaaattacatttaaggaatcatatatgactcataccacaaatgtaattcatcagacactgatcatagcatagctgtttctcataaaacatcattatggtttgctatatcatgctttcagcacctttctgaaagataatatgctattttaaaataaacactatgtaaatagtggtgtctgttttgctggaaggtgtagtttggaaagaaacaatttaaattttgcataaaagcagttggttgtaaagcataattgatgcattcttttatactaattaaaattttcatacgtactctttcatgttctgctatttttttgatacacagtgtggatggaactattttccaaaatttgtggtattcataggcttttgtttttgacagttctttgaaaacatgatttggagattgtaaaataatagtcaaagactattctcatgtttctcataagtatgaggtgatggagagtgggatttgctttaatttgtgacattaattggggtatggggagttttaacattgattacagtttttcagtgatatctattgcacttaaatctacctttcccgtcatctatattttattcatataattctcaggtaatttttagcattgtatttcacttcaaagctgaaatatgattgggagaaacttgatcctttgatgttaaaccaaggtacctttggccaaggctgtgaaattctgtatgattcattcaagaacactcgaaggccagtgcacaaaaagatgtcttaatctcctgaacatcctagtgtccaggctcaactctggcaccaagaacagagttctacacaactttttcccagcatcaagaaaatccttgttccggctttaccaagtttacgctgggagcagtcagcttctgagtgacagtcaagtggagcatctctgaactcccagttattccgtgtttttagtgtttttgtatagttaaactttgtggctggttcagtcaatttttttttcttgtggattagtataccaaggaagatttttgaatatcatctgcttaaaagtggtagatacaaaaataaagaggaaattcagtagtgttagctttctaagtaagtgtgaagttgtcatatatgctatcttttttttataaaaagtaatatgaaacaattttaatatataacaatattatgatagtttgtgtgatgatttgaagtactgagtttaaagtcttcaggacttaatgtttcatgtgctacttgtaattagtgtgtataaaataaaggaacacctgttttcctaatagttttattctagtactctatgttgttggaatttcccccatttttgtatattttgtaaataaatgcatattttttttcttgacagatgcagattttaaaaaactgattcacttgtgtttttgcaaaattcaatttgctattctttcttgaggttttttttatttttctgtgtgaaatcagtgctgagcacttagtgaaagagattgaatatttttaaccctgaaatatcaataatattaggggaacaatatctgttttagctggaattgccatttaataaaaataggaattgtaaacaaggacagtgactgaaactttggctcttgtttttcaaacactatttgaaataatacctttacagtttgttgagaaacatacttgttgaatatttcagtaacttgctacttatatgtagagtctctaataattgctaaatagcaatgtgaatgattagtagtcattaattagtaaatggggattaggttgatcattacaacatagattctgaatgagaaaaaggacatatatgattgaaatcaagtaagttttgtgaaaggatgtgatcatattatggtaaaagctttaaaaagggttgagatttagtgtcagatggtattagtgaaaaataaatgggccacatcattttgaaaaaatgaaggaagttcctggggagtaaggtattatttaagtgttttctgtaggtgttcagagttttgttacaacatctaatgtgttaaaatatatttctgaggtgtcagaggatagcagtgatataaaaagtcagacttcttattttcaagaataaggcagtaaatatccatatacatatcttctaattcaacagttattcatgttttcctgtgttcatagatgtttttaggcatggactttttggggggatggcaaactactttaaagtaagtagcaggcttgatgttacttgtcccttaaatatttcaacacatgcctccaaaaacaacatttttaggttaatttcatactgatgaagattcatttcttgaaatcgaagagtccacctcttatgtagcccagcatggaaacatttcattctaagcaaatcatataattcaatgaattgggagtagtcttatactttacaagatcattttgtttccagcagctttcattactgaagtttaaaaattaaaatcatttttctctgttcactttacatgtttttct

SEQ ID NO: 72353 - DNA, 1541 bp, Homo sapiens
tcgtaggccttactaaatttgaaatttgaaatgtcatacatttaaaagttggataaggaattaaattttattaaattaattgtcccacaaaagctgtcccacattaaattgtcccacaaaaggtgttatgaagctaaaaatctttatataacttaaaagtacatagtttcaaagattacactaccatggcaaacaatgtacttaacatgcacacccatttacaaaatcaagtgtgttctcagcatatatagtctatcaaatgaaacttaagtcatgtgtggaatgaacattttccatgatcagcttttttttcttaaacttctgttgccagtttttcaatactactaatcagataatgtagagtcatatattgctgttttacttggtcactttttaccaacaagtagttagtgaatatctctgatatatgcaggaagcaagaaacatggccctcgcccataaagaacttaattgtgaaattactgcagtggatacgtgaaataattaatgaaccaagagtgttctaaattatgaagcataattgagtataatgatgtccaagtggtccaatatttatgtctttttttaagagtaaatgctggggtgctatttaatataatccatgtaattttaaggattttaggaataaggttattgtagattataggcagtttaaaaggctgttatcattattagaatgacattaacatcagagctaaactttaaaatagtataaaacttaaaaccatttctgatggtgcagagatactctgcaattttatcagaagaaatatcagaatatgcctttagagtccttatttagttaggaattgaagataacttaaaatttttgtgacattttattcaccagaggacttacttacattttagcacttaactctcctaaagcccagtttatctaattttctcttcagtcttcattcaatgtgagacttcatcataatggttttgtagagctattaatcattatcatccagttgggttgttgagaagttaaaactgtcataactcatcaagttacattgatggaaagtggcagcagattttctggtgtatcactagtgtgtataaccaaacgaaacctacattataatgctacctttctagtaatcagataatgctaacattttttatatctttaaatttatttatagctatgtggtggaagatgtgaatactaaaagtaaggctctaagttaactgctgttagttggaaatattatttttgattttttatacccatagttgtatagttatattctgaacccaccattgttaaattacattctattaaagagaaagagaggaaaaagaaaacttccgaacccaccattgtaaaattacattccattaaagagaaagagaggaaaaagaaacttagtttgttttctgggggattgttgaggtaagacgcctcttagatactgttcttatattctcttcatgtctagattgtagaaattattaaaaatagctatttagggctatactgagggagcggaaatattcttggttaaagt

SEQ ID NO: 72354 - DNA, 1139 bp, Homo sapiens
agtaattgcttgtgtgggctatctatagtccctggatggaataatgcttgagtagatgaatacaaatacatgaatgaattataatatttagacaatgaagattgtaaccttatttttagcataattccctaaagctatttgtgttatatgttcaaatacatttcaacatgaacttggtaacagtcatttctattttaagacttcagtgacctgggaggagaaaataattggctctggtggttatcattactagattttcctttgcttggaatctaggcatgtgtctttcatctgttggaataaaaacattaaaaataatttgtgatatattttatataatctgattcattagtaatctaatcttgcaatataaactggatgcattaagcatttgtagtatattaagcctgggagactgaagtttcttttcagcattcttattaagtttatgatgatggaaacttttcaaaatttttaatgaaaaatgatgtcccaattcactcttttctttttgattttagatgggaaatgtaaagtcataagatcgataggttgactgtgacaactatgtttacttacagagagaacaggaaatgagaatgggtgatatgggtccccgtggagcaataaacatgggaggtagggatttgaagcaaaaggcttttgtaatttatcatttttggggggactgtttatgctgtttgtggtatctacatatcagtaagaaactaaaatacagaaccaacatttctaaaggtgaaatctcttacatccattaaactggaatacaatacaattatattaaaaatatatgtctgggaagaaaattctcattttgtttttgtttgaaggctaaaagatgtgttatacattcataggcttaatgaaagaaacatataaaccaggttgcaatacagcctgaaggtagtttagtcattgcattgtgtaatacagctctgtctttgcagttttaaaatcaaattttatgccttctatttggctttttttttttttttttttttgaggcaggacctcactctgttgcccaggctggagtacagtggcacaaacttggcttgctgaaacctcgacttcctgggctcaagtggtccttccatcttaccaagtagctgggacta

SEQ ID NO: 72355 - DNA, 2063 bp, Homo sapiens
cttttgcagtccatctattgcagaaagctttttaattaaaacgcatcaaagaagacctgactttatacggagaagtgataagggaggagtatgttaataacctttaaagataattgtggatttttttgatactactgtaaaacttaaaagtactcttacatcgaaattaattgggttggctgggcatggtggctcacacctgtaatcacagcactttggggggttgaggcaggtggatcacttgagctcaggagttcaagaccatcccaagtaacatggtaaaaccccatttctacaaaaaacacaaaaattatctgggcgtgatggtatctgcctatagttccagctacccttgaggctgaggcaggaggattgcttgaatctgggagtcagaggctgcatgagttgagatcacgccattgcaccccagcctgggcaacagagtgagactgacaaaggaaaaaaaaaaaaaaaaagaaatccgctgggctgctttgaattttgaatggattttttacccatgcatgattttttagtgttatgtaccaatcagaagaaaaatactgatgcattggcctaagcagattatccaaaatgctaatgtatttattttacaaaattaaaaagaagttacatgtcttcatattgatctcatagaaaatatccgccaaatactcaagccaataattatagtgtctcttataaaaaccttgttctgtgaaaaaagtatttcattcaacatgcacctcaattatgaatgctttttcttaaaataaccatcctacttcagaatgcagcagatgtactttgtggacaaatcctgttttattgtgaagaacatgaaaaaagcatgtacccatggatagagatttaataaaattaactttgactgcttcctccaggtattcatagtttaaaattttaaactacagttttatccatgtgacaaatgcagtggttactagtaaaaattgggcccaagtctcttggcttgtgctatagtgctgggacttttcctagccattactttcgcaccattaaatgtagtgaatgttgatacagagaaaagtctgatgatagtactataactaactgtatcttagtgctgggaaaacatgaaatagttgtgactgtgcacttcctgagttttggggactcttagtgtactccatgacctacacgttaagaaccgctgcaatgatggaatgctcttttgacatgtggttctgggaattagtcatactttgcctccttttttggtcatctgttaatttaagtacacttgaattcgaagctttcaggaatacatatgtataattctttccatggaaaggcatacaatcttataaataccgcaaagataagttaaaatcttgccttttgttaggcttcgactgttggaattcttttttttttttttttttttggctgtctgggacatggagatatgttggaatttttgaagaatgaaagtatctcgtgaacgtcaaaaattttgtgaactccatttcagtagaatcgtataggttagctcagccacttactatccatatgaccttgactaagttattcaacagctttgtgcctcagtttcattatgtctaaaatgaggtaacagtaggcctacttcatagagttgaatcaataatgtaaaactgagttttcatcataggtttattttagcgcactgcagtcttttgagatgttggttacaaataagttgttttggcttaaacaacaactcttaattttttgtaatgtaataaagcattattaaaatttgtaaaaatatcacgtatacgcactggttctaacttaaattctaatttgaagtgttattaaaagtcattcatagagggaagtaagggttttgtgtattgcttgttgggtgggcacacagttgtgaatttcctcaagtgattcttattaatatttgatagatttagtgttagtgaagaatgctgtatttcattttacaaaatcatcctaatctctacctcttttgcattttactagaagtttgtagcggtggttttctagaaagtaacagcctgaagacatga

SEQ ID NO: 72356 - DNA, 3117 bp, Homo sapiens
attttggaagaaaaatttgttcactgtttcctgtattcaaaacatagtgctgagcactgtggaggatacagaggatgttagaggactttaggtgctgagtacttatacagagtaatgttaaaagaaacagctcaaacgttctgagaatttagaaaatgaaattctctactgagagtgtcattaaatagtcttggtacttttgtgtgtgtatatgtctgtgtttataaaatgatgtgatttgtttattattcctgctgtgttgtaggtatacctcatgtcttttcatttgaaatggtaagttctaataatttttggttcagaatggtaagattttttagctaatgttaactcttttttgagcaatcggagaagaggagagtcaagaccggcaaatagacatggttaactaatgtaaacatatcttgtgcattgtctagtgtataatataactaataataattttaattattagtttgaattagtaacagaagatcctcagaaggcataaaaatttaacttgttacttctgctttgtgacttgtttaatgtatttggagccaccttacagtgcttgttctacatagtgacggtaaattatattttaggctagtcagtatctaagatcttctatacttcatattgaggatagtatctctgtagtatcatctaaaatgttagaattttgtactaaaactaaaaaattataatgtctatgttcagtattaagtaacaactagtgagatgtaggctgtaggaactctggtttgtaagcatctgatgagatgcagttatgagttagattggtaattattataattataaactttcaaaggcttttacttatttgagttagattgataattataattacaaactttcaaagacttttacaattcaaagtaactgaaagtttatgggtaagtttgtttcttttcttaatggtatcttatactatattgtgcactatgtgtcaaaccctggcttttctggttgttttaccatagttttcttaagataacttcttcatttgatttattcttgttttttctatatatgattttaaccaattgatatgattgttacagtagtttgttttataatggcaaattttaaataactttgatttttattttggtaccacttaaatgtgtaaaaaatgactatgtatttaaacctgtagctttgagttagttacttagaagaaaatatgtactaacatcacaatttcaaggcctctggtaaattattaagatgatttatctaatgccgactatcacaaacagaaatggatactctcctgtataaaatgtgtacttaactcatacgttggccatctatgccttgttttcctcttttctgcttttttctgttgacgggaccaatttggaactgctgcttgtgcagtttatatttgttcttttctttcacctttcataccttgacctggccagttatgatggttttactttggtaaggaaatgcactggataagaaagaggttttggatcaagaagtgcaaaccagtcaccagtattatgtgaactttggtaagattttattgctagtattgtttgtcttacagctggtatccttgctcattgttttttttaggagttctgggtaaaataactaaatttgaagaataattaaatactattaatcaattttaggttttaaaagcacctcttcagagtgagtttacacctgacaattgaaactggtaatcttgaaaatgctctcaggtgtatgcattacaaataaaattcttaggagcagtgttgtgtgccttgtagtcccagctacttgggaggctgaggtgggaggatcaattgagctcaggaattcaaggccagctcgggcaacatagtgagaggcccgtctcttaaaatctcagccaaatagaagcttctttaacaattaatttatgtaaaatacttatttccttctgtcccttgatgtgtgctagattgtgtttacatttaattgatcttcggttagaaagccaccctatgtattaaaaaacagccattaattttgctacacattcagttgaatttgacagtaatatcagagcaatctattcactcaattacctgaccgaggctttcaaaatacattgttgaatgtatttggtttaagaggcacatgtcaagttaatgaacacagtaagtttccctacttctatttgtcgttgcctccatttctgatttagtatttaacaagtaacaactactttttgtttcgtgactaaaccttgcagtataaattaagatgtaattagctgggtgcggtggcatgactgtagttccagctactagggagcctgaggcaggaggatccgttgagcccagtgagtataagtccagcctgggcaacatagtgagactcatcttgatttattattattatttttaatgtaattgattattcaaaaggattcattttaaagtttcaatattttagtagcctttttcaaaagagctttaggtccacagcaagattatgtggaaggtacagagatttcccgtctaccccgtgccacatgcctacagcttctcctgctatcaaagtgttttaccagaatgatacacttataacaattgctgaagctacattgacacgtgcttatcaaccaaagtctatcgtttacctttagatttgctctgggtgtacattctgagggttttgacaaatctatgacatgaacctatgattatagcatcatacagagtattttcacctccttaaaaatctgtgctctgcttctctatcccttccacctaacccttggcaaccactgatccttctatcgtctccatagtttagttttttccagaatgtcatatagttggaatcatacagtatacagcctcttcagattggcttctagtcacctggcaatgtgcatttaaatttcctctatgtcttttcatgggttgatagctcatttctttttagcactgaataatattttggttgtaccacagttcacccattcatatactaaaggacatcttagttgcttccaggttttagcaattatgaatcaagctgctataaacattcatgtgtaggtttttgtgtagacataagtttgcacctccttggggtaaaatg

SEQ ID NO: 72357 - DNA, 1121 bp, Homo sapiens
cggcccactccaacccccgcctcccaggttcaagtgattctcctgcctcagcctcccaaatagctgggactacaggcgtgcgccaccacgcctgggtaatttttgtatttttagtagagatgtggtttcaccatgttggccaggatggtctcgatctcttgacctcaggtgatccgcccgctcggcctcccaaagtggtgggattacatgtatgagccaccacgcccggcccacgctcggcaaagtttttgtatttttggtagagatggggtttcaccatgttggtcaggctggtctcgaactcctgacctcgtgacccgcccaccttggcttcccagagtgttgggattacaggtgtgagccaccgtacccggccaaaatccctttagttctagtcagtagaggaataaagcactgttctttcaaatgtgaacccctcttgatcagtattgtccaatctggcctgttctttaaccagtcagcctcttttcctgcctcttgcatgggctttttgttgttgtttctttgtttgttcatctatcatctcttgctttaatcataacctaactttccctgatgtggcacgtgtaaaactgaaaaacagaaactctatctggtaaaaaaaaaaattccattaatttatgctgtcagagaagagtgatcctgttgttatttactaatgaatagatacaaatttattttctgaaatggtttgtgaagattccagagcagaagttacagttttgtggtttccacatggctgtccctctttttctacagtttttaaagctctaatgaggaatttatgttgcttaagaagatttgttttttgaagtctaaacttctgaagcattcaaacaaaagacacattttacaagggatttttatggcctcttcattaagttatggaaataactaaagaattatttgctgaaggatttgatgtcagatttaagtgtgacctgctggactggtaggcttatttatggtataatgatggcctagtcccagtggtttggacatgttggtgaaaatcaaaatggataataacagacattgcaatggtctcatatgtaatgttctagttgtgactagtttcggttgttaatgtttttacttat

SEQ ID NO: 72358 - DNA, 2051 bp, Homo sapiens
aataattcttcatacccttttcaggtttcctgcattgaactaaatatatacctgacttactattaaagcttattagtcccatttgagtagttgggaatagccctaggtgtttcaacacagtttattcaacacacataataaacttgagaataaaggtatgttgtatgctaaggcaacagtttgactcagttgtatttctttgcttgtcagaggcattccattgtagcacccgagggactgtgaggccagaatgattaagggaatgttggcagaggctagcagtgtagtgcttcttccaaggacaatgtaaaacattttttttcttttagagatggggtcttgatatgttgcccaggctgggctcaagcagtcctctttcctcatcctcctgagtggctgagacaacaagcacatgccactgtgcccagcagaacagtgtttttccaatgtacgtaataaacactcaaggagcttttaaaaaatgtgggttcttagatcatactactaataattgatttgttttgtgatccaggtagattgtaatacattgatctttgatcacatttttttgctaaatccagtagttttcaaccttgcaatatatttgtggaacttaaggaaaaatgcctgagattcagtcctccaagtattttgattcagtgtgtctaggttggtaccaggagatatacgtgttaaagaaaactctacaccttgcttatttctttttggtagcgaagattcaaaactactggccttgtattgaaatgagacatactgaaatgaaaatagttgaatttttcatggatcctgggagtgttagtggaaggcatgcttgatgtggttcaacatggtgtaagatttatataggatgcaatttatttatttattgatggtatcttgctgtgttgcccaggctggagtgcagtggctattgacaagtgtgattatagcacactacagcctcaaactcctgggcttaagtgaatcttcctgcctcagcctcccaagtagctgggagagtaggcatgctgctgtacccatctttcttcatttttttctttcttttgattgggtctccctgtgttacccaggctggtcttgacctcctgaagctatcctcctgtctcagtctcctgaatagtgggactacagttgcctaccactgcatatggttatatatccatctttagaacacggttcaaacagtatgacattctacgtgaatagtaccctgcagaatttgggtgtggcaaccttgatttgggctttcagactatatgtgcaggacatattatctcaaactatgcattaattttgcgtgcatagttctaataattttaattgtctcatccagtcgaggggttgacagactagaacagaccaggctcagttcacatgctgcctatttttgtaacacttttttttgtttgttttgttttgttttgtttattttgccctacaaaaactgatttgagtagttgtgacacaactatgtgagactgtattgagactacatggcctgccaagcctaaaaaatatttacacctgaccctttacctgaaatgtttgctgacctctgaatccgagagttgaagggaatctataaaagtggctcatattaccaaactcgtagagcttgtgaagaataatgcaaatctattcatttatatattcttttccagtgtttttagaaggctcactgagcacagtacctcatattccagatccaaggattcctgaggaatccaaattagtatccagaaggttcattggtagtcatggttataaaccagagcaaaagttaatgggaagaaatggtaaagagtcactgcattgcagctgacacctgggattttaaaatctttttttcgtttttgagatggagtcttgctctgtcgcttaggctggagttcagtggcgtgatcttggctcactgcaacctctgcctcccaggtgcaagtgtttctcctgcctcagccttccgagtatctgggattacaggcacgcgccaccacgattggctaattttttatttttatttttatttttat

SEQ ID NO: 72359 - DNA, 1031 bp, Homo sapiens
ggaatatttatgttttttaaaaaattttaaaattagtatttatggtagatagaccacaaagttactatgctcttaactttttgggatatccgtatttcaaatagtatgtaaatgaggtatgataattgtgtaacactgactagtgttctataagtttatttgtgattagaagtgatatgaatctacacaagtttttcattattttggtgtcagttttatttggttccaagcttcacagtgcctcttactactgcaaacttaagcactaaaagcaatatgaatgaaagctctacctatctcaaatattttgtgttaatgggagtatattaataggaaagcattgtattaagaatgcattgaggccattctggcagttgttcttcatttactttgaaaactgtctttggagaaaattgttaaacaattttaatgctgtgtgtgtgtgtgtgtgtgtgtgtgtgtgtgtgtgtgtgtgtgtgtttaagctttgaaattaggccctcttatgtgctttctctttatttcactgttcagtttaaagggaggaatcaaatggtaagtgttcaacttgtccaagtaatgagtaaagttgattttctttgttaattttaagatgccacctctctcttcttgccttcctaatagaaatattccaacaaaactaagagttatgggacttttaagtataaaataaatattgatttacatatttcacattttaaataataatttcatgtaacaaagaaagagtgaaaacacttgtcatatctggtcatctttttgtttgtcagccttcaacttgatcataattttatgacacatgggaatatatttttaagagtttcaaggatgtaagccagtacttcatcaatatcagttgtcagttttatttaatacttgatttttccttagaagacaaactttttgataattactgttgtaactataaattaaacaacattttttactcatttaggataacattcaactgccttaagaatgtatacattttaataatatgtcttaattgc

SEQ ID NO: 72360 - DNA, 1554 bp, Homo sapiens
ctcgcctcaacctcccaaagtgctgggattacaggtgtgagccaccatggctggctgagattttttcctttctatagtaagagagtacatgtttcagctttttttgactctcaatttcttgaatatacgcaaataactatcctagttatgattttactttgtttttctggtttaccttagctaagttactttatttctttggcttttttgatttattaaaggcttggagtgacatagaaggaaggtaaatttaggatgccgtggtcagtcgtgattacaggtttggcataatatgattgcataaatgatttcattttacatgaagtaaaatgtccaatggcagcccacatgttatgatgctgaaatttttatttgaaaaattttcagacatgaagaggagcatcggcggcgtgaggaagaaatgatccgacacagagaacaggaggaactgaggcgacagcaagagggctttaagccaaactacatggaaaatgtaagtaaactactagttaactaaaatgattttatattttcaggtttatgatgcatatttagaatgctttagattttggtttatacagtagtcttttctaatctttctaaattcatcatgtttgataaattagtgattttcttaacctctcataggtggtaaagtaaaattagtttctgaagatatctatgttttatgaagtggatgttatattttttcctattattttggttgatctttaaaaaaacatatgctattaagttagaaatcttgatatatacatcatttccacttgactgattttcaccacatactaatattgaaacatctctattttggaagatttcagacatgtacagaagaattgtagtgaacacttataaacatatggccaatcttttacatctttaagtataaccactttatttcccaatttatgttatttgaaatacctgatttcatataattttattttcagtatgtatctctaaaagatgaggactttttaaaaaaatctttatcatattttaaaaatggtcagctctttcatcttaactaattaaagcccagatttgcacaggtcttaatttttttttttttaaacatttggtttctttgaattgactgttatatccagcctcttttagtctataggttttctcttcctgtctttaatattttagtaaccttttttttttttttgagacggaatcttgctctgtcaaccaggctggagtgcagtggcacaatctcagctcactgcaacctctgcctcccaggttcaagcgattctcctgcctcagtctcccaagtagctgggattacaggtgcgcaccaccacacctggctaatttttgtatttttagtagagacggggtttcactatattggccaggctggtgtcgaactctttacctcaagtgatctgcccacctcagcctccaaaagtgctgggattacaggtgtcagccaccatgcccagccgacatttctaaaatagatcatctattgtttcataagattatgcttatagaaaagcattaggtgacaatataccttct

SEQ ID NO: 72361 - DNA, 1161 bp, Homo sapiens
tttcccctaacaatgaacttgtttttgagatggagtcttgctctgtcattcaggctggagtgcagtggcacaatctcaactcattgcatcctccacctcccgggttcaagtgattctcctgcctcagccttctgagtagctgggactacaggcgcgcgccaccatgcccagctaatttttgtagttttggtagagttggggttttgccttgttggccaggctggtctcaaactcctggcctcgagtgatacgcctgccttggcctcccaaattactgggattgtaggcgtgggccaccgcacctggccaagaatgaacttgaatactcttttttatatacgtgaagaaacgtgctcagaaaggatatttatttaattacccagcttacattattataaaatgagtaatataccaatatattgccagtgatagagaacttctatgcttattggtataaaaatatggaaagggaaactaaaaatattaatgtgcagtcattattttatagatctaatgaggcgtcaagaagaactcagacgcttggaagaactcagaaaccaagagttgcaaaaacggaagcaaatacaactaaggtaaaagaagatcattttaagaaacatgaattgtatgtcttattaataaaaactccccacaacctgttacaagttgtataagttgagtatcacaggaaaaatagaaaaattgcccattttaaccacatacagtgaattacttcataatgtagcataattctttgctggtttttagctggttaagggcactttgaatgctaaactttgaagttaaacaagggttttaggtattattatatgtaatttattataagaatatgctgtgaatatccatttttccagagatggatatatttgcgttgctcttatttattttgttatgtgtaaaactctactatgaatatctttatgtaactttgtgcttctgataatctttaaacaagatttctgaggctgggggcagtagctcatgcctgtaattccagcactttgggaggctgaggtgggcagatcacatgaggtcaggagttcgagaccagcttggccaacatggtgaaaccctgtctctactaaaactaaaaaattagctggctgtggtggcacgcgcctgtaatcccagctactcagg

SEQ ID NO: 72362 - DNA, 2034 bp, Homo sapiens
caagaccagcctggccaacatagtgaaaccccgtctctactaaaaattacaaaaaataagccaagcatggtggcggacgcctgtaatccgagctactcgggaagctgaggcgggagaatggtgcgaacccgggaggcgaaggttgcagtgagctgagattataccattgcactccagcctgggcaatactgtgagactgtgtctcaaaaataaataaataaataaataaaaaagtgaaaaaaaaattgactggggaccaggtgtggtgtcttgtacctgtaattttgcacttttggaggctgaggaatgagtattacttgaggccaggagtttgagatcagtcatattttttatatgtctctaaaataaatatttacatatatatgtatatatgaaaaaaatgaagactttcaaatatattcatagccctttatttggtaattcgttaatttattcaagaaatgtatattaaatgtatatactgcactctaggtacttgaggtggtggtacagcatttaacagccacatttgatgtcgtcaattgagtttaaagtctatcaagagaaagaggtaataaataattaactacaatggtagtaagttaggccttgatttttggggcctacccaattaattggcacataacgctcagtaaaatctagctggttttactagaaaaacatctgatccagacagttaattcatattcatgtgttccagactttcctttgtaaaatatttcttttttttgggacggagtctcgctctgtcacccaggcaggagtgcagtggcaggatctcagctcactataagctctgcctcctgggttcatgccattctcctgcctcagcctcccgagtagctgggactacaggtgcctgccaccacgcccggctaatttttttgtatttttagtagagacgggatttcacaacgttagccaggatggtcttgatatcctgacctcgtgatctgcccgcctcggcctcccgaagcgctgggattacaggcatgagccactgcgcccggcctgtaaagtattttgttgactgaaaaccagaaaatgaaacctccaaaagcagaaattttgcaggtaataattaggagaatgcaggttgtggcatcagattgtgtaagtttgaattattgttccattattagttgaacattcttgggcagttcttaaactcaggcctgtaatcacaatattgtcacgaggtaattcatgtagacacggtgtctcacacggtgtcttggacattgtaagtgcttgttgttctcatttgttgttgttttaccttttaagcatacatttctgtatgttttaatgttaatttagggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaaggtaaatatggattttcatgtacatgtggtatgattttttttttcccttaagtgtgtgtaccattcatgtactactgtgtaaagtgccatttaggagtttagaggtaaagttggaactcaacatattaggtgtgaaaatctcccttttcccagataacttcccttaaaaaaaagaacacaacttactaaaagttagttttacttgacgggcgcggtggctcacgcctgtaatcccagcactttggggggccaaggcagatggatcacctgaggtcgggagttcgagacctgcctgaccaacctggagaaaccccatctctactaaaaatacaaaattagccagccgtggtggtgcgcacctgtaatcccagctagttgggaggctgaggcaggagaattgcttgaacccgggaggtagaggttgctgtgagctgagatcgcatcattgtgctccagcctgggcaacaagagcaaaactgtctcaaaaaaaaaattaa

SEQ ID NO: 72363 - DNA, 1036 bp, Homo sapiens
ttaaaattttttatagagacaggatctcgtcatctttcccaggctgatcttgaatttctgggctcaagccatcttccccgcctctgcttcccaaagctctagaattacaggtttgagccacttcgccgaaatgttttaggtcggattttcagctttaactttttttttttttttggtgacagagtctcactctgtcgcccaggctggagtacagtggtgcgatcgccactcactgcaacctctgcctcctgagttcaggcgattctcatacctcagcctcctgagtagctgggactacaggcgtgtgccaccacgcctggctaaattttgtagttttagtagaaacggggtttcaccacgttggccatgttggtctcaaactcttgacctgaggtagtccgcctgccttggccttccaaagtgctgggattacaggtgtgagccactgttcctgctggccaacatttttaagaactttctgaacaatactgatagatacagggaaactgggtggtgggtacagatgggtgggttgaggtggtgggacatgttgatgataaagatatatatttagaaaatgtctcacttgagaaaaatgtctcagaagtatcatttgtactcataaaaatcaatcaatagctgaagcagtggctgtgatgatgaccacacatataaaacatgggttaggtacaaattcgttttcattatactttctaaatgttaactataaccgttatgctggttcataattgttgctttatttactcatctttttgtggcttttgacattcacctctctctgactcagtaaatgtttattgactgatttttttttttttttgtgatggagtcttgctgtgttgcccaggctggagtgcagtgatgcgatcttgactcacttcaacctctgcctctggggttcaagcagttctcctgcctcagcgtcctcagtagctgggattacaggcacacaccacaatgcccggctaattttttgtatttttactagagatggaatttcaccatgttggcctgg

SEQ ID NO: 72364 - DNA, 1342 bp, Homo sapiens
gcctcctaggttcaagagatctcttgcctaagcctcccaggtagttgggattaaggcacccgccaccacgcccagctaatttttgtatttttagtagaggtgggatttcaccctgttggccaggctggtctcaaactcctgacctcaggtgatccgcccgcctcagcctctcaaagtgctgggattacaggggtgaaccactgtgcccagcctctagtcaagttgttaatatgtgttcttaatatatgtaggagattttaaaactatattgctttgaatatttaatagttggtaactggccttatgaagagctaatctttaaatgattacttttaacaaaacaatggagttgggaccttttaattaaaatgtttaaaatgatcattgaatagttaaaaaccatgtgataccaaagttaaaagatacaaaatcaaattgaccctgtcagccatttgctaaagatacctagttctccctagaagccaaacactgttttgaattttttctgttactgtcatcttttaaaaatgttttttcttcctaaaaaggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgtaagttttaaatatcttgtccttcttctatccagttacatatgggcttctctctgttttggaattctgtctttcattgcagttcatactagcatatggtaagtaggtgttgagtaaatattcagtgaatataaataagaaattttcgtgtactggtaggagtcaagagtcatgtactttcttcaaacttcagagtttaaatctctgcagtgttttgtattatttcatttaacttaatgaacatatatacaaagtaaaatctataaacttaaggtaatcctttcagaaattgtaatcagctttattgacacctaatttacattaataaaaagcacctcaggggtgcagtggctcaagccccagactttcagtgcgcggatcacctcaggtcaggagttcatgaccagcctggccaacatggcatgaaaccccatctctactaaaaatacaaaaattagccgggcgtggtggtgcatgcctgtagtcccagct

SEQ ID NO: 72365 - DNA, 1099 bp, Homo sapiens
aattgagcttgatatctaaaagggtaaggatgtttactcaagtcattgtattttcacacactgctgcacacatcacataatttgtcccaagagtacagccaacaacagttttgatattttagcaggatgggaaaggacgtcttcaccctcctaggagatttgtcgattgcacgcgcagcgttatgcgcatgcgcggtcagtcaacggtccgttggtgccgcgagtgcgcaggcgcgtcgttccggcgccggctttggcggaggggtgggacttgcaccggcgtctcttcttctaactgcagtttgtggcagcgccattttgaatgtgcagctgcagcgggcgtgagttgggggaggacgggttgccgactcgcctacctagcggtctcttgattgtcgatattttgttggcataggtttatgtagagacgtatacatatatatagacacactgtctataaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggtgagtgtcaggcgcccgcgcgagggaacaaaaggactgtcggggtggccgcggggtcgtggggctgaggccagcctcgtcctaggacgctgtctcaacctgtggcaaccgtggcgccgctcggcctcatcgattcctctgtgcggggttggccgcttccccagctcggcgcctttggtttcgagttcacggtcccgggatttcctgcgctcacagtggccgccgtt

SEQ ID NO: 72366 - DNA, 1084 bp, Homo sapiens
gactggagtgcagtggcgcgatctcagctcagctcaacctctgcctcctgggttcaggcgattctcctgcctcagcctccagaggagctgggattacaggcgcatgccactgtggcccggctaatttttgtatttttagtagagacagggtttcaccatattggccagacttgttctcgaactcctgacctcaaatgatccatccaccttggcctcccaaagtgctgggattacaggcatgaaccaccgcacccgaccgtcgtcgtctttttgattggcatttctttgatgcctaatgatgagcatgtgcttattgagcatttgaatatacattaatttttaaaagtttaacctaaaataaaattataatcctctttgtcctcagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacgtcaacaatagtgttaagtactcaaaattaaaatctgatctgaaaaaaaataaagctattgatgct

SEQ ID NO: 72367 - DNA, 1107 bp, Homo sapiens
tgtgcctgtgtgccaggcattacttttatgtcatgtgttcttcatagcactctgatgagttaggtatcatcaattagtatatttgtataatattacattcaggagatctttgaacctggagtctgacttaagagccgatggctaccacattacacaattccagacgccaacatttactttattattattgttggcacagtggagtatcattcacttgagatacaaagtggatagtccccctgggattgtgcatcaagagtgtttggccttaaccacatgtttatacgcctgccccacttgtctcttaaactcttaaatgaaaatgcaagttatttttctgatgtacattttgatttgttccatgatttttttcttgtttcatttttaagattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaagtaagcagtacctttcaacatttctccacatagttgaatactaatggtataaataagtactcaatataactgcagagctggatagatttatgggtagaattgttgcaggagtgtcttcaagtttattgagcttgagctcctagaatatatccaagctgtggactcgtatgtgctgtatttactctcggcagaaaaatggaacataggtttggaaatcaattgcccctctccctgctactacatttgcctcccctgctcccccatcttaacaccttagttctatgaatttattaccagcattttggtttgttggtttgtttttgagacggagtctcactctgttgcccaggctggagtgcagtggcacgatttccactcactgcaacttccacctcccaggttcaagcgattctcctgcctcagcctcccgag

SEQ ID NO: 72368 - DNA, 1862 bp, Homo sapiens
tttttagagccctgagtttaagtcttactcccagtgttatgtggaacaatttagttagcttccctaggcctcagtttcttgaactataagagtaaattatagctactatcatggagttttgataattttattttctgtaaaaagcccattgcataatatctggcataaatggacttaatgctttctgtacaaggacaaaaaagatgcataaagataattacataattattttggaagaagtgattttggaaagaaaacaatggcaggagacacttgggaaatagggccatatcataaatgctgtagtaggtaaaagcatatggaatataagtgattatattaggaccctaagttattggtatttaatttaattattttgttactattttctaattcaaaggaaggcaggcattttttcactataaagagtgaataaagtgagtactataaattgattagaattttttaaaggactaccaaaattatataattaatttccatcaagctctgaagtaaacattagttaacagtagaggaaaaacaaaatggatatcaggtatcacaaaaaataatttgaaaaatttgcttgtgctattttattgtagtaaaatgcaaaaaccataacatactagaacttttttttttcttttctgtctctacaggttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctggtaagcagtaagtgatactgtttctacctcaagtaaataagcctttggctgttctttttagtaaagctcatatctattttattcacattctgtggctttgctttttttgtttgcttgtttgtttgtttgtttttggagaccgagtttcgctcttctcacccaggctggctggagtacaatggcgcaatctcagctcattgcaacctccgcctcccaggttcaagcgattttttttttcctgcctgagcctcctgagtagatgggattacaggcgcctgccaccacactcggctagtttttgtgtttttagtagagatagggtttcaccatgttgaccaagctgatctcgaactcctaacctcaa

SEQ ID NO: 72369 - DNA, 1131 bp, Homo sapiens
gggggcgggttgggcgagggaggggcgccccggccgggtcttcgctgtcaggaccgcgctgccaccctgccgccggagccgaggtccccaggtttttcgggcgagggcttctgcctctgccccgctgggtcccctccttcgctcatcttttcccaggcgctgcgcggcttttactctttgctgctgatctgggcgagtttaatggcggatctggggccctgtcgtcgactgctggggccccagggcaacttcttgaggcaactgtgggcccagaggtgatgcgcgccgcccgttacctctgaaatggtgcttggagtgacagagatgacgctgggtgggcaaatttaggagggaatacaaatcccttgctggcgtcgagacgacgtttacccttccctctcccgtcctgggagcaggcctcggatccccgagcccactgcatccccagtactgcagttggacgaagcacttttagctttgtctcgtcgttgcggttcctatagttcttttttttcaacttagtttctcggtaacattagggtgggggagggtagcagagcccaggaactccttggcctcttacccctttgccacctcacggtgttgagttggttgtgcatccagattggttgtaccgaaattggttttcaattctcattctaggaccaggaatcaccttcaagcctatgtcgtgaggctttggcagaaattaagaaggaaatatctccattgtgagttgtttttttttttttaccccgctttgctgtctaatataattagtgcagtagtagggtgttcttcctgagggatttgcctttgtgttatcttgaaggccttggccttcaagctaattgcttgggtgcccctgtccccagagccaagccatggtagtccctgggaaggcacggggagtgctgacatttataccactggaactctctcaagttccagaacaagatttaaagttagctctcttttaagtgccttgaatttaacaattttttcttttccagtagattggaaaaacttttttactgttggattaaaaagaaacactactgaataatctgttgttttgacgttgatatttgccttgtatttgaggaagactgttatttatgtaccctgaca

SEQ ID NO: 72370 - DNA, 1031 bp, Homo sapiens
aatacaaatcccttgctggcgtcgaggcaacgttttcccttcccccctcccttcccgggagcaggctcggtgtccttaggccccctcccttccagattttgcctttcacatgggttttggccccaaatatgtattttgcgctgttttgccccacttacgcaggagggggctgttgtgcgcatggtgggggtaataatagaaggaccgaacctccttgacctcttattcccttctctgcctccttctggcagaaagggttgggttctcccaccaggttgtgtgtttttgatacatttttcttttttcctcctatcccaggaccaagaatcgccttcagccctgtctggtgcatccttggcagaaagtgaggaggaaaacacccccattgtgagtcctttgcccctaatttgttgctaatagaggacattgtcaggttgtaggggttaagctatgggacctggccctccccgttgttttgagggggaggagctttcccttgggtggcagctgcccccagggcgaagcctgggtaatggctggtgaggcagctgggagtgggcgctgctgtttccaccgctgcagacatcgctcctgctgctgcaataccaacctcagcaaccagacgacgggcttctgcagctgctcacgttacccgggaggaggggtggtgcgaaggagggcatatttctggtgccctctagagttccaaaatgggaattaaagttatttcttgttgaatgctgtgcatgcaacctgaacattttttcttccttaaacaatggctaattgattgaaggaattggaaacatagaaataatcatttatatttttgtttatgtctgctggaaacacatattttgacacttatggctcatgagttgctagatctttttcatgtatttgcttaggaaagggagtcaactcctctagtactatcttgttcaccaagtagtatgctgatcagtccagtgtactgatctagttaatttcttcgttccccatcttccatgttgatcatctttaacttaacg

SEQ ID NO: 72371 - DNA, 1418 bp, Homo sapiens
aagggaaaggattatagcatgtgactttatatgatacagtgaataaatgggataagtgtataatgaagtaattattttttgtcagattttgattttttttttttcctgttcagatgtgtgggaggatttatccatatttttagtgataaattttatggagtaaatagtgtacccctgaaaggaggtggtggtggtggtaggaatatattgcatatgattaccatgaatatattgcatatgattaattatccaataaaaattggataattgccttccttgttatcctgcaaaagttaacatgtaaactatatgaaatgattaatgaatggatatcacatattttcctgaatgttagacaagaatcacttcatttagaataaaaataaaataaaagtaccctttaaatcaatggtttcagttagagtaacataaaaagtcatactgacattttaattcttttttctatcttcctaacaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctggtaagcagtaagagatactctacttcatgtaaatgaatttaaacttttggctgctgcttttttcattgtagtaactggtattac

SEQ ID NO: 72372 - DNA, 1027 bp, Homo sapiens
ccgacataccctttttttgtgctgagaacacttaaaatctaatgttaactattttaaagaatgtagtgcattgttaccgtgacattcttactccaaaacttgtgctatatacctctctgctatgttgctgttccattaacatcttaaaattgtacaaaatgggaagttaatatttctctgatataaattttaatatgtataaacaaacacttgtttcattattctttcttgtgcattttgtttttaagattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaagtaaggtttacctttcaacataattacatatagttgaattttggagttgtaaaattttaagaaaagtgaaacagatttgtaatacctttggaaacttccctatcaagtccaggtggcatatggataaaaggcttcctgtttggatggcattggagttgatttagataggtccttataattaattttgtctgtaatctccattggactctttgattttgtaacaatacatacttatttacatgattaatgagaagaaattagttcttatagccaaataaaaatgctaagcagtttatgcgtgattctgtgttaaaattggttaaattttaccctgtcttcagatcaagattataaaattggcaagtctttggattttatatgtgtttgttttgaacattaagtcattagaaatagtatttcaagactcaggtaccaatttttagccagccttagaaaggcaggatcctctcttctactgtttttttctttttct

SEQ ID NO: 72373 - DNA, 1787 bp, Homo sapiens
tacccaaacttggttttctgtcatcttctgatacctctagagaagtttgtagtgatgtcactgatgggtttttttcttttttcagtgccatacatgtgttcctgtgtgtataaaaacaatttaaataattatgaaaatggggccaggctcagtagctcacacctatataatcctagcactttgggaagccaaggtgggaggatcacttgaggccaggagtttgaaatcagcctgggaagcatagtgggaccctatccctacctaaaagaaaaaacattagttaggcgtggttgtgtgtgtctatagtctcagctactcgggaggctgaggtaggaggattgcttgagcccaggggattgaggctgcagtcagctttgatggtgccactgtactttagcctgggtaatgagtgagaccctgtctttaaaaaaaaaaaaaaaattttttttttccttttctccaaacaagccttattaggacatctttatttctgttcagaatgctttattatttagctacttgtcagattgatctgttttgtaagattttgtttatttttcttttagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaattcatgttctaatcaaaattgggcattctttagaatgttcttgaaagtgttgtaatacttttactctaacagtgtttattaactggctttatcttagaatttcatttaattccattattgttgtcatatcatggagcatactgaatgcatagtgctttgtaccattaaagctgaaccatcgtaagtcagggaccatctgtatttattcatttgaggtaggtcatttccgtgatataatgatggagttaagtctgggtaaacccgttgtaagttggaaatgtcttagaatgcacctttgacctaggtattttcaacttagaatgggtttatcaggatgtaactccattcttagggaacatctgtgtatgtagattattggcagtaaatttaagattttacatataatggtaaatgctatcagaatgattcctcttttgaatttatttcctctttgggagttggagaggggctgcaaatatttcaaacttttaaacctcggcttgaagtggtcgtattgtttatatttaaattttaaggttaatgttgttatcattttttttttgagacggagttttgctcttgtttcccaagctggagtgcgttggcgtgatctcagctcactgcaacctccgcctcccaggttcaagtgattctcctgcctcagcctcccaagtagctgggattacaggcatgcgccaccacacccggctaattttttgtatttttagtagaaacggggtttcaccgtgttagccaggctggtctcgaactcctgaccccaggtgatccacctgcctcagcctcccaaagtggtgggattacaggcgtgaaccactgcacccgtccaggttaatgttattttaaggactttttgatttctagttttattccattgctcattggaaaggtagtctgtgtgatttcaatcttcataaatttatttattaaatgttttatcagaaattattattgctttaaagatctttttgttgtctgtggagaag

SEQ ID NO: 72374 - DNA, 1608 bp, Homo sapiens
atatttggacagttaaaaaaactttacaacgtaattaatttttgcataaatactcatttgatgtttttatgcttgtttttaacagctttttattttatattaatctttttgaaaactgttctaattattttgattattctgtactacttttttagttctcttcatgtctatgttcttaactaaaattgttactccatctaaaaaattacccaaaactgagttttttctctatatctatgtatgttttagtggcataatatcagagtccgttatgacaatattttaaaagtgcacataatcttcagtattgaaggtgcaaataataatagtttattttttaacagaaacttctatgatctcagtagttaagataaaaaaacttttttattactttataaacaaatcagatatgtaccttttctttcctaggtttgggaattatttgccatttttgtaagcgaaactctttacctcaataccaagccacaatgcctgatggaaaactgtacaacttttgcaattccagttgtgtggctaaatttcaggtttgtcgtttattttgcataacccatgcccccaataaaatacacatagaaaataatcagtgtaatataatatgctttattttatcttaatttttacgtagcttgttgagggtcaaattggaaggtggatatcctagtcacagaatatgtggctgtaccagttttctattttagcctggatagtctaattgagattataattattactctgatacagattttgaaggaaaagaaattttaatatagttcagtgctgatgtgtagttttttcttattagatagtttgaataaaatgtgaaccgtaaggggaactgttatgtgacaaacggatagaggacctagatgtatttagcctagaagtgataagaatacttgctttcttcatatgttagaaatggaccatgtaaagagggaattagattttttacactaggccttaatttaatacaagatcagtttagggagacatttttcattttggtaaatgtaaagaaagacttgctaacatagtttttcaaatttggagtatggatagtctcagaagatagattcttggaagcgttcaaacttaacctggttgaccactaggaaggaatagtttagagggaattcaagcattagttaggtgatacgattaggtttacctgttgtgtgtgaaaatttcagggtattacccaaaggttcaaacccgtgcataaagccatgcttcatgagttaattcatccaacaattctgctttattccaggtactgtgctctatgttaatttatttaaactgcaaatatagtttcttaagtataatagttactatatcacttattagtatttaaattgaggtgtttttgaattcaaatgaatgtcagtttttgttaatagtaatattctcactgagcttaggtgataaaccacgtttaagacttaacttgttatttcagaagttgggatcatggccattgatacatccttacagtggtagatattgcttttgccttgttggcttttcttaaactagaaattaaggaataattattaattagaagagaggaagacagtgtctatagca

SEQ ID NO: 72375 - DNA, 1050 bp, Homo sapiens
agtagctgggattacaggcgtgcgccaccatgctcagctaattttttttttttttttttgagacggagtctcgctctgtcgcccaggctggagtgcagtggcgtgatctcggctcactgcaagctccacctcctgggttcacgccattctcctgcctcaacctcctgagtagctggtactacaggcacctgccaccacccccagctaattttttgtatttttagtagagacggggttttaccgtgttagccaggatggtctcgatctcctgacttcgtgatccgcccgccttggcctcccaaagtgccgggattacaggcatgagccaccacgcctggcctaatttttgtagttttagtagagacggggttttgccatgttgaccaggctggtctcgaactcctgaccttgggtgatctgcccgccttgacctcccaaagtgctagaattacagatgtgagccactgcgcctggccaacataggcctatttcactggtagacttggaatgaaaattatagtagggatgcagtggcacaaaacattagtaaattagatatttgatgattattggagatagcaataagaactaggtttttgttctttttgtttttttaaacttctgttagttcagaacgtgggcaacttaacctcactattatttgcttactgttacttccttacattttcttaagtgaacagatgatgattgaatgtatgattttttcttattttaggtaaataataattctgtggttaaaaattaaatttaatttcaattttataaaactaacatatactataatttttaaggacaaaatttggaaatgagttttatgtgctgaaaagatatctaagcaagatgtatattactttctggacatcgtagatatatgacagtaatcacaaatagaaattcaaacatacatgtcaggcttagtatcttttgttctttgttttaggctctaagtatgcagtcatctccaaatggccagtttgtagcgccaagtgatattcagttgaaatgcaactactgcaaaaattccttttg

SEQ ID NO: 72376 - DNA, 1468 bp, Homo sapiens
caatctctgtctcctcagttgaggtgattctcctgcctcagcgtcccaagtagctgggaatacgggtgggcaccaccatgcccagctaatttttgtatttttagtagagacggggtttcaccatgttggccaggctggtctcgatctccagacctcaactgatccgcccacctcagcctcccaaagtgctgggattacaggcatgagccaccatgcccggccataattgtgttttaataaaacaatagtggcctatgaatcccactacaagtttattttcttttcccttttttcattagtttactgatttgctttgacatgtctccattagcaataacgctgatgattgacttttatttcataagggggcagtaatagatggatacatggccaagactgcccaggctgcccattgctttcttgagcaatgcttgcctttggccattgtttcttttcactgctttaggggtggggcagggtgggaggtagtgcatggagtatatgataaaatggtatacaagatttagaagatgtagtattaacactgttcttgagccaaaatttattaggagctgttggtgagtcattcagtaactaagtcttaagtgaaaggtggtacccagaactggattacatgattttttttctgtctttttttttttttttttttttttttttgagatggagtctcgctctgttgcccaggctggagtacaatggcgtgatcttggctcacttcaacctccacctcccaggttcaagcgattctcctgcctcagtttcccaagtagctgggattacagatgcctgccaccacgcctggctaatttttgtatttttagtagagatggggtttcaccatgttggccaggctggtcttgatctcctggcctcaggcaatccgcccgcctcagcctcccaaagtgctgggatcacaggcgtgagccaccgcacccagcctggattacatgatttctaaagtactttggaaacctgaaatttcattttaacagtttaatgactggaacattttttagtttattatttgctttggtgctgtctccagatcatttaaaccaatccctatttgagactgttgttggcatccagtgatgatttttagtgactgataacctttaagtaacagcagtaagaatgaaggcccagtaagaggtaataaaggagtgatgagggaatgaagaaagaaatccattagcaagcatacagaataatagtgtcatatagaaaatgaagatcctgcatacactgaattttgatactagatcaaaatgaggtccttttcactgcatttatgtcaatgctactccacttctgtagttgttttggtgtattgcttttatttacatggaggttaagtgttagaagcagttaagagacactgccacactgaatgagagttgagcgtgtccccctgggagattgagaattcagtggtctctttctcctc

SEQ ID NO: 72377 - DNA, 1034 bp, Homo sapiens
tgttcataacatttattgatatttaatgttttttgccaaaataatatatccagagtggctgcacaattttaatgtagctgaacaaaaaaaattgagtttacgtttctactgacttgtttcgttattttatatgtgtttgtagatctgggcttcaagatggttttatctctaaaaatttggtaacctcttatttcattaaagttttagaataaaataaaagcattttcatgccatgttatttctaaacctacatgttgtggtctgaaagttggttttccaagtggtttaaaattgttttccattagctccattttccctgcccagcttactacctaacctgcaaaggttttcaatatgtataccagaaagaaaatcacatatggcagtactaaaatgggaagatacttttaggtattcaatttggggtgccagggagacactgggttctgttttagtatgttcaagaattccctttcctcttatctacacttttgctgctctggtgccaggcagcagattatacagatgaattcaaattctaaatctacttatccagagataggaactaggattgtagctatgggttttggggttgtgttattcctgttcccaatgtgacattcttgctctaagctggctttcactttctatctttctttggtccatggcactgaactcccagctttcctgtctgctatcttcacctataattttttaatgaggaatatttttttctggatctgctttttctatggattcctgactgctagtttggagtaagagaaaggtgggaaaatcctaaatgtcagcagtagagaatgacagcaaaataaaaagatttatcagttcgttcaactagtgcgttcatttacagtcttaacatgtaatgtaaagtcatgtccgtaagagggtgctgcttgcttataaaacaaggcattcctatttaaatttaattttgtacatttcacctggaatggaaagtaaccatgtttcgctgttatttaagagtaaagctataatgaaaaatgacaaat

SEQ ID NO: 72378 - DNA, 1808 bp, Homo sapiens
gaaaagattgattctgaattagtctttttacatttgagttgtgcaatgacattcttactgattcataaatctgaacatgctgatgttgattgctcatatatgtcattaattgtctaccatttggattatatggactttactaaaatgaatagacaattagcagcaaataggtaattgacattcaagaagataattttcagttggagggatttatacattcagatcggtaatagcatgttgaaaaagaatgtgtgggtttttttcctgttaaatgacatattttttgctttctcttactgcacctagttctctgctagaacctgtcagaaataacaaaacacataatacctagtacgaccatcaaactctagttagataaagctaataaaggtaaattttaaagaatattttaaaatatagttcaaggtaacagaagtcataggatagtacataaatgattgctaaataaattttatagaaaacaattgcagttcctgtttgcagacaggaaatgtcattttaaactaggttgatcgtgggcagcatttgtggtagggggataatttgaggtccttatgaaaggatgaataggattttagtagataacatgtaagtcattctacttacatagcacagtataagtatagagtattatgtgatcctcgtagaggtgttatagggaataaataaggatatgtaaaaatacttaatgcgtttatgtagtagaaaaaagacatacttcgttaaaggactagataacaaaagtattttctctgggcaagtcaataaatctgtttttttttctgaaggtccatgtaagagaggtaagcttgaaaaattagctaaaatgcccacttaagttgaatatctctataaatttactcagagcctctcagtagtctacattgttcctttttctaaaatgcctatttgtggtatgcttagtttgatacttaagattctatctgtctatttcccaggcccaagcaagattctgtttaaatagaacaaataaaataattctgagacattactagattttaatatcttgaaacattattttaacccacatgttagataatatgttatctaataaaatatcccatattctgttctaatttttataggttgatattgattacagtagattttatagttttgatcaggagaggaaaaatcttgaccaattaagatctgtctctgctcaataattagttttcatgtgtttttttgttttaatatataaatcttatatttttcaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggcgagtaactcctttattacagcagctactttaaccagtcttaaaaaacgttgtagctgttaccattacaaatctggcaactcatttattttaaaaatgtacacacttaaggcccagccctgataatactattcattaaaattgtcttgtcatttctgcttgtttgaagtagcatttttatctctttttttaataacttaagcattaccaaaagattaggatatacctatattttcagcattgtagtttaacaaaatggattgtttttctaaaatttgttgtgtctttatttcactaagtagaattttttttttttttttttttttttgagatgaaatctctgtcgcccaggctagagtgcagtggcaccatc

SEQ ID NO: 72379 - DNA, 1392 bp, Homo sapiens
aaagttcacaacctccaaaattttgattatggcattaaagttggaattattagtattgagttctcacttactgttttttcatgctgaaaaaatacatgcctattttgtttacatttgtaaattggtattaatcttgccccttttttctttgggtagagggaaattatctaaatttgttttgaacctttaaaagaagaagggagcttcaagtgttgattctataaaaaccaagtgtctaattgtagaacgatgaagtgattccattgttcaaattcttgaggtggaatgtgtttaattttatgcccttgatcttccaaattattgtataaacggaaatactactactaagagtcagcatagtacatgtaatgatttgaattaatacagatttctgttttaaatgttaaattgagaatcttcttgtagcattttatttgtattgtgttagggtatttattctctgctcatttatagtaactcattttgtctttattgcttagggtacaggctaaagcctaggttttgaattggttgtctgccttttgaatcctatctctgcatttttaatatttgaccttagtcaagtcatttaatctttctagatcttagtttgcagtacccattttgcagggctgttgtgaaggtttatagagagtagatacaatgggtttggcttttatttcaggttctcagtgaacaaggtagtcaggctgtaactctacttttggttcctgcattgttcggaatcagtgaataaagtattaagcttccatttccttcctttatgctttgtcttttctttgagcataaattataaaaagggaaaaagaaactgaaagaaagaaaagaaaccctggaacaattctatggttatttcgaagaacagtctcgctggtgagaatttaacaaagggacttttttattattgagtgaaaatatgatcttggttgatattaagtgctattgttactgagatgatcacataatactatcagcagtataaaatttggattcacaagtttttggacaagagttgtgatattgcatcacttagtagtcataatttatactataaatcttcatttaacatttattcagcaggagaaatacctgacctggagaaaaaaaaaagcctgtgttctaaccttggggtatgtttgttatgtaagacctgtttgtcaacacagtcatttgttaacattcctgaccaggaattttgacatggcatttgtagaattcctcttgaaatacaacgtgagaaatttcaaaatccacagtgtaaaactctagattagagtaataaaggaaaagccatggccacagttactacgaactacaaaatacttaacagttattactttatcagaatttctaagctgttaagccaaaggg

SEQ ID NO: 72380 - DNA, 1796 bp, Homo sapiens
aaatccgttcattactcataaatgttcaatgtaatgattgtaggagacaattctaccagtacattatatggccctcaaaattatttaaaaacattaaaatacattcatttggtctaccaatatatatttagttatcctacttttgtaatgctggtctttgacttctggtaagtataggatggactttgtcaactgtgaaattgtatttttttttttttttttcatttattgtagattttactgtttacaaatgatttatattatagttctactttttctgtatcagtcacggttttatcacatttggcaataatcactgataaacttctggaaatcttcaaaaataatttgcaatatctgaaaccttcctttttaaattaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatggtatgtaatgatttaggtgataacttgaaaaccctgtacatcagtctttacgtagttttgaatccaaagcactgataatgaatagttgattttggagatagcttaacagcaacttaaattccgtagattctctgggtcgaagtacccttgtatgttgtttttataaatgtattgcttttagttttattgtctttttgaaatttcatgctaattgagaaaaggcatagttgagagtgaggagaagctaaacagtgctataacacaaattttaaaaagaatagacatctaactatcgtgtcatctgcaattttaaatgaaaattatttttagcaaatcgtattgctagggagtaggttgggaggaagaacaaaaaccgtttagaagctgtaatttttttaaaaaaaatatcatttaagatataaatctaagaatatataatagtatttccccgaaagcagtgtatactttcagaggggacgaaaggagaaaaggattaatttcatttatttacctgtatatttctatactttatacaaatttgaaattctttccttaaaatagtctaaaatattttctttagtcacattttaaattggtgaaatttaatgagaaatagggatttagaacattctgaagaaagagtatttgtcttattttaaatttttttgtgttttttagatcagggttgtcagacatctcgaaccaaaatgacagtaagtattggtgaaatggagtgctgaattgtgatttttgtaatatggggtaaaaaataattaggccaatttaatgtgatcataatagtaatttttttggttttttttttgctttactgagacggtggagtattcagctgaattatattaataccagagactgtcatgcatgctaaagaatataaaggagaattaattatagcctctactcacaatggggcgatagacataagtgatatttgagttgacggatgtttccataatagatgcatctttaagacaatggcaatagtatgtttgaaattaagacaatggcaatagtatgtttgaaattaagacaatggcaatagtatgtttgaaatgactgtatttgttctgaaagatacgaataagctgactgtaaacagttgagtagaagattgccagataggcatgaaaagtaggagaataataaagtactaagcacgtgtatttggcagaactacttactagagccaagcctgaaggggatctttggtggaataatggaaaatga

SEQ ID NO: 72381 - DNA, 1048 bp, Homo sapiens
tattccgaattatgtacctacattttctccgtatcaatagatgatgtggagagtaccttatttttactcccttacgctcatatcttccacttatttcagattttatttatgtggggttttgtcttgtttgcaatgcaaataatgctgcagtgaacttagtgtgaaatatctgagagactgcatctgtagaataggtttcagaaattgccattgctgggccgcaggaaatacacaacttaaagtttgaggatatctttggtaattgttttcatttttcttttcaaatttataatcatatttaaagccatttatccagcagagggagtgagagtatcagagagccataataactgttggatcttctttttctgaaataaatttaaaagtacccaagtattttcatagttcaggtttgcaaccttgattttgtacttaaaagttagattgtctttttatatttttctaaaatcattctgatggtatcctttgaaggtgatataaatctatagaatgaataattgctaccactttgctagtagttaggatagattcatattgatccttatagattaagagtatggtgaacatagggataatagcataatttggttatcctcttctgcttttgtgtgttcccttcttaggactgaaaatccttcattgacactaggaagtattgaaaattagacataaaaataaaaatgtttctctttgcttctccatagggttcagcaccacccccttctccaacacctaacaaagagatgaagaacaaagcagttctttgcaaacctttaacaatgacaaaagctacttactgtaaacctcacatgcagaccaaatcttgtcagacaggtaacttaggacaatgtgacttacatacttccccataccttcatctcacctaatgaaatacatgcttttcttgaatgacacctccaggatagattcatttggtcaatttgtcattttctgttgattttgcttacgtaattttagatattacctggagaatacagcatctcattttaaatcattatgatcaatc

SEQ ID NO: 72382 - DNA, 1055 bp, Homo sapiens
actggaagccttgctgataacagttgattaacacatattttatatgctacatactgtatttttataataaagttagctagagaaaatgttatcaagagaatcatatgggagagaaaatatatttacgattcattaggtggaaatagatcatcctcattgtcttcaagttgagtaggctgaggaggaagaggagagaggttgatcttgctgtctcaggtggcacgattggaagaggtagaaggaggttggagaggcaggcacacagaaaaacatacgtgtccaagtggacccctgcagttcaaacccatgttgctcaagggtcaattgtaatttgcctttgttgagagatggcttgtataaagtaatgaaataatgtaggctttaaaaaagatattattatggtgttttttactaatagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttgtaagtgttttaattttgtttctcctaagtcctatttaaaatcaagatttctgttattgagtacctttaaatttaaaaaacataaatgtaacttaaaatacctgtaagaatgcattttattttacttcagagctcttacaaagaataacgtcagaaagtttcttaaccttaataagacgctaaataataacaattattttttattttatgtatttttagctaaatcagtaaagttaaaagaggatctactctctcacaccacagctgagcttaactatgggttagctcattttgtcaatgagatccgacggccaaatggagagaattatgcacctgacagcatctattacctttgccttggaatacaggaggttagtaatttgatggctgctttcaagtataacattaataagaaaagttgtggtagttcttgtttctgtagcattatggaacctttattgacttacc

SEQ ID NO: 72383 - DNA, 2076 bp, Homo sapiens
aacagtgtactcccaattcttgccttccattctttgtgctgttatcatataattttatgttattttctctttaagccccactaatgtttatactttaaatgattctgtaaccaccctcactgttaagatttttctaggtttgtgacagtaagttacaagattcataaatttgcactgttttacaggtggagaattaggaatatagagacaataagaaaaaagcgttagcctgacaaagtcagagtgctagaagagagctttcaatagctacagataacatttcctctcattcttaccactcagtgtttttctttagtcattaccttaattataactcttactttataagaaaaaaaactaaaaagaaaaaaacacttttattttaaaatttacatttttcttcatgcactatataataaacacgggagtcaaatattcttttttttttctgtctgacagactgaagattgtcatccagtttttacattcttgattctggggtgtgtatttcagctttgagtgtttcaagcaacagatttgttgataatttatgattctttataatttctaggtgcatacataaaatcagtcatgttttagtatgcatttcaaagacataaagctttatttttttcttaagaaatacggagtgtaatatgtttactataattagctgattttctttcaagaaagtttgtggggctttttttttttttatagtatttgtgtggaagtaatcgaaaagacaacatatttattgatcctggataccaaacatttgagcaagaattgaataaaatactgcgaagctggcaaccaagcatacttccagatggtaatgctattttcactaaaggtgttgctctcttgatattaggattgttatttttacagagtatgtttgaaaatattataattaagtcacttaaattagataacattttctgaacacttactcgagctcatctgcctttcatctcttgttgaattagaaacaaatgtggtcaataactagtgtttatgaagaactttgtaagaaatgtaatctactttctctggagtacgagactggatgttcatgtcttaagccttccagtggagcttctgatgtaaatttctcttaaaccactgttttcagtccgtgaagaaaatgtgtatgtatgtggagtcatcaatttttttcaggaatttaaattcctgaattttaattttaaaaggatttacactgttttctgaccactgtttgcttgtcctactgaagaacagaagcaaacatccagtcccttattccatagataatagttccatagtagcctctgtattgttaaagagctgcataggtaattctagaattattctagttgatctaatatgaaaggagaattggtatagatttgtccttaaattaactgtgtctgcttctagatggttaaatgaaaacttttatttattataattcttttaaaatagttctctctatttaagggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaaggtagtgtaacagatttctatttttatttttatttttaaattttttttgagacagagtttcactcttgttgcccaggctggagtgcagtggtgcagtctcggctcaccgcaacctctacctcctgggttcaagcaattctcctccctcagcctcctgagtggctgggattacaggcaggcgccaccatgcctggctaactttgtatttttagtagagacagggtttctccatgttggtgaggctggtctcgaactcccgacctcaggtgatctgcccacctcagcctcccaaagtgctgggattacaggcgtgagccaccacgcatggcccagatttcta

SEQ ID NO: 72384 - DNA, 1929 bp, Homo sapiens
tttggcaaagagtttcagattttggatttttgaattagggatgctcagcctgtatttctcaccatggtttagggtggtcctatttggctgcagtagtgtcagggtcttcagttggtagtaactatttgttagtaggaaattcctatctcactattaccttgttggtattttaaaaattgagtttctattatgtagtgctgtaagaattttttaattttatgtgctgccatacatatttcatcaattctaagacattttcacatttcactatttctgaaactgggatgcacagtttaaattgttgcatcttgaaatcataattggcagtgtttcacttgcttaatggtagcattaaaataatgagtggtgtgtctattgatagtgtcttggatttagtgaagtagaattaaaattgtgggaaataatctctatctcagaaaataactttgagaatattttaatgacagaataatggagacagtggggcatagggggtctggtcatataacgtgattaatggggtctgaattattcttgaaaaaagaaaaagttgtggaaattttgtgaaattgactttttctctttttcctcccgcctccaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaat

SEQ ID NO: 72385 - DNA, 1087 bp, Homo sapiens
ccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatctta

SEQ ID NO: 72386 - DNA, 1038 bp, Homo sapiens
acaaacttatggaaaaactaggtttttagaaattttttggatctcagaattcgtgattagggattgctgacctctgtaaggaaactggtgtcaggtctagaattttccttctaatgaaatacgtagtcattttccccctttttaaattgcttagctttggtagaggtaactgaaggctttctttagaattcgtgtgttagattttaagaaaaatgcatgaaattgttaggacaggcataaatacaaatggcaattctagagccattacggaattttgaaacacttaacaattgctttcttttacttttcatcttgcctcaatacttgtagcattacaagtattccacgtaaataaacgtttatgaagagctgcagtcatgtcatggagccaggcatttattcattcaacaaataggttagtcttccacacacaatttcaggtgctgggaacacagaattaagacccagcccttcctctcaaggacttcgcgtagtttgggagaaacgggaatgggctggaatgtcagaataagatgggcacttaggccttattgagcatgatcacacttgtattttgaagtaaaataccctgatcaagtaatttaccaagaagctactttttgtgacacagctccgtctcctgaccgcggttccagacttcaccattacaccagtctattcccattctggaaagggagaggtatcagctcttagggggcagagattagcaaattgaaaaatagcagtgaaccagatggaaggctctcgatctttagaggttattaatcagtgtttgttcgttcaatttttaaccagtcaccttgctgttaagagcagaacataattggctggaatgtaatgtagggaatttttccctgttggatccctagcacctagaaaagttcctagcacctattaggtgttaataaatgattgttgaatgaatcagtgattacaagtacttttaagaattttgaaaataaaggaaccattggaaatacgacctgtgatcaaggaagaaatacctgttttttggtg

SEQ ID NO: 72387 - DNA, 1303 bp, Homo sapiens
ttgtgttatttgctaattagatattgttctgggaagtcaaaaaagccagtttaacgcattgcccagttgttagattaagaaatagacagcatgagagggatgaggcaacccgtgctcagctgtcaaggctcagtcgctagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaagtctgttgattaaagatgagctttgtctacttcaaaagtttgtttgcttaccccttcagcctccaattttttaagtgaaaatatagctaataacatgtgaaaagaatagaagctaaggtttagataaatattgagcagatctataggaagattgaacctgaatattgccattatgcttgacat

SEQ ID NO: 72388 - DNA, 1050 bp, Homo sapiens
gcccgccaccacgcccggctaattttttgtatttttcgtagagacgggctttcaccatgttagccaggatggtctcgatctcctgacctcgtgatccactcgcctcggcctcccaaagtgctgggattacaggcgtgagccaccgcacccggcctacacccaggtaattttttagtagagtcgaggtctcactgtgttgtccaagctggtcttgaactcctgggcctaaacaatcctccagcttggcctcccaaagtgctggaattgcaggcataagctacctcgccctgctgagcctgcgtttttaagaggtatgaggcataagcgggaatctgggagcttcatgttaatgaaaagtaagggacacctgcagaactcggtgctggccctgctgcatgtttttcttccggcttgggctccctgctgctcacctagcggtatcagcacgctgggagcatatctgctgacgcagagctgccttgctgtgtttattttcatttgaaagtcaatattcaaagacttgttgcccagtaagtctgtttgaaccactgggggaaatcaaaaggtttctttcaaggggcggcctttcacctcttatgggtctggttgacctgtatcagtccctgctgcccagcagagaccttcctgcctttcgtttttcctttttttttttttttttgagatggagttttgctctgtcacccaggctgtagtgcagtggcgcgatcttggctcactgcagcctctgcctcccgggttccagtgattctcttgcctcagcctcctggtagctgggattataggcacatgccaccactcccagctaattaccttcctgcctttcagaggccctggcgttcagcaagtatcgcattgcacatttgtgtgtgggaagacacctgggacactggagtagctatttctgttgttttggcagaggaggctgctactgtggtttcctctgagagacctactgtggtttccttccttcctgccgcgtgcgcaggacctgccccggaactgccgtgtgcgtggggcaggtgacacagg

SEQ ID NO: 72389 - DNA, 1017 bp, Homo sapiens
tctctacctccatgagacccactgctttagctcccctacatgagtgagaacatgggatcttcgcctttctgtgcctggcttacttcgcttaatataatgatctccaatgccatctatgttgctacagttttcttataaaatatgttgctgtggttttcttataaaaagaaaattattactatttagggaattgttcacaagcaggaggcagagtttgaggagacgcgtgtgtgcgtgcgcacacacacgcgcgcacacacacacacacacagactgcttgccacaatgcttcaactaaaaataatcccactgtcggatctgcccagccccagggggcgaagcccagtaatgggagtgtggttttccccagtggattgttttctacccaaccctagagggcggggagcctgggtcaggacgtttcctaatactctgctgaaatccgggagcacgcaagaaagaaacctgaatttctagaacttagtgcaattttgaaatcaaatcttgcctggcaagaaaacctactgttctggaaaaataagtttactctgaaaagctggtctcaagccttgacttttaaagcacattaaagctcattagccactatgtcgaggccttatctaatctctggaacttaaaaccggagatcacagtagctggtgggagccatgggaatgatttatagagttacgaagtttaaatggggtttccttacacaaagtcagaacaatctgcaatagctgaaatcgagaagttaaatggatattgtctatgtagatgatcagaatttgcatctcaactatatctttaaaatggagagaatgctaatcattttgaaaaggaccttcagacactgtcagtaattacaggaagtagcgttcttttggaaatttatttgttttcttaaaggattgttggactttcagtcttggttcactgagactcagaatatttcttcttttggtagagatgggtgtgggggtggggggttcaggcagcattggacacatgggatgg

SEQ ID NO: 72390 - DNA, 1811 bp, Homo sapiens
gaagaattgacaccaatataaaacagtagtttctgagctatgagattgtaaatgcttttgaaatattttccagatttttacaaataaaatattggcatactgtatattagtttaaggaaaattgcctctatttgtagataaaaatggtacattttcaatttcacagagttgaacttttaatagattttcttaacagattatattagctgggcatggtggcgggtgcctgtaatcccagttactagggaggctgaggcaggagaatcacttgaacccggaaggtggaggttgcaggagccgagatcgcactattcactccagcctgggtgacaagagcaaaactccatctcaaaaaaaaaaaaaaaaagattataagagtactgtagcatagcagagtataggctctgaagccagatgccttggctctcctactcagctcttactctccctgtgtctcagttcttttatatatgtaatgggattaactattataacctatcttacagggttaaggtgaggattataggtgaggattaaatgagttaatgcatgtgaaatgcttaaaatagtacctggcagctgggcacagtggctcacacctgtaatcccagcactttgggaggccgaggtgggaggattgcttgagcctgagagttcaagatcagcctgcgcaacatggcgaaactccatctctacaaaaaaatacgaaaattagccaggcttgatgttgcacacctgtagtcccagctacttgggaggctgaggtgggaggatcacctgagcccgaggaggtcaaggctgcagtgagccgtgatcacacccctgcacactagcttgggtgacagagtaagaccttgtctcaaaaaaataaaaaattagccagcctggtggtgtgcacctgtagtcccagctactctggaggctgaggtgggaggatcatctaagcccggggaggtcaagggtttagtgagttgtgatcacaacattgctctccagcctggatgacagagtgagaccttgtctcaaaagtaaaataacaaataaaaaaaatatatattagccaggcatggtggcacatgtctgtagtcccacctactcgagaagctgagtgggaagatggcttgagcccagaagttgagactgcagtgacccatgatcatgccacagtgctccagtctgggcaacagagcaagactctgtctcaaaacaaaactaaccaaacaaaaaaaatgtatgtgaaagatagttaagtgctgggcaaatgttaattattatatattattttcatattgagaaaaaataatatatgttgtaaaatcatctgtgtttttaatggggagtagagatatggatcatactaagtaattgatgattgaagcatttatatttgagtttagaattaaagtattacatatttgtactaacaaccccagcttctgtgtacttggtcctaatctttccatcctgatccttttatcagcttcttagaataggttagttcaatggagaatgtgattggtaatcagaaatatgaaaaagaaagttctaatttacataagggaaaatagaaggattaatttactctcccttttttaaaactaattagtagggaggcttattggaaattcaagttcgtggctggacatgatggcttatgcctatagtcccaatactttgaaaggctgaggtgagcaaattgcttgagccaaggaattgaagaccagcctgggcaaaatggtgaaacctcatctctacaaaaaatacaaaaattagccaggcatcatggcatgcccctgtagtcccagctactt

SEQ ID NO: 72391 - DNA, 1020 bp, Homo sapiens
atgcttgtagagcaattagcactgcccctgttatagagtaaacagcaaatattttgtgcttttataaagagatctatttaagttgggacacaaaaaattaaatatattctacaagttctgtagaatttttctcaccctgagagcatttaatatggaaaaatatgtggaaactgtcgtctgttacaaattgttataatagttaattcaaaaatgagaatgtaggtatcagtccaatttttacttaaaatgattagacattaaaataggctaatgataaattggataagaaaagtaatttagaactgaacacttcagtaactgaaaacctgtgttggagcaaatcgagtgcttacctttacagagtactagggaccctttaaaaaatctttgaaaagccacatttaagaaaaccaacagcatcaatatactaaaacaaaatcaagtaaggttttttatgctttcccttataggtgcgtggaagtggtgaaagcttctcaatatgtagagctagccaatgatctggaaataaacaaagcagttacatacttgagacaaaaagactataaccaagtaagttttaaaaaaaattttagatggaattccatatcttaattggtcaaagcattaaaaacaggtaaactcctttctagaataatgttatctgtgattattctgaagttgaataatatttttatttctattttatgttaattttcattaaaatagttttaaacttttattaatttttgcctgtttgtcgtttctttttttttttttttttttttttttttttttttttgagatggagtctcgctctgttgcctaggctagagtgcagtggcgtgatctacactcactgcaagctctgcctcccgggttcacaccattcttctgcctcagcctcccgagtagctgggactataagcacccaccaccatgcctggataattttttgtatttttaatacagatggggtttcaccgtgttagccaggatggtctcgatctcctgaccttgtga

SEQ ID NO: 72392 - DNA, 1034 bp, Homo sapiens
ctaacacagttacttttgcttctacataactgctttctaggagcaggaggcaccaagagtcaagcatcttctaatcagtaaatatattttaaaagaaggaaggaaggaaaacccagtgcctttctctacccttgtttttttctttctaatattctgtagcaatttctaggttgaatactcattcacctttcatgtaaagtgtctgaccgttccacacatcttacttggttaggattatctcagacctgccaggtagttaaaaacatactttcatttctcatgatttaaaaatgtaattatatttggatctactttagatcactttttgtaacactcccagaattattttctgttactggttttgaaaaattctgtgccatttttccttcttggccttctgaaactccaattacatttctattagaccttttcattatgctcccgtaagtctcttgtgttcttttctaggaacattttttagccatctattttgccatgtttcatttagtctgaacattttctgggaccttggccttaaagtcctgtttgctttgctagctctacagtgccttcaaaaaatatttttagtattttctataatctttctagttgttctctgtcaaagaatggtcttctataggctagtcagtcatggccagaagcagaaacctaagaattattttgtaaagatcaaatttgatcacatctcttaggcaaaacctttcaaggcctcactgcccaccccattatgcagaataaacactcagctgcatcacatgactcccaaggatcattattattatcatcatatttttatttttttagagagagtctcacgcctatgcccagtctagtctcaaactcctgacctcaagcaattctcctgccgtggcctcccaaagtgctgagattataggcatgagccaccatgcccagccttccaaggctcattatttactactgacctttcttccagtcaccaggtctctcttcagctgtatctaatctgctgttagaacatctatgttttctta

SEQ ID NO: 72393 - DNA, 1063 bp, Homo sapiens
cccttttgtgcccttccctggtcttacccttcaggaacactgatcttttccccgaccataagcttgagtactgtcatattacagtggtagtaaccttcagatattccatttctaggctgtagagatcttaaaagtgttggaaaaaaaggacagtagagtgaaaagtgcagctgcaaccaatctctcagccctgtattatatggtaagtttttttactactaagagttaatcatatgctatttttatattgctaaatttctgcccaaggatcatgcctagggagaggtccaaagaatattggtggagaatggtaagtggactgaggagtatagaggatctgatcctgacaagtgccaggccaggggctgagttggcagacatgagtgagaacaccatctctgaaggagaagggaggaagaaaaattgtagtgataagcatcgcatcatagattatgcaacatacagctggaagagctagagatgtatttcaactcctttgtgttattggtaaagaaagtgacatcttaggttaaaagatttatgtaaggttacagagtatcaactctaacaagcatttattgagcatctcactggatgccagtcatgggaataccaaaagtctaaaagctccctaaaggggagcgttcttgtctttggaacaaaggaggtagactaggaaggaaggtttaaagtagagaacaataaacgaatgcagataataagtgcttcagaaattcagaggaggcaaataacattttaatttaggactttcaggaaagatttcatagagagttggatctttcaggtcagaatatagaaaggggcatttgtagggagaaggggacgaaacagaagtacagaggcaaggaactgctgggagggaagtgtgtataagagtcatttcttttcaccagaaaatacagaatttctggtaggctttttctgaatattgaaaattgattataggtaggtgtggtgcctcaagcctataatcccagcactttgggaggctgaggtgtgtgaatcacttgagcccaggagtttgagaccagcctgggcaaca

SEQ ID NO: 72394 - DNA, 1050 bp, Homo sapiens
cccaccctaacattattctttaaaaaaatcctcagttggccgggtgtggtggctcatacctgtaatcccagtactttgggaggctgaggcaggtggatcgcttgaggccaggagttccagaccagcctgagcaacatggcaaaatcccgtctctactaaaaatacaaaaaattagctgggcgtggtagcacgtgcatataatcctagctacttgagaggctgaggtgggagaatcacctgagcctgggaggtcgaggctgctgtgagccatgtttgtgccactacactccagtgtgggcagcaggagtgagaccctgtatcaaaaaacaaaaacctgagttcatcttcattttctcttctggataaatattttcatatattttgagatttattctgttatgttaaataaattaataccaataatgatacttatagattttcttttttttcttctttttttaaggccttacctatgagaaactaaatcggctagatgaggctttggactgtttcctgaaacttcacgcaatcctacgaaacagtgccgaagttctttaccagatagcaaatatgtatcttatttgaaaaccttagggacagttattaattctctcaattggtgattgaagatcaattattaaataagtttaactaatgaagtaattgatgaggataatatttgaagtaagtgatgaggataatctggcagattattgtgtgataaatatcatttgagtaatcctattttaagatgtagtttgcatcgaaagaggaattaatggttaaaactattatttattaaattttgaaaataactgaagtaattaggacattttcggtacatataagccattcattgaaagtcaatttggtgctttagaacgttgtattaattctgaagcttgtagggtatcattgaagcactaacttactaaataaaatactgtttattactgattactattgattgaatttggataatttttcttacttttttagctggcctgtagatataatgaggtctccaaagactgttaccctctaaaatta

SEQ ID NO: 72395 - DNA, 1050 bp, Homo sapiens
gatatgaataaattatttgtatatacaccgaagacttagtaggtactaaaaggaagctacaaaaaaaaaaaaaaacaacactgtccttgggtttataatctaattagggaaaactcacaggaaaaacacatggaaataatttccttaatatgctgaacatgttaagaaaaagaataactggatgcaacattcaggacatttttattaaggacaatttttggacaatactttgaataattctaccagaaatttgggagttgatcttagtggatagtaatggaggaaaagggaaagcaggctatatacatagggagcaagagtgttacctccacagtactgctgcattccatctccacccctgagatatccagaggaaacagtatacaatagcacattactgtaggctaagaaatattgttactgtaatgttttttaagtttgcttattgcttaatgaatttagaaaacatgttttccttaactgacattgcataagatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgaggtaggtgtgttatcttaatttccttctgtgttttagcattttatgaattgttataaagaaggcagcaaggctttaaaattttagaagatcttaccagttttaaaatgatttatttaaaataaagcattcttggaaaatgaagttagtttttgttttgttttgttttgagatagagtcttgctctgtcgcccaggctgctgcacagtggtgcagtctcggctcactgcagcctcctcctcctgggtttaagcaattctcttgcctcagccttccgagtagctgggattacaggcgcctgccaccacgtgcagctaatttttgtatttttagtagaggggtgttttgccatcttggccaggccagtctcgaactcctgacctcaggtgatctgcctgcctcagcct

SEQ ID NO: 72396 - DNA, 1061 bp, Homo sapiens
tcctctttctcagaaagtttcccccaagctgtataagcttctggccccacacattctggatctgccccactgtcaccattctttatccttccagccaaagaacagtgtgctttatctatacttgatctttattttctcacttcccaggtgctcttcaaatcagtctaaccttgactgcttccattcacacagctaaaactaccctcactaagattagtcacttacatagcagtcaatatgatggacactcttaactttccgtctgcctgacttagcagcagctctgtatatgtggcgtttgtgacacacccctcctggcttccttcagttcctttgcactgcactgaggccactttacctccatcacactcttaaagggcaaggtcagctgctgggccagccctggaatacccggtggggcatcacagagtctgtcctgttgcctggtgggattgctgtctgcagcagctctgtctcttgggtgtttactttgcatctccgaaggaagcacttagatcatgcctgaaaacactactgagcagagctctgttgtgtgaatggtatgagagatgtgcagttaactgagtcttgacagttgagatttctttttttttttcttacataataggcacattcttagagagttctttgaacttagaactttatcaaactaaggttttgataaatgttttggttttacttttgaagttgccttctctgtaacttccacaagaaatccttgctacagctattacaatggtacagctattacaatggttagtacacaagactccttatggtggagttcactgattctcaactgcaaataggcattcagttggaaaaaaacaccacattctctgtgcacaggaggatgatgaaggagaaagacaaaccggtagagtcggaccctgagcataatgagagcacatggagccagtcccgaccaggggacacacagggggtctcctgaggagatgagggaggaggaaatagctgaaaagatgagggagggcaggcagacagggattagcggacccatccatgcagggtccatgcca

SEQ ID NO: 72397 - DNA, 1037 bp, Homo sapiens
taaacaggccagcaccatgaggtttagctggagacgctggactgactcttggggaatcaagtggcctggctagaacccgatgccactgatggctgtaactgcctactaagttataaattgaatttgactgcaattgggacgaagactccttgaatttcaaagcacagctctgaattcaaggagtctttgtcccaactgcagtttctatccctaggaaagtttgaaaactcatgtacatttctctaccatggcagcatccacagcaccattagaagctgtgtgtctttccaactagattctaacttctttgagcatggggaccacgtcttatttgttcccatgtccttggctcttagcacagtgtttggcacacagtatgcatccaataaacactgtgaatggatgaaaggcctgcctaactaagagctacatttgtctttgtcctgactcctacatcacaaacagatatgacagaatgcagctggatagttacatggagctaggtcatatatgcatgagagtgctgagtatggataggagagaatgtaggtatatttatagaccccaattcgacatttatttttaaaattagcttctttaaaatcaccaaatttgtactaagtttaacttacactgcctgcctgaagtagagaaagaaggtagattgttgatgggaagaaggggtggaaaactcaataaaatgtcttattatgtaatgatgtcacaaggagtaaaagaattttagagatgcaaagaacttcagaaatcaccaaaagcctatagcatttatgtggttggtccaaagacatatatacatcgtcacgatcaagactgggactcacactatgtctcctaattcctagcttgtcactaattctacactaaaagtcagactaaagatttagggctgtcagcattccataggaccatcctccttctcgtggcacttccttcaaatggaaattttaaaaatgtaacacagcaaaacctcataagtacgcccatctatgataatctgtccaacctgagagattaat

SEQ ID NO: 72398 - DNA, 1031 bp, Homo sapiens
atgcagacatccagatgggaaatatttgaagcaattctctttttcattatattcagtaaatatttattggtttaaagatgtgttattaatgttttcattcataccacgtgccactttgaattgtaccttgttttaattgttatagtcattttgaatgccatcttgttttatttttatttttatttttatttttttcgagatgtagtctcgctctgtcacccaggctggagtgcagtggcacaatctcggcttactgcaacctctgcctcccaggttcaagcagttctctgcctcagcctcccaagtagctgggattacaggctcctgccaccatgcccagctaatttttgtatttttagaagagatggggtttcaccatcttgaccaagctggtcttgaactcctgacctcatgatccacccacttcagcctcccaaagtgctgggattacaggcgtaagccaccgtgcctggcctgccatcttgttttgagtgatttagaaccattccatattagtaagaccatccagataaaccttttaaaaggtccaataatagacaagcagagagccaaatcatgagtgaactcccattcacagttgctacaaagagaagaaaatacctaggaatacaacttacaagggacgtgaaggaccctcttcaaggagaactacaaactactgctcaaggaaataagagagaacataaacaaatggaaaaaaattccatgcccttggataggaagaatcaatattttgaaaatggccatactgcccaaagtaatttatagattctatgctattcccatcaagctaccattgactttctttgcagaattagaaaaacctactttaaatttcatatggaaagaaaaaagagcccgtatagccaagacaatcctaagcaaaaagaacaaagctggaggcatccactacctgacttcaaactatactacaaggctagtaaccaaaacagcatggcactgttgccaaaacagatatatagaccaatggaacagaacagagatctcag

SEQ ID NO: 72399 - DNA, 6008 bp, Homo sapiens
tgctcaggctggtctcaaattcccgggctcaaacagtcatccctcctcagcctcccaaagtgctggcattaaaggcctgagccactatgcttggccaggccagctttttttgagagcttacctctgtcctggttgaatttcccttaagcccacaccttcttccactttcctttataaggctttataatagagtattaaaaacagaaaatttcccatattcctatatttactaaagtcctcttcctgccctttctctaagagctgctgggcacagtgctggtttggagctttcagagtgccctgctccacttggagaaggcactggaatatatttctccgccccgtcctcccaaaagactcctgcctgtcctgtctttgtgcacattgctgtcctcagaactgggtggaccagatatctctattaacctctggggaactattgcagacttagattatgtgtcaaacgcaacataaataggaataatgtgctttgaagaggcagcacaacaaagttgattatcacatgggtcttggggctagattggtggactcttgcttgatctgggccatatcacttcacctcactgagtgtcgaaaccttcacctctggaatgggaatagaaacagtacctgtctcgaagcattgttgtaaatgatagatgaattaatccatgtaaaaggttttcaaacagtagtacttaaatgctgaattattctaaatgttaactcttaaaaatgtgtccctgccttttagaaccccacagtccagtaactgataagatctacttgtatgatattctaaggaggatacttgtgtatactttatctcttcaataggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgtgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacatttttgttttgaccatgtgtgatttgttcatgggtatttagctagactcttttatgaaatgcattgaaatggtgctagtttgtttaccattataggaagattgacactggggacattacacggtcc

SEQ ID NO: 72400 - DNA, 1976 bp, Homo sapiens
cacaagaaacagactcaccactttttctagcaacacggcactttcttaaggtaagatgtctgtgcggtaggtcagaaaatcagctactttcaaaagtgtggtcggtgcacataattctgcattcaaatgaggaaatgcttccattctttcgggggcaaggaaaccatgacttcctgttcactgtttttttctggagatcagctcttcatggacacattctcatcctctattttttgtgttcttggaaattgatgtggtacacattgagggaatttgatattgttgattattcagataccacagcaagtagcaatatctgtaaggtattttttttaaaacattaaggaaaatttcagattgatttaataaatagaataacaaccaaccctctcttcttcttttttggactggggagggactggaggatatatgatcatcctatgtttttatttagaagtcttatgtaatttcagctggtttttgatatgctggttttgcaaaagcacaacacagagatgaccactgcggctggcgaagctttctacacgttggtgtgtttgcaccaggtactggacatgcctcttttcaggggactcttctcattctattttgcaaagagattgttgagatagatggtgggtcattaatccccccttataggatctgtgactcagtgcttcagttctgtttcagtgaggaagtatttcttagcttctttattagctttcacatgtcagtttgtgtttatctgacagctgtttgtcagttcaaagcatttattttttgtcctccaccattatgaaccatcctttgcaatggtcactgccccaaagcctgtccttaaacaactgtgctaggaatgaggaatacataatgggtgtgtgaagaactcatggttttttgtaagggagacaggatggcagacaaggaagagtctgccttcagacagtatggaagacagtattttattgcatattatagaaaacagtatattatttcattttgttgatcttttaaagattctgaagcatcactgataatggggttaatagaagagttaggctagcttacctgtctccccacttctgatcgaataggtgcctgtgaaatttatgaaaaggaccgtattgaacagtttgctgcctctgtttccccttttcctctcccatgcatatatatacacacatatatatgtaaggtacatatatatatatatatatatacacacacacgtatatatatatatacctcccagcatggccaagaagctttggcgttttatttccatctttaaaaaagggtttagaggaggtcttccatactatttaaagacctcctttctctagacttcccgtaacatctgtgccctaagctgaaggtgccctggggcttcatttcttgctctctgccctaggctgccacttcctgcaggtggtacctgctctcaaatctgtgccctttctctgtcatttgtcttacttgttgcttactagcaaggtagtcgtcttgtctgatccttccttccttccttccttccttccttccttccttcctctctttttcttttcttttttctatctttttctttcatttttcttttctttcctttcttccttccttcctccctcctctttctttctttctccctccctccctccctcctttcctcccccgttcccttccaccctcttgtctcttcctcccttcctttcttccttccttccttctcttcctttatttctctctctccctctcttttaacatatttacacactgcaggaaagagcaggtttcaggaatggccagtatgatacttgctgcctggccccagaggctctactatctcgctttttttttttttctgagacagggtctcactttattattacccaggctggagtgcagtggtgcaattactgctaactcctgcctcggcctcctggcctcaagcaatcctcccgcctcagctccccaag

SEQ ID NO: 72401 - DNA, 1347 bp, Homo sapiens
atgaaatgttatcatttttacaaattatttttaatgtaatgaatcagaagtagtatctttttaaaatttgtattgcttgattaatagttggaatggactgttttcctttagagtcagactttgataaacgtttgtttagagatgttaatttatctgtttaggtcttagtattctcattaatttatatatatatataattcatatgtattaagaatgataaccctttgtcatattggttgttcttttttaaactactttcttttttatgtaacattttaatttctgtatttctcgcattccttttaagcttagaaatattatacacacttgaaatcaaatggatatttctatagaaattgtttaactcattatggctagtatgccagtagattttatatttcaaaacattgattaagcattagttttatttctagactgtcccctgctcttaacctccccaatacttctgtatcaagtactcatatcccctaataaaactcaaaaggatgacacagggctggggtctcagatctttttttcacccctggatgtgctgtctcctccatcccctcaccagagaccaggcaggacgaggtcagattctttattattcactcattgatttatttagcctctaggggtgagtttattttcataagggtagaatacacacttggaagatttattgatgttaccaccataagcctgcatccttttattttaatagatgaagtgtttagaggacatgagccaggtcaagcagcaaacagatctgtgtcagcagcggatgttgtgttgtatggagtaaacctaattctgcccttgatgtcacaggatctcttgaaggtaattaatgaaattgaatgtgaacataccactatgtgtaactgaagttcaaagatactttagacaagaatatatctgtgatttaatttagtagttgtatctgctaagtgcacatgaagatacaatttttgtattttcattaacggttacttgtgcatgcttctcagtaacatgggcccttacttagtctctgtttctgccccaaagtcctgcaggcacccatacattagtgactcgttttgtcagggagtgctacagaaaggagcctgtccttttagaaagtacattctgttagcagttttgattacctcataatttgtcactaagggaataaagtaagttaaaagtttcagtgttttcctctgatactttctgaacatcattctcaagttaagggattgagcaaaggaaggcattttccaaggggcaccatgtaaaaatgggatggtatgcttccaagactgatgctgttttaaagtttttgcacattctgactacatt

SEQ ID NO: 72402 - DNA, 1896 bp, Homo sapiens
atatacagggcaggactgattatctgaagttacgttctgtgccaagaggaattaggtaaaggaaaaaggaaaaaaacagacaagaactttgaattgggcttcactctgtagaggtcggcaagctgcagcccatgggccaaatgtggcttactgtctgattttgtaaacaaagttttttttcctttttgactcattacttggaaagagatggagggaaatggcagaattctttgaatggcagggagacagttatgtcccatgctttgggtgttctggctttacatgagcggaaagttaggatgaccctcaaaatggggagtgtaaagtctggtttagatattctttgttatgtgcttgtcctgcctccaacaattagaaatgttttggaaagtgaatatgtatccaagcagaggaaataaagcatgagaactgagctttaagaaaattcctggtttatttttataggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagaggtaagcactttctaattttatcccctcaggattaaaactctttgaagctgtaataaaataatagatctttgcttaaaatttgattagtattatcttaaataatatttttattccttcaaaagatttttaaaaaagatttttgaaaagaacttataatttagagaaagtcatgttgaatgaatgtaaattttttttttaatttcttctaaaaggaaacaggatacatatacagaacgttcagatttgttacataggtatatgtatgccatggtggtttgctgcacctgaatataaattcttgtcctaaaattttgttagaaaaggggtaaaattaaaaaaaatatactcttaatatatgctttctagaaattattgttttaatgtagtttaaagcaagaattattgctactgttggaattcggagttaatttatatagattatattttaaaatttttttaatgtcagtgtaccaagtagcataatttgtgcatttttttttttttcagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacaggtaaaatgtaacgtgatggtttttaaactttgttgttatcctcctttttattaaatcaaaggattgttttctgtaagagacatctcatgaggaaattcaatttatggaataaatgaaagaagatctttgtggtcaaagtgagggtgaggaccagtggccctcctgcttgcctttcctcttgtaagaataatagaaatagtatctctcattcattgagatcttactaaatgccatgcactgttcttacctctcacaatggtatgaagtcaatcccattgttattctcactttatagatgaggaaacagaagcacagagagcttaagtcacttggccacagatacttagccaggactgggattcaaatcccagcctgtgactccagatgccagtctcttcagagttacacttcctgactaatcacttctccatgttcctcacggtggccac

SEQ ID NO: 72403 - DNA, 1034 bp, Homo sapiens
aaagaataaatgacttctgttttatacctacaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcaggtcagaatgtaaaacttaaaacttcatttggatttatgatgatagcagttatagaagcaggaacatttttcttggtggtttttcatcaaaatagaactgtttaagagcagtttaacattttctgtgtggaagagaattatgtgactggaatgctgttttaatgtgtttttgagcacatcccttgatatcgtttattttaactgctgttgaagatacagattattatttgggaatagattatgcttttttgtatttggtttaatactatgttaattttttaatactatgggaataatagaagttgacgggaaaatcacactggaaaatgtgagtggattgaggatgtctttttttttgaccagtggaaatgagtacatgtgtaaagttgatgtgaagtaagcactacttcagattagatactaatttcagttcgatttttctctgttttttttttcttgagttgatctttcttgcttaccttaaaaaatttgtttcctctcttaagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaaggttagcccattgttggaggctgactgtgtgtgtatgtgtgtgggtgagaaactctttttcacttcttagtgtagtcctttgaactggcaaatggttacacggtcctaattccagatagagcctacatttttggagtaatgggttttaaaaactatgtcacagtact

SEQ ID NO: 72404 - DNA, 1799 bp, Homo sapiens
cagcctggcgacagagcaagactctgtctcaaaaaaaaaaaaaaaaaaaaaaaaaaaaaaaagggtcctgaaagtgaatttgaaaacaacatgtgaaatttcagtatctttaactttattttaaatgtaggttgcaagcagagatgtcagtaatgatattaacattggtttttgtcagctgcaaaaccagtaactcaaacaggatgctgtccccttcattctttttagtatgcaaaaatatatggatatcatttaaacatgcaatagaaaatgtggctttttaaaaaatagttgaaatattaagctgataaccaaggaaatgttggggaatttatttcctttattgttgcattctcttgtttgaaatgaaatcatactttattgaaaaagttatatattcattttaggattaccttagtcattagatttagtgtctctggaaatcagtgctttgctctggtttggttggtggtgaatgttaatttaaaaagcagttcatttcagggtgctgtcatattatatattctttgttatattttttgcttgggcagtagcatcaggaatgctttccttgtattttaagtgctttttccatttttgtcagatgttagtgtgggagcaaaacattttggtatctgagagcacagactatggaggattgggaccaaaaaaaaaaaagtcaccatgtttttaatccaaagaattaatatgaaatttaatgttatatggtagaaacatttcttgtttcactaaaaaagcagctcacatttcttaaaacaggtatcatttgagaaataattattgactgctgacaacgtaacagggagccttcgggtatttgaacaaaacagatagaagtcacttctcttttagaactctttataaaggagagagaataaataagtaaattatgcagtatgttagaagacagcaaatgtgacaggtaaaaagctagagtgagtatcagtagggattgttgtagttgtcattagtgtgatgagtgttggctttatctagaaggtgacttgggagcagagatgtgaggttggtaagggaggccatgaaggtgtctggggggagagcattccaagcaaaataaacagtgaatgcaaaggccctgggcctgcttggcatgttcaagaacagcaagaatgccgtggtgggttgagcagaatgaggtggaattttttaggagatggagttaggaaaatagagggaaaacagagaaggtcttaggcctttgtaacatctttggcttttgttctgaatgaagcagcatgccattgtagggttttgagcagaagagtaacttaaatgttaagaagtttactctgctgcattaagagtaaatgatggaggctgggcactgtggctcacacctgtaatcctagcactttgggaggccaatgtgggcagattgccttagctcagaagttcaagaccagactgggcaatattgaaaccccatctctactaaatacaaaaaattagccgggcatggtggtgctcgcctcctgtagtcccagctactcaggaggctgaggcatgataatcgcttgaacctcggaggcagaggttgcagtgagctgagattgcaccactgcactctagtctgggcgacacagcaagaccctgtctcaaaaaaaaaaacaaaatgcaaaaaaacccgagagtaaatgatggaagccaggagaccagttaggagacaaattgtagtaatccaagagaaagatgatggtggctcagacctatagtggaggttgtgagaggttaaagctctgtttgatttattgtgctga

SEQ ID NO: 72405 - DNA, 2924 bp, Homo sapiens
ggatgttgcctatgtatattccttttcaattttcagttacccacctctttctgtctagctgtcaagagatatgaataatttgggccatggatgtctggttatttcagtgacagaagttcaattctcccatatgggaggtgggttgtgggtgtgcagttagttgtgttgatcaccatggagtgattcctgtacttcttgctcttgtatgttttcccccttttgataactaccacggctgtcagcattgttagaagggagttcctagatagctgtgctcaaaggtcggctgtgtcccctctccttttgctatgcagtgcttagctatctaagctatgttatggagccacagaagtgcacgttgaataggcaatgcagttcctcattgtttatttcttttacttgcaatagactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaaggtacacacagtccaaagaaaccccatggagcaaatattctctattcacaattccctggagagcacttaaagtgtttaaagactttaaacacccccaccccgtgtcccagcacactggaacaaatggacagaaacatactcatgattgcgttccttggcttagacatttggagcccaggcactacagcatagatggcagagagattatggaaaacatggtatgagaaatgatttgacccatatcagtaaaaacttggaataaccagttttcaaatgcctgttgtaaaccttgattgtttgtaaagcagtgttttaattctatgttataaaaaataaatcataattcctatagtgctatgacaacagttgtgtactataatgtttttgtatatgtgtttttacgctaacattcaattcatgttgtctaatatatggaagttgtaagttgttccatgtctttgcttattgaactttatgaagctactgttttcttctcttttagtttattagaagaaagagtaacaagactccatggtcagttacaacgacatcagcaacagttacttgcttcaccgggttcaagcactgttgacaacaaaatgcttgatgatctctatgaagatattcactggcttattttagttacaggttggttggtggtttctttttaaaatgtaattgccaactgagcaatttaagccttaaaagaagcttcctatatgaaaaacaatagtgtatatataatattggataaaatttggatacagccattttctgtcatagaactatggatgcatttttaaaaaatactggctaatatgtatgcagtgcctattgcataccaaatgtttcatggatctcattctacccgctgaattagtattgctaggtagtattactattatcatcatcatcgtcattatccccaactaatagatgaagaagctgagactttgagagtataagaaactagcccattgtcacactgctattaatttttagagccagaatgtaaatctaggcagtctgactcttaggatcttcttttttgaccaccatactattagtgtttccatattttaaataataagcaaaaaatcttgacttttgaaaatgaattccctaatattgacttctaatatagatagtagcaaaatttctattaactttacagaatacagtactgaaaattatttaaggtagtagattaaaaagcccctatgaattacaaaattggtgaataaaacatttgtccttttctgtagttttgagggttacttatctgagacatagaaagttttttttgcataaacttgaaattaacaggttaacatttataatttacatcaatttatatgatgtatataaatcaaactgaaaacatttatagtacaatttgataaatgtagatttgttaagtgttcatttttaattttttttaaactgaaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggtaatataaactctatagctgtgctcttgtaatttttatactgttttataaattctgagttgatgggtagatgactggagtgataggcacgttgtaaatctgatacatgaaaaaaatgaaaacttggagaagccttgaaatacacaaggatggcaagtactcagtatatttaggcagtgccactctagtgagagttgacagctatacccagtactgaagaaaagtaatgtcaaattattctgaatacaatgagacttggaagggacattgaatgtagttaggaacataacgcctgtccatcagagagcaatactgatgcatgcaggcgccctaaatgaagggaaccagatgaacgtcaacaagtatcgttcataaaagctaaaactacgtttcggtggctttctcatggaaaatgatagataaaaatttgtatctcgtaaaatggaaatatgtattctaaatgtgaaacttaagagccctgttataatacaggagagtgcctcaaatgaggtgattcactttaatcttcctaatactaatggcaaaattttcgttaattcttaatggtgaaattaaggagggataagcctgtattaaaaatgttccggccaggcgcagtggctcacgcctgcaatcccagcactttgggagaccgaggcgggcagatcatgaggtcaagagattgagaccctcctggccaacatggtgaaaccctgtctctactaaacctgcaaaaattagctggat

SEQ ID NO: 72406 - DNA, 1046 bp, Homo sapiens
accaagggcatgagcacatagtgtctagcttggtctccttagtcatctctgtgcacgtgctgctgccttggctgctgggttttggccagagtggccatggagcagggccagggtattatgaaaaagcgctaggttaggtttcagttttctgtgattagactgaaagatttagttgccaattgtcaacaaccatatttctcacactttgctcgatgagttatattatctccaaaagaaaccagaaggctgtttagaagtccatagtcttactgtaaattgccatccaatgagttgaggctcttgcagtctacctctgatcttctgttctaatatcagagtgttaataggagggattattgaaaactttttttaataatagaaaggcatataagacttttactttttagttatacttttatgtatatgaataattaaaccacgataacatgtgttagatatgtacctaaaaaacaaccaagataggtcttagaaaatatcctgcttttttttttttttttttggagactgggtgagtcagaggatgctattcctaaattcctcttgtgatatgttaccagtctgtttattttggcaagataaactgttaagacttaacaaatgatggctgtaaagcacatgctttgttaagtatataaacaggccacagatgtttctatggaaagaaagtatcttattcatctccatattccagtgcctggctcttagcgttcaatagattttttttttttttttttgagacagcgtcttgctctgtcacccaagctgaagtgcagtggcgtaatattggctcacagcaacttctgcctcccgggtttaagcgattcttctgcctcagtctcctgagtaggtggaactacaggcatgttccaccacgcctggctaatttttgtatttttagtagagacggagtttcgccatgttggccaggctagtcttgaactcctgatttcaggtgatccacctatttcagccttccaaagtgctgggattacaggcatgagccaccatgcctgactgagagctct

SEQ ID NO: 72407 - DNA, 2010 bp, Homo sapiens
attgtaagttgtgttggttagattctgccaacgtgtatgtgagttttttcgtatcccttcagaggtgttcagagaatagagaactcgagaatgattatgtttatgtaatcgggcactttcatgatttgatgaggaaaggaaccaggtcagacaagtgtttatacggtagagaaaatgtagtaacagaaaaatagaagtttaaaggcatgatatgtacagttgaatgtttcagagggatactttacattctaaacataaaaatccagggtaattttaagtatttaacattttaagtatttacagtttactcaaacctctttcaaatgatcacagattctgaactagtcaggttttatttaacatgaattccttgcactttccctctccaccttggtttattttctcttctaaaccaggtggattaaagagcatgttgatcctatatttagaaactaagctccttttagttctgtttgtgagttaagcgtgttcctaaacgttttaaagaattgctggaagatatatggcatccttggtttgcaaattttaagtgcagaatttatttgaggacactgacatcttgacaatttttccttcaagatttgacataggagtgttggaatatagaaagcctgcatgcatttgcagagaagcagatgtgtgttgtgcttatttcacagcaggcgtgctctagtgaagatgaacctaacaggtttcattcaagaaaagtattatttcttttcatttattttactcttttaattaatttttaattgagctgtttatgatatttaaaaattattttttaaaataattggtcacctattgaaaaggacagagggaaaagatctgtttaaagttttgcattagtcgtagaaaccaggttggggatgtgtggtgaagttgagggctaatggggtggcccaggcatggtgactttcttaagagtaaacctcctaaatgtcatctcaacctcaagcggtttccgttgtatcttctgtatgctgggagtagaggaccaggggagtatacagctaataccagaaatataggaacaaatccagccaaaccaaattggacctctgggacagaaaccatttcatcttttgttttcttgggcacccagtaattgtagtaatagtacataatacgtagttgtcctgagatggaaaagtatataaagacatgatctttttttttttgagatggagtctcgctctgtcgcccaggctggactgcgatggcacggtcttggctcactgcaacctctgcctcacaggttcaagcgattcttctgcatcagcctcccgagtagctgggattacaggcatgcgccatcacgcccggctaatttttgtatttttagtagagacggggtttcaccatgttggccaggctggtctcaaactcctgacctcgcagtccacccaccccagcctcccaaagtgctaggattacaggtgtgagccaccgcgcctggccaagacatgatcttttaagtaaaatttgaaaaattgaggcatattaaagatatgagtttgggagttaacatgggatgaaaagatgatgaacttttgagggagactgcacagttacaggccaggcagtcatgaagagcaagagttcaagcaagctgcttcacttttttttggagcatgttagcttattggtaaagtcagggtatgaattccttctactgctttatgacgtggattaactgcatgaaaagtacctgtataggccgggctcagtggctcacgcctgtaatcccagtactttgggagactgaggcaggcggattgcctgaggtcaggagttcgagaccagcctgccaaacatggcaaaaccccttctctacttaaaaatataaaaaattagccgggcatggtggcgggcgcctgtaatcccagctacttgggaggctgaagcaggaggatctcttgaacccgagaggcggaggttgcagtgacccaagatcacaccactgcactccagcctgggtgacaagaa

SEQ ID NO: 72408 - DNA, 1030 bp, Homo sapiens
gaaagaaaagggctagttaagtacttcggcaagtacaaaatggtacatccaacagtaagtgttggatggattaagattaataatgatcatattccttcactaaattttccttggctctaatatgtcagattacagaaatgaaacctttaacatctgagaatattaatactataaaactagggagcagtatttcaagagcattcccttcatacaaaacactctaccaggtgtttcatgtccgtattgtatcactgaagtaaaatataggttagctttaaatggatttaagtataatttacatttggtattcaaaatcttttagcatttattaatagcaatgatgtaggttaaactgagattcaaacaaattgtaagcaaactgagaattaataaaagaacgtgctcattatattttggttgaatgaatgcatgaatgtctagggattcaatggtatattgcttttctaagtgcacaactgtttacttccactaaagcagcatctatatactctttattgaacttgtctgctaagtttagcaagaagctgtagctaggcatagttagcataatacagatgactgtcattgttgctgtttttagaagaagcagtatgtctgactggctggcatctgtttctctctttgtcataacatgctggagacagatcaattttcaaaatgtaggtagccctcagttaaaaatcaattgatatgtttaaaataatgacctgtaatgtaaagtggactgagggacaattttcaatttagtttaattcaggaattaattttctagaaataaccagctacagtgaatttttgtcttacctcattcggcatggtagacacgtgacccttacaaaggaagaatttatatttatggattagtaattctttctaacaggtacatcgaaaaatcagagaagattcagatatggcacaagattctctgcagtgccttgcccagttagcttctcttcatggacccatcttcccagatgaaggatcacaagttgattatctagcacacttc

SEQ ID NO: 72409 - DNA, 3131 bp, Homo sapiens
cccctaaagtcttgtcttctcatcagtatggctgcttaaacagaaattattttaaaaggttcttgctaatttataaaaatgtcacatggttatgaagggcttaatatcctgcagcagaagttctcaaacttttaatttcaggacccctctatactcttaaaaatttattgagaactccaaagagcttttctttatataggttatatttgtcctgttaaaaattcaaacaaaactttacaaaataatgtgctaaaaagtaacagtaagaaacgattacatattaacataagtaacattttaattaactatatttttgaaaacgaagcaagtttaatgagaagaatagcattgttttgcatttttgtaaatctataatatcagacttaatagaagacagtcagattatcttacctgcttctgccttcagttagttgcagtatcgcacatcgtgtggcctcggggaaattccactttttacctgtgtgacagtgagaatgggaaacgcagatactgtcttcatattattatgcaaatagtttttttcctcacaggcaacctgacaggcttttaaaaagcttcagggatccctgggccatagtttgagaactgctattctagagtgtaggttttatacttattatatttatgagtcattggttaagttggtattatggaatagcagtttatctcatgtataactttagacagtcctctttattattggctaaatatcaagatgtaagcagtatgttcccacattggccagtgtgtatccccaataaaacggtcaaaagctggaaaaacaattcatatgtgtgtgtttatgtgttggatgctaatttgcagttatagggggaatatacaagttaattagatataatgacgtggacagaagcccaagtaaaaatcaattaaaagtaaaaaagctattttgcttaatcccaattgttaattttagtttcttttcatttgttgtaaaaatatagatgagcccttcaactgcctttttctgattgaaccatttaaaataaagtagttatgtggtatgtattttaaaatatctagaacaaggttatctatccatgggtatatataaaggatattttctatagaaatattcagactgagcattaaatcaccttgtggtttctttttaaaatcagagaaatgatggctaaaaccactatcaagatcaaagagataattgtaactaaattttaaaattccgttgcctgcctcatctgacaggaattgttttgatacgaatccaagtccaagtctttgtattatgcacttgactgaaagtagattccactccagcagtttttgaaaaggtgaaaaacttgctggcagtactggaaacaactctaccagatctgaacagctgtctagacaaaccagacagctgctcctgtcagctgtgaacaaccacacgcaaataacttgaatttgaaagttaacccttttttgctttatttgaacaatttttgtgtttgtagctattttcacttaagcagtttatgaacaagtttgttacttgttttaaaaatgacaatggctaatctttttatttaactttggttaaatttagttttagttatatgaatttattgcctactttaaagcacttttccactggatatcacttgtgctagatttggataagcatcagtatactgttgcataagagcaagactttaaatatgttaatcataagactttaaatatgttggaatactttgggttgcattctgccctatagaagtttacaaacttcttgattttttttccttctataaggtcttggaaaaaaaacccactttcattgtgttttcttcctacctttttgaccagagtcttcttgatctcgcttatggtctcttccttctttgctcatcacataaatattggcattcctatcttagttctcaactttgctgactctgtacactttcctgtggctctctctttgacacgtaggacttcaggcaccggttcccagatgactcctacatctatattcagcacagcctgctccagagtttcagagccttataatcccagtgcttactggatgttttaatttggatggccaacagacatctcagatttaacatgttccagtagaattcgtcatcttccttacttgcttctccttccttgtcttccttttcttgatgcatatccttgccattcatctcactgggcgtcctgctgggctttgctttcccttatccctctgtcccttttccatattcaggtggtgattcagctttccgttttatgatacagtttatattgaaatacatgttcagatatggaggaactcttttgtaatgatgacattggaagaaaggcaagaatttatattgtataaaaattaagcatttattattagttttatgtggtttatatttcaggtaacataaattaagcttgaacagcacacaccgtctcgaaagacagttatttatttattttaactttatttttagttatttcattagctatttcattgagggtattctttcttctgattgctcgcttcgagaccataatgaacattcaagattgtgagatgtattcttattgtcccagattacattctatctgttgacagaatatatccctggatatcatgcttaaatgctgattagattctaaggcatcgtgacaaaaatttaattacagatttcggataaagaacttataagagtgagttgtgttcagaagtttatgaactagacagtgtgcatatatgaatttgtctattgtacttggaatttactatataaaacttaaaatacattggaatatagtttgaaaaatatttgtattttagaccaaggatttgcagacattttttgtatagggccagatagtaaacactttaggctttgcaggtcatatgttcatattcaacactgccattgtagtacagaagcagccatagatgatacataaataagcacggcggtgttccagtaaagcttattgatggtcattaaaatgtgaatgttggccgggcgtggtggctcatgcctgtaatcccagcactttgggaggccaaggccggtggatcacctgaggtcaggagtttgagaccagcctggccaacatggcgaaacccc

SEQ ID NO: 72410 - DNA, 1063 bp, Homo sapiens
ggaggctgagccaggaggatcacttgagctcaggagttcaagacttccctgggcaacatagtgagaccctgtctcattaaaaacaaacaaacaaacaaaaagtacacacacacacaaaacacaaagaattgattgccttactcagaacatttatttcatatactatagcctttggcatcccgttattgtggaaaatttcaaagatacacaatagtggagagaatacccagctttaaacagccagtcttgtttcatctgtgctctgccatccccagaatattttgaagcaaatcctaggtgtcagataaatcagtatattgtagtattgggtgaagaacacaacattgaccttagaccatgatcggtgcctcttaagaaaatgaactcactctatattgttagctcttagggttcacgggctgattttttccccctttttaaattcgggcttctttcttttggcttttttggccttcacctctttccctgtacctccacaagggggcagataaaggaagagagaagggaagtttaaatgaaccagatttgagtttcacttttgttaatcagtcgaatagagttgcagaagattttgggggtgacttttcagaaacaagcagtgatttttctccttgaaacaactcatagtgcccctccttgctcttcagagacagaataatattagctattttaaaaggggttaagcaattatcttaaaaaaaagtttccagagcattattacagcctttaattttccctgtgaataataatttttctgtaaaaataacgatttagactttactcaaaatatagtatttgaatttctatctacttttttcagacgatagctctgggtgattatcattaagatttctcattgagtgatgtgaatgttgcatagtcgaagtattttagctgggcaattgattaccaatggaaggggcataaccactgttttttgtttgtttgtttgttttgagacagagcctctccctgccacccaggctggagtgcaatggtgtgatctcggctcactgcaacctctgcgggagagtgttttcaa

SEQ ID NO: 72411 - DNA, 1869 bp, Homo sapiens
taggcaaaggaaattttcagattgtccatatttgcttgaagataatgtgtagctactgtatgccttatttaattatttttttgagtgtcattcacaatcacaaaacgatacccttactgaaagtgttagtggataaacttaattgcataattacggacctgtgtatttccagagatgatgttttccccactacatgttaagatgtacgtatttaatgacaatgctgtttgttgtatgagaacttgagacagaagatttagtaggattatccagtgacagtcagtacagggtgcgattaagctgtccttctggctcttggcctggtatatgtttgtctctggccatgcagttacagaatagggcaggtggcatgtttatatatgcctttgatttcacagaagttggtgagctttcctaagtggagaattttagagctagataggattgttgtgggagagggggcagggaatggagagttgattcttcactcttctgtggtgcagttgaatttacatgtagctggaactgattttccaagggattatgatggcaatgagcttagaagattggttgggttttagcacttcagaattggatcccttgccggaacccttgctaagagggagtggacttgtatttggtacagagaccaaaaaaaaaaaaaaaaaaaaaaaatcactgtactaaatgtcctgattctttaatttggtgagaacatggatgggaaggtaaagtaagattagatgtgtatgatagattttttttaagataaagggttagcaaaagactgaaagcagctctgtttggctttcttattgatggaattgtgttttgtttggttacaaatgaattattctgataaaaatataaattgcatgcattcagtatttattttagaaaaatatataaagccatagcccaagaaaattcttgaattacactcttatttgaacttcggtgaagtaatagctatttagttccaatcttttgtgacttgtgtgtctcataaaatttgactagcatgtaataaaagacagtttagtaaataatcagttcattgtcaaactgttctttcgtggtgacatatttgttgtaaaagataaaacaatgtaatgtgcagatattataaaatgctaaagtggtgactataaaccaaacttttgaaagttttaaaaggaaactattgttttattaaaattatttttaaatgaacatcttgctttatttaaccttgaaattatttttaaaatattgctttaagaatagtagtgctagatttctgaattctggtggtactggttctgtttgttttttaagttaagaatttaagaattatctggggtagaaatggtattttttttgatttcttataagaattattaagaattatctggggttgaaatggttttttttatttcttatacatacagatagaaatagtcatttgagaatacctgattaaaaatgaattaccttaattctttatattattttgaatgtaaagatatggtccagatttgtgtatcattattctgcccacattgtgatatgctcttcactagttttgtttttcaaattgaaaagtaatgcatgtacgtgaataataacaatattttaggtaatattaaacattatacaatgcatagtaagcctttctcccatataaaagccagcatagtctgttattcggggcagcaacttcagcagtttcatggtacagtctgataactaaaacatatttcttgtcaaaataacattgtctttaaacatttgttctgtataaacattatgatgctgttccatataaacgtttattatactgttctttttgtttcatgttttttatttaaatgcttttgggaataatta

SEQ ID NO: 72412 - DNA, 1713 bp, Homo sapiens
tctcttacaaaaaattagccaggcatggtggcacacacctgtagacccaattatttgggaggctgaggcaggagaagtgcttgaacccggcggtcagaggtggcagtgagctgagattacgccattgcactctacctctagcctgagggatagagtgagactctgtctctaaaaaagaaaaaaaaaggagaagaaagaaaacaaatcataactctttaacattgattctcaactaggaacaattttgtatacttgggacatttggtggtgtcttgagacaatttggattgtcacaactcgggaaatgctactgccatctattgggttgaggctacggatgctgctaaacatcctaaacatcctacaaagcacgggacagccccacacaagcaattattgggcccaaagtatcaatagtcatccacacaaaaacttgtacatgaatgttcagagcagtactatatgaataggctattcataatactatatgagtagaaacaacccaaatgtccatcagctgatgaatggataaataaaatgtggtatacccatataatgggaatattacctgtcataaaaagacatgaattactgatacatgctacaacatgtgtaaactttgaaaacatactgagtgaaaaaagccattcacaaaagaccacaaattatatgataacatatttatgaaatgtccaggatgggcaaatctatagagacagaaaggttagtggttacctagaactggagtgattggaacaaagtaggaggtgactgctaaagcatatggggtctttctggtaccatggaaatgttctcagattagatcatggtcgtggttgcacacatctgtgaatatgctaaaaccattgagctgtacactcagtgggtaaattgcgtagtgtgtgaattatgtcttaatgaagcctttaaaaatacccatcatgtcacggtgtagaaacccacttcacacaggtcaactgcaccattagtagaattatagagggagattaggggtggagataaagttgtgggagagtggggccattgaagttaaggaaataggagaggtggtccaagaaggagcagaggatccatgtcaggacctttaggtgcatcagtagtgaaaaagcaggaagaagcaaaagaaaataagaaagccaattaagacaagtggatgggagaacaaggcaaggagtgtttggaaagcaaagatagatgatgtttcaaggaatcaggtagtcaacatcgtctgttaccgataggtaagatgtagattgtttttgatctacaccgaatatcagttagaacatagttggtcatatggaagtctgtttatgtgaatgacaggggcaaaagccgtatctcagtgatcaggtagtaattagtaattgatgaagtatagagtgaagtacaattgacccttgaacaatgtgagggttagagacaccaacccccatgcggtcaaaaattccagtataactttttactccccagaacgttttactaatagcttactgttgcctggaagacttactgataacataaacggtcagttggtacttattttatgttttatatgtactataatatattcttaaagtaagttagagaaaagaaaatgttgttaagacaattataaggaagataaatgatatttagtgttcattaagtataagtggatcaatcataaatgtcttcatcttcgtcttctag

SEQ ID NO: 72413 - DNA, 1063 bp, Homo sapiens
acagttggtagagagtgactattttataaaaagaaatagttctctgggagtttggaaacaaagcttgtctaaaagatacacacacataaaatattttataaagtacttagataaagctttggaaaatctgtcatctgaaaatgataagcaatactgcagtgttgccaaaggaaataattccttgtttaaagaaagtatatcttggtttttgacttgaggatattttgcttcatggcttatgagtgagttcttgtgtgaccttttcatatagtgccatttgttggctgactgcactacagctaagtattctttgagtggattagctttaagtgtgggagaaagaacttggcagtgagattaaactaagctacagatttagcactcattagggaaatcaatttcaaggaactcaattctgactaatttctaattttggaaattacctggagatctaccattcaatcagtaaggaaaagaatggaataattatgcagccttgtaccatggagagggtctaaataatcaaatttaacttagtttaaaagtgttgaattgatgccttttaaaagatggtttatctgctgggtgcggtggctcactcttgtaatcccagaactttgggaggttgacatgggaggattgcttgagtctaggagttcgagaccagcatgggcagcatagcacaaccctatctctacaaaaaaatacaaatattagctaggtgtgtggtgtgtgcctgtagtcccagctgttcgggaggctgaggtaggaggattgcttgagcctggaaggttgaagctacagtgagccatgatcatgccactgcactcaccctgggcgacagaagagaccctgtctcaaaataaaaataaaataaaataaaataaaaggtgatttgtctcttaggatagacaaataataaatcatggaaaatttgtgtatttagtgttaaatattttgataatttagaatggtatgttaaatgaggctgtgttaaattatcagtaacaatcccccatttattaattttttctaatctgctttcttttttgtatctatattt

SEQ ID NO: 72414 - DNA, 3097 bp, Homo sapiens
agttggtgggtgggtatgacagtgttcagctgttggataagcttgcataaatagtatcatcttgactttaatctttcggttgttcagaggtagtgtgcatatttctgtttaactcctggaaagttgccaaaataatttgtatcctctttccatcctttgtaccttgactgttttagtctgggaataaaatcaatgagttgatattaggagcctgttggatagaaccaatgagaagaaaaatcttcatttttctatttaaaaaacttttgggtattacctggctataatattttggacactataaaatctgtttcacttttcatctatttgggaatgcattttacaaacagaacggggtcaaacatgggttgaaatctcagctggccttagataagtactccaggtcacttctctcaaatgtaaaatgaggatataggttgttctgcgaattaaacaaaataataccttcaacatttattatttttaaatatcatttgaattccactattgagtaggaacagtgtgtcctgagttcaagtcttagatggatttgtataactgcatttgaggaagtactattaacactgaccagaccacttagaaaggagagctaatatttattttgtcatatctgattttctgactagttgttataagatctaaagatacagtggaagatctaaagttagggagaaaatgttctattatgtttgaacaaatgcattgaaacaaagcgttgaaacagtaatgcctcacaattatttcttatcaaataattacagcaaactctggcctgttctattctgactgcgctattgagtgaattttcaagttcaagtaaaactagcaacattggattgagcatggaattccatggtaactgcaaaagagtttttcaggtattggtagttttgttcttgagttttaattattggatcattcactttttactcaatctattcctaatgacatgagaatatttattttatgtagttgaatggtagcctgtacttcaggatttgttttgtgatttcaaaggatatagtaaaatgataggtttggtgaatgtagttgatggtttaaaattacttgtttaattctagtcttaaaaacaatacttctataaagatctttagtttattatttatttcttattgtgtttagatataactaattcaattgaagggactctgctggccttaaaaataggtctggaagaatgccagaaggccgtgtatttcaaatgttattgcagatggtgcgggctctttgtcttgtatgtattgtttggctctggagtaaagttatgtgaaggcattggcttaaatcctagggctctgcactatagcaactgactcctctggctccgcagtagttgtcaaagactctcttctctatggaagtagcatttatattcaagtaaaagtattccatctggcgtcacttgaaagcatactgcgatgtaaattacaagtagaggcctaaaaatggaacacgttcttaaggaaatggtgttttccattggaaattttaaggtgtttgttttgtttcatgattctaaaaggggatacattttgaataaatttttcatataaaatatttgtgatttattgactataggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaattatatccttttaacaaatgaatagtttatctgtggtaattttcataggtgacttaattacagctcggagtctttcacctctgcagctttcataaaacatattgaaagaaaataagattttttttaagaaatagaatttaatttctttataatgccaaaagacagtggatactaggataatactagaagatttaaaagtatttactcctttgtagaagaagtttgaatacatagaaacgtggtggatgacggagctgttgctaattcaggattagcattattctttgggaaggaaaaggaaacaggtagaaattaccttttaagaaaccgaatcattttttccttggacaagtaattatgtttgatttttttgactgacttaaagctagtttggagtgctctaatttaatctttatggatggtgatgttgttcaagtataggtaataagttagtaatatgtttactcttcaagggcctttaccagtataaaaaaatgagaattttgtttttaggaaattattcaaaagtttaagtgggttgtattatcaatgcatatatctgctttttaaattagttacttaaagtagagaaatttgtatttcataaactttaaggaactgctgtctcatttactatgctgggacatctgctgcccgttgatagtaatatacagtgactacccatttgttgtgtaaagtccaatagatctggattcaaggctctgctcatcttaggcaaatcacctgaacctctctgagtctcagcttttccaaatgtaaaatgggggtatggattgttgtgtgaattaaatgaaacaatacatttaaaacactcaggagttagttactatttattgagctcttaatagcctccgtgaattaaatagttcattatataactaactgtcttttatactcttctttgttgaactaatacgcctctgtgtggtataggaaatttaatgcgacctgttctagatgtttttaatctgagagtctgttcaggagaaaaagactgatgataagcagacaggaaatagatgtgaaatcagatcagagatctagtatgggactcatttttattgtaacaagagccaagaggagctacatttacatatacagaaactcgctaattatttgtggctggtaaaattatgacatttaaaggagtgtggtggggtataactccttcttccatttaaacttagtctattcacgtagtagaatattaactgtgaagggctctgtcaggtaaagtgagtctgactcgtgagctctccaggtttctttcccaaaagcagtcactgagctgctgcattatgggg

SEQ ID NO: 72415 - DNA, 2427 bp, Homo sapiens
aattttaatctgtatttaaacatataattcatatttgtcttatttcctttgaaagcagtaggcatacgttaaatcactttaaagctgtttaatttagcatttaagtctcctttcttcctctttgccatactagagagaagtgggtgagaaattcacttgtctacggcagcccctggatgtgatagccaagttaatctctcttatcataagtctcattgatgtttgcatagaagagcagctggaagtctgctttatgtatggcaacctttcataaagtttattcttggtaataaagctcctggggtaagagccaggctattataagagacaatcctctctctgaacaagagtattttattttgtcagctggagttagtgtttgagtatcttgggcttgtgacagtaagctggtgagtaaggcaagctatctctgaagggcattttttcactagcttgaaattaatggcttttgctagaaataaatgagaatgctggtctaagactttcaatgtgaagataagagttacttaaattgttagccagtgaattaacttgtgaattttcagtacttcaatgaaagaagacaattagacttttttttataactttgacacctcattgcattgtcttctacttgtttgacatattaaaattgtcttgtagaaatttataaacaaccaaaaaatagggaacacatcatttattttccaacttctgttatgttaacatagtgctgggcatagaagtaaacactgattcattaatccaaacagcatttactgaacatttactatattgctttagtgatacagcttcagttatagctctgttttttaagtggtgtaacacatttagtaattttaattttgcagaatgtagatcatcatcaaggaatagaataaagctgaaataggtggttgtcattttctatgataatgataaaaaatacagctgctactttaccttcttgtaacctggtgtaattacatggtatttttaagcattatgcaatttgagccttaggacaattatgcaaattaggtatggcagagggtggtagcccttactgtagatgagaaagctgaggtcaaggtacatgaagggctttgaccacagttatttgaagaaggaaatcttggactgttagagcccagattttctaactgattcaaacaacaggattcttgtattggactcctgaaagagtcctgcagaatgtttttatttatcatttattttagatgtaattttaataaattttatttggtttctaacctgtgagcaaatgaaaatgatccatttagaactacctgttagtggcagtcaaattgccagcagcagtgaatgatagacaacaacaaaggatgattgagaaaagctatgaagcagacataaatcaacaagcattgggatctggcaccacgttgccaacgggtggaaggccccttatgttttagtagcttccaagtagtcacttaagtataatatcatataattgccatagaaataattccttaagaaaaatttataggacgtttcattaaaaatgtttgcttgctgcatttacaaaattaacatattaacttaattcttcatgatcttagataagtgaagtattgttgtattaacctcttagaagtcttaagatttgtattttatactgggcaaattcctgtgtattttagtatggcagtcttttatcaattagttagttagtcaactttgatccgaattcactgacattaattactacagcttttgtttccggctgtcttaagtatcagagccactgtctctgatatggaaaaatatctagctctgactttgacaaaggccagagaggcagcacttgaagatactggtcagtagagggtgagttagggggtagtgcactcggaatgcccattgagacctaacagtctgaaggaggcagataagaacattctttaagggtaagaaaagctgaagctggtgatctcctttaggcagatttgatgctttaattttttttctttcctctctctttcctgggaagaagctgtcctctgttctcccttgggagttttatttttggcttgcttccctagctatcttcattacaacccacaatgtgagagtaacttcattttaaggggatttaatccataattaaatattgaaaatgagcaaacatatttagaagtgagtcctagacatttagtgatatgtttaattcccctatgaatagggagaaatactttgttgatatgtgttgaagtactttgctctcttaatgtataatcaatgtttaattattcatcattccccaggagtctctattcatttggcacctttgagccagactagtgtagtatgattaatatttatgatggtaatctcatattcctacaggatttccaaattaaggagagcttatactatttggta

SEQ ID NO: 72416 - DNA, 2341 bp, Homo sapiens
atatgctagtgtgcatagagtgggtggctgatctgggagctagtgaaccagtagtaacagatatgtcctgtcatgtgagggtgccgtgggagcccttagtaataactttctggagaaagtgacgtcataatcttgggagagggaatagaagttcagaggcctggaagtcaaaagagtgtggagtgaggaactgaaaggtcaatatgtctgcagttgtgcgtgtgtgtggaagggcagaagtcaaggagaggagcagccactggtggctataggtgggtctccaaactgggacacttttgagagtgaaataaagaacgactaataattatttggggcaacaggtgaattgaggctgtcccaggaaagctagaatggttcccactgcttataagccatgttaaggggtttgggtttattccaggggcacttggtggttgtatctttgtgggattccagaggctagattataaagtttgggattatgttttctgatccttatctttcagaaaagattgtgaaaagtcaattaagtttctgtgcccttgtggtcaaatgggcttggtaaaatgcctccacttgggatgggtgcttctgtcatcacatggaggaacagaacctagatatgaacattttgaatgtttgtgtgtgtgtgttttacaattttatgtttccataatgatgtatctcggatagctagtatgttgccttttcacattaaagggaaatgggatttaggattagattagtagttgtagacgtaggttagatcagaatttatctccagactagtggaatcttaatcttagtgatttttttccctacaaatatttaacagggagctgacttacatctgttgaacacttcctggagcaaataacacttgtatagtgcttagtatgtactgggcacagttctaggaacatttaacccttataataacactagtagtgttattctcattttacagattgaaaaccaaggccctgaatgctaactgtcttgcccagggtcatacagcccgtccacaatggagcctgggtttgaacccaggcctcctggctttggagtctgtacataaccctttggctcttctactctcacatgtaagcaatgttattagtagcttcaggcatagagagaagtttgggagtattcttgtattagatttaggtaaatttttcacaatgatttttatgttttacagccttcaaaagtatgttcgggaacagattctactagcagtagcagtaattgtaaaaagaggatcattagataaatcaattgactgcaaaagcatttttcatgaagtcagccagttgattagtagtggcaatcccactgtggtaagtgtgctatttgtatttataaatattaacaatttatattttctgttacacaaatagcattatagcaagagtaatggatatctacataaaaatagtgaaaaagctatcagtcaagcaattttcatttgttcaggttttcttctagtctttttttttttttttcccttgtgacaagagttttgctcttgttgcccaggctggagtgcaatggcatgatcttggctcaccgcaacctctgccttccgggttcaagcaattctcttgcctcagcctcccaagtagctgggattacaggcatgtgccaccacacctggctaattttgtatttttagtagagacagggtttcttcatgttggtcaggctcgtctcaaactcccgacctcaggtgatccgcctgcttctgcctcccgaagtgctggtattacaggtgtgagccactgcgcctggcctagtctttttaaatatatatgtacataatataaatgcagtgtactttgctttttcgtttgattctgtattttccatgttgccataaatattcataatcattattttaattgttataaaatattataagttaatatgccataatattgttagccgtttctattgaactttgttttgccatttctaataaacctttgacagctactagtgaatacagaagtgtttgaataaagtagaaaatatctgacatgaaaataattaaaagttgctgtcctaataggccatgggacttcaggagttactgtcaactgaacaaattaggggttattgttcttggctgaattagtttgggaagcatggttctcccaccctctccactctcctgtccaccttttagagagctggagttgtgcctggagagtggctgtttggttgtaatcactctgtctgaggcaggaggagttgcggttgctattaatgattagctgtgattctttgtttaacctatcaacttttatcacctgaatgatatttaactcatatagaa

SEQ ID NO: 72417 - DNA, 1655 bp, Homo sapiens
ttctaataggttcacatttttagaagctattcctttattttaattatttattatattttaaagtttctaaatttgtatcaattctgattatcatctcaattagagttcatgttaagatagcatagaataatcaaaactttaaaaaaaggttcaaattggtttctcttagtggttttggtatgatcaaaactcctgtgtagtagtctaatacgataggaatttatatagggtacaccttttctcatacatttttatagctaaatgtgtcaagaacacttgtaagatttttaaatgacctgagcttgaataggagagaaaatggtgtgcttgactgtatatatcttcatgctcttctgatatattcttgaaggtgccagtctatgcctagagataatttctcatggctttcagatatgcatgtccagtgatcttggcaaataatctggagtctaatcatgagcttttcatggatttcacatgatggttattttttagagcctcagaaaatttctgctttttcttgacttcatttcaactgtttctccctgttgataatgctgtttgggaaactgattgtagtggtattggtgaataaaggaaaaaatagaaaattaatataaaacatttttaaagtgtgttaattttctattttttctcccctgatttagattttagatcagatactataacttgctagctaaggctgggtctttctaagtgtagctttgggattttactcagtttgatcagtactgcaatcagaaaattcacaagcacttctcaccttgtgtaaatgtgacttatattgttttttatattttgagaaagaaaacctaaacatgattgtttttatttctgaacttgctattggagatgggtcatcctgctgaaagcttaatacttaaaaatgaaatattttaacagcatggctcatcacaggtagtaatgttcaatgactagtttattaaaatgtttttcagatacaaagttctgttttgcacagggtgagaatcttaggaaattttctgattgctttatatttttatttttattttttttaaagctgtgttattttttagttcttcatgctttggaagtaacagttgaagagaggtgaggaaagtttgtgaaaattgtgatcggtgattagctgccacctgcctgaggtgtcttctgagaggaactaacctctttgtggtgctagagcaaggtcactggataaaaaaaagaacaggtaaccatcttattccttgtctgaaaagttctgttttaaaattaataaatgcaaaatgtgcaaggtaaaatgaattattgtttaaataaagtttttaattttctcctcagaaactagtaaagtggactatgtcctctttcaagctgccacagccataatggaagcagttgtccgagagtggattctcttggaaaaaggtagcatcgagtctctgcgaacattccttttaacctatgtcttacaaaggcccaagtaagtacatggagggggactgctgaaatacttttgctgagcttatgtgtatctttttagagctttttttgtttgcattttaaaaacttttgggtgggtatagtggctcacacctataatctccactttgggaggctgagagggaggatctccttgagcccaggagttt

SEQ ID NO: 72418 - DNA, 1119 bp, Homo sapiens
aattgtttcgtgaggtgaaaatgtaattacttttcattatgtaaaagcactttgtgaacagtgaggtaaatgtcatggccatatacttgattttaaacagcttttaaaaaatgtaatcggctttaaaaatgctgtgttctgtgtttgcaaggaactagcagcagtggtgaaggtggctctgtctcatttaggagttaggtcttagcagaggaacaggttcaacaactaccttttaaattctcactgaagccattttaattaatttacttatttcagtggtcagcttttatagttgtgtggattcgtttctggcactaagaagatttaacatatacctgtggaggatatttaactcaatgttaaaggaagcaaaactaaacggcataaagagtttaaggaagcattaattcatccttactgccttgaaattgttcagcattaatagatttagaaaaccgttgtgttaaactattaacctaaaataatttgagtctggttttcatggcatatgccttaacgacattgactaggattccatcagtgtttcatctgactttctattggaattcagtgtcattgtacactagttgggaaatagttgatctaacttacaagtattttattagagtgtatttgtttataccattctttcctttttagaatatgtatattttatgaagtattgttgctttgttatgattgagcttgttttggaatacttttgttttcctgataaaattttctaaagagtagtattgctagttctggccatgcttttaaaatgagtttgggttttgagacactgactatttaaaaggtggagtgcatgtattacaagcataatcattaatgtactgcaaagccctgtgttacattaatgtttacatctaaacttcacagaaaatcttttcactccttattcagttgccaccagcacagaagggtaaattcctctaagaagacttctcatacaagtggcagtcaatcgcagttcagaattttcacattcttgtttagggattatgtgtcatttttatagaaggtctgggtaatatattctactaaaggggagactttctttgatgcttcccttttctggcctcttaaaattcttccttc

SEQ ID NO: 72419 - DNA, 1010 bp, Homo sapiens
gtctttaactctcaaggcaccaccttccatggtcaataatgaacaacgccagcatgcagagcacatattcttatcatttaggaaatcaaaatcaccatttgcagtttgcaagcatattttgggtaagtattcacttaaaaaatataaaatattttggcataatcagatctgggtttgctgtcttaaacattagctattttaaattcctttttaaaaacctggtttgtgtagttacaattatttaaattaataatcattctactggagtagctttaaagatattctgtaaagccagacgggaaactttgtttttactttggatttttcccccctagatatagtgttcataatttgttttattattgaccataacatgaaggctgttaatagtaaagagaaaaatttagtattttttcagttttcaaatgtcatttattacagggtatgtactatagtatcttttagcccagtcttagttttaaaattgagattgtttttggagatttctacattttcttttagttgttttccatagttttttttttttttaaccatttagtttgtactcagcttgcttaatgaatatcagtcatttctgcgtagggtatcactgtatgtatcctaaaataaagcactgatttttacttttgtcaaatatgttttatgagtatcttatgtctgacatgtacagaaaagatttcttctaaaagaatcacaagaaatataactcttatccaaagatggcattttctaagagttatatatgatgtgccatctgtcccttagatatttttcaataatagtaagagagacttcattggttattgttattttataagctgattactgctggctgatttttttagtgggagccatcttttgtaaggctctagtaggctacttgagtcatctgtgaccataaaattggttagttgagtattaggaactagaacatctgacttttattcttgtgcttttagtaaggcttatctatagctaccaataggctg

SEQ ID NO: 72420 - DNA, 1591 bp, Homo sapiens
ctggagtgagctttgattgcaccactgtacttcagcctgggtgacagagcaagaccctgtctctaaaaaataaattataaattaaaacaaaaaaatagccaggcaccatggctcacacctgtaatcccagcagtttgggaggctgaggcaggcagattgcttgagctcaggagttccagaccatcctgggcaacatggcgaaaccccatctctactaaaaaatacagaaaattagctgggtgtggtggtaacgcacctgtagtcccaactactctggaggctgaagtgggagaatcacctgagcctgggaagtcaaggctgcagtgagctgttttcacaccactgcactccagcctgtgcaacaagagtgagaccctgtctcaaaaaaaaaaaaaaaaagttaattaattagttagttaattttttaaaagatgggcatatttgtccagattatacatagcagacagcaaagtagaaccagttatcaattatctactgttgtgtaaccaaccatcttagaccatcccagaatttttagtgacttaaaaataatggctttttggccgggcgcagtggctcacacgtgtaatcccagcactttaggaggccaaggtgggcggatcttgaggtcaggagatcgagaccatcttagctaacatggtgaaaccccgtctctactaaaaatacaaaaaattagccaggcatggtggtgggcacctgtggtcccagctactcaggaggctgaggcaggagaatggcgtgaacccaggaggcggagcttgcagtgagccgagatagtgccactgcactccagcctgggcgacagagcgagactccgcctcaaaaaaaaatggatttttaaaatttgttattattttattattactatttttttgagacggagtctcactctgtcgcccaggctggagtgcaggggcgctgtctcggctcaccgcaacctccatctgccaggttcaagcaattcttctgccttagcctctggagtaactgggactacaggcacatgccagtgaaataatggcttattatttcttatggctctgtgggttggctgtgctcagctgggcagttcttctgctccagtggtatctgctggggttccatgtagctcattccactgggaactcagctggggctgaatacccaagagggcttcactcatgggttagaactgcaacacagttaactggatctgtctccaaccatggtgcgatctgaggactgaaaatggaagtagccagccttcttgagggtgaggctcagaactggcacagcagcacttctgctcattccattgatagagaaaatcacaggccagccaatattcaaggggaggggaagtagattccgcttcacactgggggctgcagcccgtacatacagggatgggagaaattttttagtgcccattttttggtagcactgttacacatgaatagaaatataggatccaggacccctgaaaccatgccatgtgtgtgtactaatagggaactttgagtatattaagtttctgtggaatgtgcttacctctgttcacctatctccattgtgacaaaagtcttatttt

SEQ ID NO: 72421 - DNA, 1043 bp, Homo sapiens
tgagtgccagcagtgccaggccatgtgttggaccccagggatacggcggtgagcgcactaggcctggcctgccctcccggagctcacagttgaggctcatcaacctgccaacaaacatgctgtcagtacctcctttcaaaactaacgtgtcataaagcagacaagatcttagaatagtttaaatcatcccagctggaaaaagaaggttgcatggtatttgtgagttttgagaaaggagtttccatttggttgaatctgtaaacttaaaccactcaacaaacattcttttttaaaaaggtatcatatttcttctttccttgaccctgtgatgtttatttttgttgctcacattggactttcaggctgatggcagcagtgctggctgcataaacagatttttccacttcagtgaaatcagcagagcttgtttcagttgctgcatggatggtcagcgtcgttccttctcatgtcctcctagcatccatcctcagcattgccataaaaccttcctggtgtgtagttttctaaaaaaatattatctagcatatacatttcactcagaaatacttcctttatggcagttccttagccaaggccgtgctttattcatacttcaggatcagctaagccaaaccacggtggcagtgaggagtgggtcctttggtttgttgaccctggttgtcagggctgtctttggctcatgtgtctctgtattgagatgtggtttagcctgagagagtggccggctgcaatgctaattgtcctccctggtttgctggcatctgtgggagaacaagaagaaaaggccttgggtttgggagagccctgtcatccatctggagtgacctgggagtgacctgcgcgcctttccccctgcccccgactcatattaccctgttcttgttctttttaaaaatacttttatctgtttttcctacattctttggcattttaatctccctcccttcctttcctccttccttccttccctctctttgtttctctctccttcttcctcctcctcctcttcctcctcttctctt

SEQ ID NO: 72422 - DNA, 1037 bp, Homo sapiens
ttaccagcattacctcatgtaaccacaactgagatacagtgactatagttgctatttataggtgacaatgaggcccagattgaggggctactttaacagctcaaaaatggggcattggacctaggtagccaaaaatagaggattagttgaaacatttccagaaataatgttctttcatactcagtttcttatagtctggcatccacccacactacactgacacactattcttgtagtgatgttattccctacaagtagcaatttttgcctggttatctaaagtagacctcttcagtttttaaactcaaaatgcctctcaaaaaaaaaatatgacatggtcatagtttccactttgaatgtgttaagagcagccagatgtctgcctgttctggtttgtcttctattacttaaatataggttgcttttgcaaataactaatttcctggagtctgcaatggcacaagcttgaaggaagttatgtttattctgttagaaaggattaatcatgactaggcaactattctgtgaagacaaaatcacggattctcccccttaagaaatccttaggggaaataagctaaacataaaagtaattttaatactaaagagtagttgcaataagcaaaaaagtccttagcctgggaatgttaatgcagactattataggaaggtgtaatgatatccctacctcataaaacttggggaggagtcagtgaaattaggggagagcctggtgggcagtgaatattctgtaaaggtaagctattttaaagagaaagaaggtatttctagcctcttcaatttgtgccttcagctgtttagaatttcctgctctacccatggtaccatgtcaacccagttacaactaactcatgagaaaatttaaccaggatttggccgggtgcagtggctcacacatgtaatctcagcactttgggaggctgaggttggcagctgacctgaggagttcaaaaccagcctgggcaacacggtgaaaccccatctctactaaaaatacaaaaattagccaggcatgg

SEQ ID NO: 72423 - DNA, 1625 bp, Homo sapiens
ttgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgagagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcatactgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaacttgagtttgtccttgttctaggagttactgggtagttgtaagtattatttttattaaatataatgtaaaataaaatgttaagatacttagttttgtttttcaaagtaaagctgtagtcagccttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactgactgttgggtttggcaaagtcgatgttattgacaacattgattaattttgatggagtgctggtactagaagtctgtagtggatggaagagaaaacagctgaggaggtaaaacagtggctttagacagctcttgaggagttttgctaaagaagggaggcgagagaaggtgtagtagctagaagaggttatgtagtgaagaggttttttaaagatgagtgtattagtctgttctcacgctgctaataaagacatacccaagactgggtaatttataaaggaaagaggtttaatggactcacagttccacatggctggggaggcctcacaatcatggcagaaggcagagggggaagaaagacacgtcttacatggtggcaggcaagagggtatgtgcagggaaactcccctttataaaaccatcagatctcgtgagacttattca

SEQ ID NO: 72424 - DNA, 1064 bp, Homo sapiens
tcggcctcccaaagtgctgggattacaggcgtgagccaccgcgcccggcccacgtgtggaattcttaatagccattctagaagtcttcctgacttatggagacccatgagaaggataaatcacttcggaaaatactcagatgccattagaactgactcatgctaggatatcaataaagtacttgttatccttttttctctgtcttttctgcttttctggaagatataataaattgcatgaagaaggagcatcttctgtctttatgaaaattatatagtttccacttccctatggttgcttcatctctccttatttctttgtaaaaggaaggaagccttatatttactatatcacccctttatgcatgaaaaaattatagctgatacttcatgttctcctttcataatttttataattgatgaccttccttttgagcattcgttttacatctttcctttgtgtattttccctaacatctttgttaaggcttaatttcctctcagggatatattgctacttgttttcactaacctcagtcagaatacattttaagctttaaaaatcagtccttcacatccaagttaaatttctaatatctccatcttttcattgcagttagcatgtcttttttttttttttttttagaccaagtctcgctctgtctcctaggctggagtgcagtgacatgatctcagctcactgcaacctccgcctctggggttcaagtaattcttgggcctcagcctcctgagtagctgggattacaggtgtgtgccaccactcctagctagtttttgtatgtttagtagagacgaggttttacctgttgtccagcctggtctcaaactcctgacctcaagtgatccacctgccttggcctcccaaagtgctggaactgcaggcgtgagccaccatgcccgccccatagcttttattgaacattttgtaacttcttccaaatttaggttatattattcatatggctcgataaaaaggaatttccttttttttttttagcttttatcaaaatacaactcaaacctagctactccaatagcaattaa

SEQ ID NO: 72425 - DNA, 1008 bp, Homo sapiens
ttacaacacaactatttgttattgtgtattactcttgcatccttgctgaattttagtagtgctaatgataattacatatgtaaatatgagattttcttcctgtccagttaagcatactatagttatagttttttaatgaccattttatgtgtcttttagatgccgaatataccaactctcctttggtacctacattctgtactcctggtttgaaaattccatctacaaagaacagcatagctttggtaactttccataaaattgaaagccacagtctttctcctaaagactcaaatacactactgcttgcaggctcaaagagtctgtttagaagacatggatgaatccagcttttagggatgtatttacagtgcatttctggagggtagcttggcagcataaatcaattgctctaaaaaatatttttcatacctttaaaccatatctctgaattttttctaaggcaaattgggacaaagatttaaacaagttatagagtaaggaacagcattatttataagcacaaaacatgggaaacagtataaatatcgaatgatatcaaagaactaaaacacagcaaggcatatccataagatcaggtgttacatatactatcatgttttgaaaaacagatgagagcatataaaaagaatgttttcaagaaatattaatcatatggaaaatgatgtgtgtgtatgtacacacacacatatatatacacatattttaaggaaaaagtggatagaaacagcagtgtagttatctctgggtgataaattatgggtgattttgtgcttttttcccctaaattttaccaacaaataaatttaatcagatttcatcaaatcaaaaccttatccctctttagtcagtatggtcacttaaccaatgctatagaaaaccaatactgtattagggtatccaatagaattttctataatgatggaaatgttttatagtctgcactgtccaatatggtagcctctaatcacgttattgagcactgaa

SEQ ID NO: 72426 - DNA, 1867 bp, Homo sapiens
ctaggcaacatggtgaaaccctgtctctaccaaaaatacaaaaaattagctgggcatggtggtgcgtgcctatagtcccagctttggaggttgaggctgcagtgagccgagattgccactgcactccagcctgggggacaaagtgagaccctgactcaaaaaataaaaataaaaaaaaaaaggaacaaagttgttgtgcctgcaggttgtttgtgattagccttttctcagaacagttgttcattgttcgccccaacctggggccttcccccattgttgcctacttatctgtgattgtgccactgcactccagcctgggcaacagtcaaagctacagaaaatatattctgatgctcactgaagtctgagaaagaaaaaaaaaaaagaaagaaaaaatattatgaaaaactagtaaatcacattaaggatgtaagaaaattggacttttatttgtgaatattaatttttcatcttataacacttttaacttgctttccttctctaatgtataatcacaatgagatatgggtgcacaagagatacatgtcagaactttattaaagggacaattgaaataacatttcagctgagtgtggtggctcatgcctgaaatcccatcactttggggggccaaggcaggaggatcatttgagcccaggagtttgacaccagcctgggcaacatgatgagaccccactctacaaaaaaaaatttttaaaattagctgagcatggtggcacacctgtagtcccagctaccccaggggctgagatgggacgatcacttgagcccaggaggtcgaggctgcagtgagctgtgatcacacctctgtactccagcctgggtggcagagcgagaccctgtctcaataaatactaaataaataaaatgtttagacaattggaacttttgctgatttgggaaatttcagataagctgttttctgttgtttttgtaaacgtgaaattttccattttgagtttgaccagaatattctgatttttcctcctagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaaggtaagcagctctgttaaaaggcatattttatctagctttctaaaccttttgtatttattgattttttttccagaagaaataaaatgtttcagacatttttgctttaaaaagttttcagatatttatttatttattttatttcaataggttttaggggaacagatggtgtttggttacatcaataagtttttttttggtttttttttttgtttttttttttcgagacggaggcttgctctgtcacccaggctggagtgcagtggtgcgatctcagctcactgcaaactccgcctcctgggttcacgccattctcctgcctcaccctcccgagtagctgggaatacaggcgccagccaccacgcctggctaatttttttgtatttttagtacagacggggtttcaccatgttagccaggatggtcctgatctcctgacctcatga

SEQ ID NO: 72427 - DNA, 1031 bp, Homo sapiens
cggccgggaatgcggccgcgccagaggagcgcagtcaggaacatggtgcctgcggaagagagggacgggctttgcggaggcgaactggcgcggccggacctggagagagcagcgggcgcgcgctccagctcacgcctacgggagttcccgcaccgcctcccctccagagaagcggggagcccaggtaaggccagcaggcgaagaaggagctccctagagaaccgaattcgcacagctactcacctgccgcgctgctcaagactctgcgtctccgcggccgccagcagacgccgtggcgtaagcgcacccgtctcgcggggtctcctggggcctcggcgagagacttcggctctcgcgagagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggtgcgtgaggcgggcggccagggcacggtgcgtggggtgcgccgcgggcggaggggcgtggcgagtggacggtatgtcccacgggaaccgccaggcactgacggcgtggacggctgccaccgaggcgcagggcgggtgctgcgcgtctcactgctcggcgtttggcgttagcgtagctcccgggcctgtttatggtttattcctaggaacccttgtcgcgtgtccgttttagacccatgtacaaccccacggctctcttgagataatgaaagtagcactattacgttataaacagagacagcagcacttaagaataagaacctaaattaacagattgagctcataatacatatactaatttatacgtgatatgctttcgtcacatacaatatgtgtgcttgtcagtaaaataccatgtaaacctaaacagtttctcttagaatca

SEQ ID NO: 72428 - DNA, 1572 bp, Homo sapiens
ccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttgaagtgttttctttgttataaagtggtatttaccaaatgagagagtaacttatgtttatcaacttgaaaatctggtaaaatagtgcttggttagagaaagagattggctaatagtttggggaaaccacttttaagataggtattattttagtgcaacaaaattgttgtttacttaggtttattcaaaacctaaagagtttaacttagctttttactgaacataatttaatttcagaagtcatttaggatcttgagaaccttcagatcactgtaagttgttgaattgtgattgttaaaatgctgaataattaatagattttattatgtagaattattttatggcatctgtgttccagtgcccttccaaagaggccaagtttgttattaaagccatttaaagatttcctgtagctat

SEQ ID NO: 72429 - DNA, 1043 bp, Homo sapiens
aaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctgccttccaggttcaatagagtctcctgcctcagcctcccaagtagctgggattacaggctcatgccaccatgcccggctaattttcacatttttagaagagacgaggtttcaccatgttgaccaggctgatcactaactcctgacctcaaataatccacccacctcagcttcccaaagtgctgggattacaggcgtgagccaccacgccccgccccggtaaattttttggagtaccttctgtatgctaaataataaactaggaatagctctgtcatttcctagtacagcataaattttatggttgctactgtaggtttataatttgtttataatttggcctaatttccatcagccatactaatattggattttaaaaggaggcaactttttttctttttgaaccaaaggaatgagttagctttgaaaacataatttgggatattatagtatggattcttctacctttgtttcaactccttagtaatcttgattctagcaaactagaatgagatttaagagataccaattattgctgggtgtggtggctcatgcctgtaatcccagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtagtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaacta

SEQ ID NO: 72430 - DNA, 1039 bp, Homo sapiens
gagaatcgcttgaacccgggaggcggaggttgcagtgagccgagatcacaccactgcactccagcctgggtgacagagtgagactccatctcggggaagaaaggaaaaaaaggctgggcacggtggctcatgcctgtaatcccagcactttgggaggccgaggcaggcggatcacgaggtcacgagatcgagaccatcctggctaacatggtgaaaccccgtctctactgaaaatacaaaaaattagacgggcgaggtggtgggcgcctgtagtcccagctactcgggaggctgaggcaggggaatggcgtgaaccccgggggttggagcccgcagtgagccaagattgcaccactgcaccccagcctgggcgacagcgagattccatctcaaaaaaaaagaaaaaagaaaaaaaagagcacactgaatatattttaaccttttctaggtgactcttaatcatttatgaattgaggattaaggtatagaatagtcagtaaaattgaagtgggaattttcatcagacctgggtttaaaatattgtctggctacttaactagcattacagtctaaaacacatctgttttttaatgataatagtaataacactgattatttccttgcactatagaaaagtggttttgggtcaggcacagtggctcacacctgtaatcccagcacttccggaggctgaggcaggaggatcacttgagctcaggagtttgagaccagcctgggccatatagcctatctctacgaaaaactttgggaaaaaaattttctaggcctgatagcatgtgtctgtagtcccagctattcaggaggctgaggtgagaggattgcttgagcctgggatattgaagctacagtgagctatgatcatgccactgcacttcaccctggatgacagagcaagaccctgtctcaaaaaaaaaaaggaaaaagaaaaatgattctggacatttagctccatttgtactaactagcaaataccctaaatacccttaaagacctactgttcgaatttctgaggtttttt

SEQ ID NO: 72431 - DNA, 1084 bp, Homo sapiens
ccctccctggatcttttagctagaaaaataagtctacgctaaatcactgaatcattttttccccttagatctaaactgcagaggtagaaagcagaaaacttggcaaatgacaggtaattgttttgtactggccacagatatagatcctcacctgtccttgtactacctatggctcctgattaacatattaagaacatttcagactggcctctgaagctttttaaattttgactaattgttttcattggcagtgttggaatacagattcttgggtctagagagccatttaatggggggttgtgggcctatttttattttgaagatagttttttcagagtgctaagatctcatgagttgccctcacatatttaggagaaggaatactaatttgctgcttattaatttattaagtatccatagttgagcattaagctgtttactaagttgtttgctcttcttttcagtagtggctcaaatcaaccttttcctatcaaaccacttagtgaatcaaaaaaccgcttgttggacagtgaatctcagtggctggagaatggagctgaagaaggcatcgtcaaatcaggtaatagttctcatttgaaacactgctttgtctggttcaaatgaaaagcaccagatataatacatgtggaaaaatcaaaataatgtaacattttaaaaatactaaaatatgtgaaacttttaaatatatgctgggcgcggtggctcacgcctgtaatcccaacactttgggatgccgaggcgggtggatcacaaagtcaggagaatgagaccatcctggctaacacggtgaaaccccgtctctactacaaatataaaaaattagccgggcgtggtggcgggcgcctgtattcccagctactcaggagactgaggcaagagaatggcttgaacccgggaggcggagcttgcagtgagctgagatcgcgccactgcactccagcctgggtgacagagcgagactccatctcaaaaaataataataataaaaaataaataaataaataaaatatatatagggtgtttgtgtttcttagtagcttctatgaggaagggatagagcgag

SEQ ID NO: 72432 - DNA, 1060 bp, Homo sapiens
aacatggtgaaacccggtctctactaaaaatacaaaaattaactgggtgtggtggcgcacacctgtagtcccagctactcgggaggctgaggcacaagaatcgcttgaacctgggagacagaggttgcagtgagctgagatggtgccaacacattgcagcctgggcaacagagcaagactgtctctcaaaaacaaaacaaaaaattttagatgttgctaaatgttatgcttctgggttgcatttttctaataagaaattgtgataactcttatttttgttagtctatatatgttttttctatggctacttttaagactatcactacttcatgcaatttgattatggtatatcttgatctagttttctagtttcttgtgcttggtattagttgagctttttggatctctggttttagagctttaatcaaatttggaaaatattgttaaccattattttgtcatctccttccccctattactgtgaggactccaattacacatgttatcagtcactcacagtcctcccacagctcactgatgcactgttcattttttgtcttttttctgtgtttcattttgtatagatcctattgctgtatcttcaagttcatcgatctcttttgtatactttatccattgtctcatgtattcaagattgtccccctcccattggttggaacacagattacttgttttgaagttatttcctctaaacagaaattttgaagttattttctgtaaacagtgaattctaagtcgataggattttgttgttgttttttgttttccttcctttaaagatgttccattatcttctggtctgcattgtttctaatgaaaagtcagcctgactcccatctttatttcattgtttgtaaattactatcctttcccctcctgtagctacttttaagagtttatccttatcattgattttaagtggtttgatgaggttccttggtgtttatcctccctggggttcattaggcttctcggatctgtaagttcttagttttcatcagatttgaataattttcatcagttacgtctttattttttt

SEQ ID NO: 72433 - DNA, 1045 bp, Homo sapiens
cataaggtttgctatagctacagatttaagatgttaggcctcatggagggccttagctctgtttggcagtaatgtcacatgtttctggtcaggtccctcacctgttacccaagatggttattccagattttcataattctcccactctccttacccattttatgagttcctagtagaaaaattagaaggagtcacaagtaaactctcatcttcacatctttatagcctcatacaaacatttcttgtttcacacccatcactctcaccttcctctaacttctgaggaagaaagatgtcttttctggtattcaaggttaacctttacaacttttctagactccttcccatctcttctaggatccctttcttcagtttttattttacttttttatatcagcaatccctcccaatgccctgggttcttatccttagcttataaaacacactgaagtgccttgtttttaaattaaaaaacattttttgtgaagcctgtatctttctccagacctcactctacatcacttaacaaccaagcttgaaataatggtctagtcatcctcagcttgctcacctttccctacaagcacccccgaggcacacatatgtctctatcgagacaaaattagcttccttcacctctgtgctcccagtacgtcatggccatgttagcacttataacactgtaatttttgctagactctaggttctttggtaggaattttatctaatttatctttgaatcccaaatacctggtacagtgctatcaggaacatagtaggaaattcataaataatgagtgaagttgcaggagttagaatatcttgtagaaaaaaaaagccaagagatactgagcacacaatactagattttcagtaatatttgataattattttgacatgttactttataaggttgatgaaatattaaatgtgctattttttcccaaaataagtttcataaatttatcttttaattgctactaatgtattatttattttaaattatatttacagtttttgtgtcaaagatataagcaagaaaatt

SEQ ID NO: 72434 - DNA, 1642 bp, Homo sapiens
tcacaaaatggtcagaagactcacttgatatgtttgaaacatttgaaacatgttggttactctggaagaaaagagaaaaagatcaatgtcacaataacctaatgctaatagtcttcttttagtctgtaatactttttaaatcaagcagaacagcctcgtgttctggtggagtagatgctttgcctatatggtttattttaagagctaacatttaaaggctgcctccttctattaaaggtactaatttcttctaggctctagtttgcttctgttaaaatgtatatagccataagaagggataccagagaagctgttttcattcattaatacctgtggtaaatttatttatcaaaattgctaactatgcacaaaggctctgtagacatacagatgaaaaaagtaggaattgaagcagctgaaggcatgggtaaggtggtctgaaaatagagattaaagaagtccaaaaatatttcacaattagtttttagttagcagcaaatctaaataaaataagcaaatatttttgtatagatatggggagcttatatatgtcggatgttggagaaagcttgaatatatacataaagtacaaaagaaaatttgttgggtagaagagtcgatcttttcactttattactggaagtattgctattgttttttttttttttttatgagacagggtctcactgtgttgcccaggatggcctagaactcctaggctcagtgaccctcttgtctcagtctccccaatagctgggattacaggtatgcaccaccatgccaagctaaaattaaaaaaaatttaagagcagtattttaaataactcttcctgaactcctagataagcaggttgctttggtaataccaattctttgcttttgcccttgttgcattgggatatattaagtaatttattagttttcaaatatggcaagtattttgatatattcaacaatctttagacagaactaacttgtaagttatattttagaggttgacctcaaaattaacttctttttttcctcagaatgaactgacagatacacgtgcaaaattccacgtactttttcttttctttgtgtctgcaatgttcttcatcagcgtcctctcacttttcagctaccactgctggctagttggaaaaaatagaacaacaataggtaagtaggttaaaataaattataattacttaggacaatgaccataaataaatatgaaatctagagaagaacaagggtcagatgatacagaagtgtaagacaattctgactctggaattggtggcacgtgcctaataatcccagctactgcagagacagaggcgggagaatcccctgagccctggaggacaccctagacaacatagggagacccagtctctaaaaaataaaaataataaaataattctgtagtaaaattaattgtgactggatgggaacaatggttttataataaaggttcattattttggagaaggttgaggaaatgagattgactttttaacacattttcagtaatgtgttatatataaaagtggagaactattttataaattttaataaatgaaaactttcctgcattcatacagtgtcgtttcaaaaattaatctataagaggcagggcacagtggctcacacctgt

SEQ ID NO: 72435 - DNA, 1020 bp, Homo sapiens
atgaattttggcttttgatttcccccttagctgggcacctttgttcagttcacaacatactaaccataccccttatttaaacagatttagtgccagatagatgaaatctaaattacctaatttcacatttctctatcagaaaattcagcaatgtttgtgtgcaatgatttattaaagaatgaataacttttttggattaattctgagtaaaaaaagacttgtaaacgtaaatatacctttttcttcattcaataaatatgtatttagtacttactgtatggcaggtagtactctagagacttgtagtatatctctgaaaaaacgggcagagttctctctttgtagagcttgcttttgagaaggagggggacaagtaataaataatgagcagggtaagagatttaagtattgggcggtggcatgatagggcaggtggcaatattgaatagcacagtcagggtagaccttatttagaaggtaggatttaagcaaaaacttgaagggaattaatggatatctgagagaagagcattcaggcccagagaacatgatacgtgtccctgccatgtttcagtaacacaagaaggctactgtggctggggtagaatgagcagaaaggagactgaaaggaatggaccaagagggggccaaaatgacagagggccttggagagtattgaaatgactgtggcttttactagcagccaggttgggacatgatctgatttgtgcaaggctcactctgattgctgagctgagaatagatgggagagggcaagtgccaatacacaggctgacatggtaggctgttgcagcatcccggctggaataaggtagaagcagtgaaggtggttagaagtcatcagatctagtttttggaaactagtcagaggtttgtttgtttgttttcaatattggctaaaaacattttattttattcttccccagactgaaatgtgtctgcaggcccagcgcaggtggctcacgcctgtagtccagcactttgggaggccaaggcggg

SEQ ID NO: 72436 - DNA, 1071 bp, Homo sapiens
tttatttaatagttttcagtaatgagttaccttcttaatagaaattacaacagattcaaggatgttaacatactggcattcacctacattccaaaccctttcttgtgtgccaggcccaggggtagatttgcagctgcattcaaggattgcacgtctacagagtggtctgcaatctagctgcaccctgggatgcagcacccttcctgttgtttcagaggtgggagctgcagacctctgcccagagcatccaatcgccactatcaagacttcatcattcaccttggcatgtgcccttcaatccagcgtttgtagctctcactagagctccactcgtgtatttgcagcttccaaaggatagctgtacttgaatggcctattatgcaaagcttcaagctcctacaatactggattcatcatttaaaacctaatatcttgggggaggggccaaaagtctgcctcgttcacttctatatttcctgcatctagcagtatttgtcacgtggtagaaactctaaatatttgttaatgaaaaacactaccctcacacaaactcagctctatttctatccttggcaccgtcattcttctagctaccctagaaactcagatttcctttgattgctactttttgagttcattctgctcagtcatcaagcctccttttcttacaaggtctgtttggtttaatcccatctcagagcctaggtaatttcacagcctttgcaatgtcagaatgttgagtggagaagggtaggggaaagagaaaagaagatactcattcctgatgttaccactcgcttagccatacaaccttcaacagatgactttctaacctttggggtgtctttgatctgtaaaatggagagattgaactaggaaatctctaaggtcctttatagctctactttttctacattatatggttttacctccctagtgcctaacccaggcaaggtgttatagaaggccctcaataaaatataacatactcggtcaatcggggcaagatggccaaataggaacagctccagtctgcagctcccagtgagaccaacgcagaaggcaggtgat

SEQ ID NO: 72437 - DNA, 1051 bp, Homo sapiens
cttggccttcatgagacatttggctagaaattagcgggaccccatgactgtgatttagcctttcacccaaagcaagtaaatctttggacattcttgcaaaaattaaaaatctcttgacagtaacttttaaacaactaaaatttttactaatggagactatatattaagcctttcctgtgtagaaatttaattttatttgtgaaaaacgaagatggaaaaatatttagttcatattctttgccatctggtgtggagggcaaatattttttaatatgccaaaggtatacagtttttgttaaaatgtacttgatttatctgcttttttttgaagacaagttttgtcttcataaaatagtttttggttttcttttttctagataaaactttttctgagcatgataattaacatcatgggattaaaaaaatttaatagtcctctttccttttatagttctacttgtccaattctgaaaaggaacgttatgaaaaagaattcagccaagaaagacaacaagaaattttgagaagagcagcaagagctttacctatctataccacatcagcttcaaaaagtaagaaaaagaataagttttccttttcaaatgatttttaaagtatgcttattcctgccaggatatatttgcatggtttgactattaaatggatactatgattgccataaataatatctgtagcaacaagactttcctgtttccttactgtatttcagatgcagaaatagatatataaaaataataatcaatataaattgtttaaggggcccgctttaatatgaatctcttctgtacttgtttttttcccccaactcaactttcatggctaaaaattttaattattattcttagtaaactgtcatttggaagtctgaatttgagtattatgtgtcatcactgagtaattaaaaaaaaatccaaaagtgtgctaagaatggggaacagtaagagacacaaataggaagaaacttgttcagatgtataaggctaatattctgagagtcaggctgtgaactcaggtttgtctagttccaaag

SEQ ID NO: 72438 - DNA, 1060 bp, Homo sapiens
tgttatttgtttttatttaccaggaaagaccgttgtttaccttgtggctttccatctgttctttgttatgtttgtatggtcctattggatgacaattttcacatctcccgcttccccctccaaagaggtaaatttaatgttggtaaattaccaaatgttttaactgattatggaattttttttcccttgtgttacctttgttaaaactttacataatgcatgtgttctgtttccattcataaaactgcttggttgctctgtactgtgaatgtgagtcatcagcctattctcagatacagtccactgacacagcatagtaaaagttcagcggtatagaaatgcttactatttttctgccatgctatgtgtctttaaagacatactttatattactggaataaaaagtctcaaggaacagaattgcgttaggaaagtagagtttatttttagaaactctcaacatttatattttctcaggcatgaacagatatgctgcaattaaagaaagttttgtgatggaaacaaattgtctaggctattgcttgctgcactttaatatgactagtgtttcttctaattggaggttccatttggaaaataatataggtaaacatttatgtggagtaggttttatgaccagtgtctctcttacctctccatagctgactgaattcttccttcaccgaaaatttcttatagcaaggtggttaagaatatattctctagagttagagttgtctgagtttgatcttttgctctaacaatttaatctctccaagctgcagttttcttatcaaaaaatggaactaacaattgtgcctgtctctgtaggatgtttgtaaagattgtgaggtttattcagttaaaacatgcatgtatttatatatttatttatttattgagatggagtttcgctcttgtcacccaggctggagtacgatggcacgatcttggctcactacaacctccgcctcccaggttcaagcgattctcctgcctcagcctcctgagtagctgggattacaggcacgcatcaccatgcccggctaatttttgtatt

SEQ ID NO: 72439 - DNA, 1011 bp, Homo sapiens
ggttgggttgcaacagggttgtcaattattattattattttatttgaaaagtacaagcaatttttaaaccaaaaacataaaggaaaataaacctcagtccaaaggaaggacagtacttcaaactgaatacatgttagcttttacaaaagcttccttacattgttcttggtctttcttttcttttttttttttcagcgcagaccagtgaacactttatcacttcttaaaattgagaaacactgataaagggaatgcacaaaaaggaccaaattttggagaaaatcattaaaatacctggataagactaatagtaataatattaataatcagtatttattgaggatttattgtgtgccaggcatccttctaagtgttttgcatgtattacctcatcagtattaagcagctaactttactgaaataagtactttaattgaaatctaagcaaattatttggagagtgcaatatgaagaagtaatgaattctgaaagtaacagaaaagacctttgtggaaggagtagcattttatctaaactttaaaaatgagtagaatttcagacttgtctgaatttattatcttcagtgggtttatggtgctgcattacaaactgaaaaagagtttaagcatctgatagatagttcttgcttcttaaagaaatcagtactgcttctttcaaatatatagaatacaacaaaaatcttttgaaatattttggaatgttaacattaatctacttgggaaacagttatgttagatattcaaaatggccaaaactttttcttgttagcctgtattgaacaggggaatgaaatttaggtcactttttctgaacaatacagggaatgagttactcagatgtattcatcatttatggtgatggtaacttatttactttcagttgacagttccttggatgtaatgttcatagtaatagattctgttttaaataattttaagtcatttaaaatgagcttttggagaacttgaaatatagtgcgtgaagaaagtg

SEQ ID NO: 72440 - DNA, 1011 bp, Homo sapiens
gagatagaggaatgtctggtcagtggagtggtagaaacaccacatttattaagttttccatcgtatatggatgcagttggtggtactccaaaacaattacaatagtaacgtcacagatcactgatcacagagcaccagagcagatattatgataatgaaaaaggttgaaatactgtgagaattaaccaaaatgtgacacggagacacaaagtgagcacaaagtgttggaaaaatagcacagatagacttgcttaatgcagggttgccacaaccttcgatttgtaaaaaacataatgtctgcaaagcacaataaatcaaagcaccttatgagatgtgcctatatgtattttcagcaagaatgtcacagaagtaatgctgtgtcattataacattttggggaccattaatgttgatcaacacccaaggtagtgtgtgctatgtttctccattctataaaggtacagtttttctttgtaattaatattctattagaccaccacatcacacggattcctttttgaggaaggacttgttgctcagttttggtcagtgcagtcagcagatagcttccagcactttctgcatgactcatatcacccaaggtcacacccttcctggtgcagcttgcacacaatgcctgagtgagatggggtggaactgcccacttcagagctccctgccggttgctgaagccaggactatattgcagtgagattgctcccttagcccaattatacctcttcccccttcctttcacatatgctggtccctagtaaatacattgcaccccaaactctgtcttagcatctgattccagagaacccaacctgagtcatttcttattgggagacattttgaaaccctgtgaataatctgtttgttattactttcacttactccttttagcatctattgagaattcttgcttgaaacagttattactgtcctggttgccaaatggtggttttctaattccatgatttcttctacatttactagttagaattctac

SEQ ID NO: 72441 - DNA, 1022 bp, Homo sapiens
ggtgttctgtatacatctgctgcctatatcaattttttatgaaaacctaggaccaaatggtaagtggtgtttgtaaacgttattgttattccagaatgttctactcttagtccttagactgaatctaccattttatgaaggactgttaagtgttctttgaataacgaaccacatcagctagaaactaatgttatgaatgagaagaatctgtaccacccactcttgaaagtggcagaatcaagacttcaattatgtttggatttgtacagctttcaaccaagtatttggttaaaaccctagttctatacatggaagagaatgctttggctcagaaaatttataagttttgaaattaaaacatccagttttaaaattactttgtacctatagaacgtttaattttgggacgactatccctgcaggtaggcccagaataaattagttgtggaatacatttccaaataatattaatcttttcaatatcattgtttagtctcatgcttttggataccagaatgtttactaaaaatgatgtttgagtcaattaaaattactagattttaatatttctgggagctacttccagaaagtggtagtgatcataggattctcatcaacttatgatgatacctcctttatcttcttatttactctgaagtgggcatttattctaaaagttatgtcattcctattctgtcagaagattattcctaccgtattttaattcccgtagtggttttgaagtaaagctgaaggaacactaaaaatgtgcatttatgttgagattccacagcttaacctgtagatggtttttgtcaaaaatattaagaaatgagatcaaacagtgctgtgaaaagtcttaaattgcttctgatttctttcaccacttcaaataaagaaggagaaatgaacatgaattgagaagtgccatgtgctagtgggcatagaggggacatttcattcaccctctcctttaattctttcagtatgtcacagcataggtatctctacaggtggaggac

SEQ ID NO: 72442 - DNA, 1013 bp, Homo sapiens
gcctctccttccccggcctcccgcgtccgcccagcctgtccgcatccagccccgccacgccccatgggcggtcccgagctgcggccccgccccctcaccgcctccccggccgcggaaaccccgccccaacgacgcggagaccgggggcggcccgcggcccgcggcgggcgggctggcggggacggacgcggggggaggggggcgacgggatgtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtgtgagtaccgtccccggggactgcggcggggcgcgggccgcggctagggcgcgagataggcctctgcgccccacacccgccgcctttctggagccagcgccggacgccgggcgtccggccccgaacgcgctcggaagcgccgaggttgctgcacccgccgctttgttcaatcctgcggcgcggccttggggcgacctggggctcctgaagccttgcggcggcttcccgggtgcaggtctggcccagggaggccccaagagcttcctggttcccgccgacaccgggggtctgcatccttctgggaaggaacgtgcagaacgggagtagtcgagcttcttagaaggtttaggttgtgtttgtggcttttttggcttttgttcattttttttaaaaaaccaaatctgttccttctggattgtttttgttcaaactgcgcgagaagaaacgcctgttacctgtagagccggctgtggcgggttggggga

SEQ ID NO: 72443 - DNA, 1008 bp, Homo sapiens
gaaaccccatctctactaaaaatacaaaaactagctgggcgtggtggcaggcgcctgtaatcccagctattcaggaggccgaggcaagagaatcgcttgaacccgggagacggaggttgtagtgagtcaagatcgtgccattgcactccagcctgggcgacgagcaagattcatctcaaatatatgtttagagcattgattaaattacaatagctcatttgtcttgcagtgactctcatgacattcgtcggcttatggtttgaatattttcttcatgggtatttttgtttttgttttacttcccaaataataaaaatttggatttgcttttacttctcaaataatgaaaatttagattaatttcacttagactatttcacatagttgataagttgttttatgtttgttttttagcggagtttaagagagctgtgaaagtagcaacaggacaagaactctcaaacaatattttggacactgtctttaagatctttgatttggatggtgatgaatgtcttagtcatgaagagtttcttggggtgttaaaaaacagaatgcatcgaggtttatgggtaacagattttttttatataatacatgtttacattgtcattaactgatattaaacctagaatttgggcaattgtacagtctttaaatggagttttcatcacttataaaaagactataagctgtaattgaaatacagaaatatattttatatatgagattaaacatctttgctttttaaaaaataatgtgaatctaataagaaatcactatttaaagtgactgtgagctacgatcgcaccactgcactctagactgtgcaacagagcaagcccttgtctccaaaaaaaaataattttttaaaaaagaaattactattcagaaatgtagcctagctggacatggtggctcacatctgtaatcccagcacattgtgggaggccgagccgggtggatcacttgaggccaggagtttgagaccagcgtggataacatcat

SEQ ID NO: 72444 - DNA, 1028 bp, Homo sapiens
cttgctttaactctctcagtgctgcttcattagtaaaggcctagagatcatattttgaagtaacatttatttcactattctaaacttcctttttggcctgatctaagatcttgtttcatgctgaagtccaccttgagtattttatcccttattgtttattgcctacttgaacaacgatggttatggagtgttatgcaaaataacagaaggaatggctctatccctcttttacaacttttgttgttgttgttgttgctgtaagaagaatcctttctggatattattctaagatttctactctacagattctatttttattcttatttataattattttaaattattgtgatttttttaataggaagcaatagtgaaagaacctgaaattaacacaactcttcagatgcgtttctttggaaaaagaggacaaagaaaacttcattataaagaatttcgaaggtaaatgcaaatatttacattcatttagggaaattttatgggtaagaaataaagagaaacagaatatattcattttctagaactgcagatcataaaactaaaatactgtttgtggattttgtggatctgtgtagtatttatctctgagaactaaacctatgaaatagaaactaaaattagtatgctcaaaatatcgtaccttactatagaaagtagtatctgtttcatagaatacaataattctttttagtaacttaatgtttgcaacaaagaaccatgcgcctagcgtcagttgttctttaggcgaaacaaaccaacccaacttaaaacaacaaccatttgttatttttgtgagtctttgagtcggttgggcagttctcctgattggaacaggattggctgatcttgacagtactcttgcatttgcagtctgctgatgggtttgctggctgctggcttttctaagatggtctcaactgggacacctcagctctgcttcatgtagtctctcattctctagcacaagggttggcaaacattttctgcaaaggcctaaagagtaaatatgg

SEQ ID NO: 72445 - DNA, 1021 bp, Homo sapiens
aggacattaacaaattcaattaaaataacaggctaaactgtaggctggctgctttgcggaagagaactagggaaagagacagctataaggagccctcctggggtcattacaaatattaaacactgacagtggaaattattccttcaaaggaccccaaattagtggagcttaacatcttggtatggtcaagaaaacggaaactagagtgctgcccaaattactctcatcccagggtgactgaaggcatacccaaaactgcctccctgaggagcaacatcagaggcttaacactggggggcgatagtcttcattaaaataatccagcttggcactaaacaaatagcaaataagcagatagcagtaacaaccctgggggagcagggaattgttaatagtactcagagttgctacagtatattatctgaaatgtgagtttttataacaaaatattatgaaatatgcaaagaaacaggaatatatgactctactggacaaaagcaggtaacagaaactgcttgtgattgcaaccagatatcagatataccagaaaaagactttagaatagccattgtaaatatattcaaagaactaaaataaaccatgattaaagattataatgtttccacttttattattcattggaatgcaattaaactatcagaaggcatttagctaaatcaagaattcagtaattttgcaggccaaataatacatcctttatgcatgtgatgtacttcatcttcatttttcatcatggataagaaggataataatcttggttgcattcctacagatcattatgaacagcaaaataaggaaaaacagggccaacccactgacccatgatctccatgaataaacagaaagatacaaaacagtctaagatttattagatcctaaactcatttttacgtagtatgtatctttttggattttttgcaaataatacactttattaatagtagttaatgaggcttctgtaaaccatctccccatgctcctttcaagtagatactcattc

SEQ ID NO: 72446 - DNA, 1045 bp, Homo sapiens
tttagaacgatacctccagtcctggctgttgcattggtgataagtgatgtagctgaggcagactacttggttttatttaacagcctccaatcctccattctttggtcttcacttttcctgagtaactctttttaataaactctttgttcagcctctgaaatgtccccagctattagaagctttagttgggcatgcagtaacggagccaacatcaaaggggccaagactcctaatcacataatcactgctgtcttgaagttttgcacaaaacaaaacttcaagaaacaaaaacaaaaacctgtcacacgaaatctaatttgatcattcagtggaagttccgtggatccctttgttattatctgcccttaatccttgctccctttctcttagcccgcttgtctaaattaatctgcagtcagaggttcctcacttttccgtcagcttctggacttacttttcagtgtgccttcccaggtaggaagtagagagatgagcctcacttcaccgacttgtgagccagacctcaaggtttgaatcttagctctaccaggatgatcactgtggtttggggcaaattatttaatctctctgagtctccattttctcatttgtaaataactcacgatttggtagatgatcactgctatttggggtaaggtatttaatctctttgagtctcaattttttcatctgtgaacaaccctcttacagtttggggtggggaagctaaatgagatattttatataaagtgactagccaaatgcctggcacatggtaggctcatgacagatgtgcgtttactgtggtcaaggtttggtttacttctgccctgtgaacacaaatgagcttgactgaatgtccatgattccagatcactagcccatcttaacctgagattttcctgcttttttgtatctagcctgactttgtcaacctctggactgtttttcacctctgctaactctggtagctttggcacatgtcctgcttttctggactattgacatctagcttgtttcctggtgataataggacttccaggat

SEQ ID NO: 72447 - DNA, 1049 bp, Homo sapiens
tttcaaagtacagtggaatgataattcaatactatatgtcatagtttataatctacaatagttggtaaattataattatggcctccagtatctaatctctgatttaccaaagttatttgaaatttaaggccatgccactttcattctcgccctatgggaacatttggcctctatataacttgttgtctttgccctggaaacccttcctactctggaccctgccctgtccccttacccttccttctgctgtcctttggctgaataccaccctagaattcctctcctgaaggtcattatcctctcagtgcctagtaacttacaaattgttttccatcaggatgcagttagctggtggcctttcataaacaaatagtcaaatatgtcagaggtgtggaggccggccgtagggtagtgtagaaagtgctccaggtgtggaggctggcagtagggtagagtggaaactgctccaggtgtggaggctggcagtagggtagggtagaaactgccccaggtgtggaggctggcagtaggggagtgtagaaactgctccaggtgtggaggctggtagtagggtagagtggaaactgctccaggtgtggaggctggcagtagggtagtgtagaaactgctccaggtgtggaggctggcggtagggtagagtagaaactgctccaggtgtggaggctggcggtagggtagagtagaaactgttccaggtgtggaggctggcggtagggtagtgtagaaactgctccaggtgtggaggctggcggtagggtagagtagaaactgctccaggtgtggaggctggcggtagggtagtgtagaaagtgctctaggagtggaggctggcggtagggtagagtggaaactgccccagctgtggaggccagcggtacggtcatgtggaaagctgctccaggtgtggaagccagcggtatggtcatgtggaaaactgttcccgcatgctcctttccagctctgagttcctctcacctccctgggttcccagactgcaacacagcttcttactactctgtactagattt

SEQ ID NO: 72448 - DNA, 2753 bp, Homo sapiens
aaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcattggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatg

SEQ ID NO: 72449 - DNA, 1078 bp, Homo sapiens
gttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcct

SEQ ID NO: 72450 - DNA, 1036 bp, Homo sapiens
ttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtg

SEQ ID NO: 72451 - DNA, 1018 bp, Homo sapiens
ctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatg

SEQ ID NO: 72452 - DNA, 1576 bp, Homo sapiens
tcatgcctgtaatcccagcactttgggaggccaaggcgggtgggtcacgaggtcaggagattgagaccatcctggctaacatggtgaaaccccgtctctactaaaaacacaaaaaaattaactgggtgtggtggcgggcccttgtagtcccagctactcgggaggctgaggcaggagaatggcgtgaacccgggaggcggagcttgcagtgagctgagattgtgctactgcactccagcctgggcgacagagcaagactccgtcaaaaaaaaaaaaaaaaaaaaaaaaaagaaccttccagtactgtgttatttgtgagaatagaaagctgttgtagtagaattatatgtatttatgacatttctgtgtatgatttacaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaa

SEQ ID NO: 72453 - DNA, 1293 bp, Homo sapiens
tatcattcacggttcttactattatatttttcttaaagctttgtcaatgtatcttacatgttttaaggtggtatcaaatcaaagaggaaaacaaaatcttgatataagtagagtgcataattaacacatgccctggtactgtctggttacatcagcgattctcttaagacgaaagctaagaagtcagagtgtcagtggtgattttttaggaagaaatgtggtcactggggctaatgttgaaccaccctggcttgctggacttttatgctgggccctgggacctgcagtgccactgctaggctggaggtggagggagtctgacctggcaggaaggctgcccttttctttccttccttttttagtttggttgtttcatttctttttttctattctctcttcatttctttgaagagcgactgatctacagtacaccatttaattgaaccttgactgtacatttacaaagagatttgcatctctgtgctcagtagggcattgttagaactcatcagctacgcaagctgccagtgcctctttctgtacaagagaaaagtataaaaaactgtcactgtgcttacagctttggatggattgttattgtagccagctggagactggaggagtctggttgaatgtagtaaactctcagttaattaaagcattcaggactgagatttcttggttaagtaaatttttaagtagactatatataatatttccatctgtgctggaattcattctcaaggttagcactgaacataaatgtaaacaataaaaaatagtgcagtctttgagtactgattcattatgttgatgttattattttgaacaaatgagggattgaactgataatagtgaagcaaaagctactcttggaagagttccttctaagttaaatttggtaattgtttaaacctttctgcctcttggaataatttcagtactgtagctaacctctgagacagtgctgataatttttaaggctacaaaaaccatttcatttattaaactgctacaaaaattattttgctgatcctattagaggtgctttacaatttctatggctttctaacccaggacatggagacttgtttctgtgttaacatttataactaaaaagctgaatgtcttaaatacaatggatagaattcaggacctcagattgaactgacttaatttacgtataccggtgtcttactacattttctctctcctttattttctttcatgtttttttccgttgagcatgaccgatgtgttagttgcatgctatatgtagtgtgtgtgtgtgtg

SEQ ID NO: 72454 - DNA, 1014 bp, Homo sapiens
agtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcac

SEQ ID NO: 72455 - DNA, 1358 bp, Homo sapiens
tgaaaatctttgaggtggttctggtatctcttattttccttcctcattctactctttttagacttataagcattctaaagattactttgaaatcatatttttaatctagaaagaatatgaggtttctggttcctagttaacaataggaaatacttaactcagtgtggacatctctgagagtatatggctcttgtagaatcaaagctcttagtactgattatagttttgtgataaaaaattttgtaatggagttggtccttttagtttcaaactgtgtcttgcaggagaaggaaagattgcacaggcagggctatcactgtagccaagatgactgtatactttattattcatactgggacacgtgtgagagtgaaggagggtggtactattctcagactactggcctgaattgggactgccctgggcaagtgggaagtagggtcatcccaactctagccaaattttagtaagcctgttgcatttacattcatacatatatattctattaaataatattgactaaattacaaatcatataatcaaaattaaattatatattaaaatatgactattatctatgaatattaatactcgtgtccacctctttgtaagttatcccacaagtctgtgccatgtagtagtttgtaaatgttgtgggacacagatgtgagtagcaaaagcctggaggcttaagcaggaatgaactgtggcgtgagagcccagctaattgcccagcacctgcatctcagtgtggttttgattgctcattgagaataagcacatttgtgtggaacattaactggaggactcttctctaaaccaaggatttgagaaggtcataggtcataggtcatgcttttatcttgtcaggagccacctggcctgatttcattcatgggggtgcgactctgtgccttgggagcagggttgagcattccctagaccccactgtccatggatttagccatgtggttggtggacataacatttgctaacttaaaatacccacaagcttgggagttggtgattgtgacagctgaagctgtgcttgacgaccgtaggtattaaagattgacttcactggagttgcatcttgcaggaaacccaggtgctaagtaagcatgtgaggcaagcatacatcacatcacccttgggagatcttcaccaaagcacactggggaggaatttctctcatcacagtgggtctcacacatctggtttttctgccagtttttgaatactactctgtccttggttgaggaacaggtgaagcagctggtatcaatttagaggccatgttatacaaaagatgggtatctttcaatactgtaattaggctccacgtggtgagatgctcc

SEQ ID NO: 72456 - DNA, 1018 bp, Homo sapiens
aagcagttctcctatctcagcttcccaagtagctgggattacaggcgcgtgccaccatgcccagctaattttttgtattttttagtagagatggggttttgccatgttgggcaggctggtctggaactcctgacctcaggtgatctatacgctttggcctcccaaagtgttaggatgctgggattacaagcatgagccactgcgcccagcccatattttcatctgttttatgaaatatatgaaatattttatatttatttggtaaatattttccatttaccaaaaaaagatttaaatatactatttagaacaaatttcacgtagagtagtaactgattttcttgtttgccttatgtttttgggtatctgagtaacctttaatttttcctttttggatttttggccaacaatagtatatttcttctgctgctaatttttacttcagtgtgtgtctttatttttattgtaaaaacagaattatagtgtggaattcagtcactctattcactcctctctattttcccttcgaataagagattttgtatagaggatctcttgagatagaacagaacaccctggtatcttttttgaattcctgcctgcgcattttcacacctagggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacaggtagagtattaggcttttcggtcttggtattagaaaatattatatcttacattctgtaatgtatttggttaacttcagaggtgatactgtttaaaagccatcttacccaaattcttctgtcagtagcaggaggtatgtcaatgaaatatcagtgcatactgaattttctgaaattaccacagtaacaataccaaagttttccttcatcatgtgatgccaaaagttaacatcatcatgatccagtggaatcag

SEQ ID NO: 72457 - DNA, 1024 bp, Homo sapiens
cctctgaagtcattgtcaatgactgtatgtgacagaaagttactgagaaaaagtgggatcaagtcagaccttctgagacacctttttaaagagatttaagtcatgtatttttaaaaagatgttttatgatttaggaggccagttaacatttagttaaatatctagcatttgttatgtctcatatagtcattcttagctcacatttgtcacttgaaagttgtactttctatactctataaaaagaggtgtgtgggacataacatcaggaggtgtgcgttctagtcctgactgctgctaccttagtgacttgggccagtcatcacagaggtcagatcatttttataataagaggattagcctgcaaggtatcttgtctctaagagcctgtgacttaatgtaacattggattcaagagacttcaggttaagtcctaatcctacacagtactaccccattgtactgccccccaggcactgttacactcagtggcagctgtgaccctcacactgacttactgcttgcctgcaagtggtatgagaaaatctttctcccacatagtttgaggattatatgagataatatatgtgataatgttttatacctggtatcatactgatgacggtatgtgctgtggaactgctaaggtaagagtgtaaggagagcctatgatgtttttgcttctagccttgacttcaccttgttttaaaaaacatttgaaactggattattttgcgagtttatgcataggtatatttagagataggctctttaaaagtggccaatttaaaataaacgtgggctgggtgcggtggctcacacctgtaatcccagcactttgggaggccaagtgggcagatcacctgaggtcaggaattcgagaccagcctggccaacatgttgaaacctgtctctactaaaaatacaaaaattagccaggtgtggtggcgggcacctgtaatcacagctacttgggaggctgaggcaggagaatcgcttgaacctgggaggcagaggttgcagtgag

SEQ ID NO: 72458 - DNA, 1142 bp, Homo sapiens
tcaaaaaaaaaaaaaaagaagtgtgagtgggataggctgggcatggtggctcacgcctgtaatctcagcactttgggaggctgtggagggcggatcacaagctcaggagatccagaccatcctggctaacacggtaaaaccccatctctactaaaaaatacaaaaaattagctgggtatggtggcgggcacctgtagtcccagctactcaggaggctgaggcaggggaatggcgtgaacctgggagaaggagcttgcagtgagctgagattgcgccactgcactccagcctgagcaatagaaggagagtccgtctgaaaaaaaaaaaaaagaatgggtgggatagaagtctgtggaaacagagtcttgtttgagcttggtctcagtatgtggttgtaccaaaatgacgcaaataaatttatagtgacaattttgcttttttaagcagaggtttctttatactgataaacagatttttgaaatgctgtgtatttgaggcattacttcccattttcttgttcttcctacagccctgtcacttgtctgaaggtgacctggtcagttggtctaagaatatctagtttaggcaaggcttgaaggtacttgaagtggacagccattgagacagtgactgctgaatttcagaacaatcagaacactggttgaatttgagaatattaagaatgtgataataggcacctctgtctctggcttgttatttaatggcaaagcagccacaaaataacatcatttattttatttgctttggaaaatatcaacactcctccccactgcaccatgcttcttgtttttgaattaatagttattatatttttgaacattttttgagactttatttgtagttcagttaaaaatcttgaggccaggcatggtggctcacgcctggaatcccagcactttgggaggccaaggtgggcggatcacgaggtcaggagatcaagaccatcctggctaacatggtgaaaccccatctctactaaaaatacaaaaaaattagctgggcatggtggtgggcacctgtagtcccagctattcgggaggctgaggcaggagaatggcatgaacccaggaggtggagcttgcagtgaggggagatcacacgactgcacttcagcttgggcg

SEQ ID NO: 72459 - DNA, 1019 bp, Homo sapiens
atttttagtagagacagggtttcaccatgttggccaggctggtctcgaactcctgacctcaagtaatccacccgtcttggcctcccaaagcgctgggattacagatgtgagtcactgcacccagccaagaagtacatatttggcccttagggctttctggccttgtctttatactgaatcaccatattctcctccaattgatggagcatacttacttacctctcccaagtaggaagaggcatgcatgacttctatcattccctttttaactgtggtaagagagatggaacagctgtagaacattctctgtatttactactgatgatgagttctgagtaataattttttttggggggaagggagaaatggcaatttattatctattttttggggcaactctaaaatttaattctgttccattcaaggtatttaaaataaggagcacacaagtttacttgttcatgatgtagcctttgaattgccttaatagatgtcactttttttttttgcaatgtgtatcatatatacctaagagaaataagccaaaggaacagcctgaggttcccccaagcctctaagccccacacactttcaaattacatggcaactttacttatcgtggggcgatttcatcaactcttaagactcatgttcctgctttcaaggagcttgcggttgtgatgggaagacattcaggctaccaacaatataatattgccaaaataagttacaaatatttttaacgtgtcataggatacatttatgtgcattctgatcttactttgctgctggctctctttcctccagcaaactgagccactgatcctacttctgtgcctcaaaaaccgagcacagaacgaaaccgtggaagacacttgtgttctgtaaccagcacgttcccttctcggaggccactatagatcttactggagatgcttccatggaatgaaagtcattagagttcaaggagacacaggccctagaaatgcctagttctgcatttcaatgcactgttgagc

SEQ ID NO: 72460 - DNA, 1016 bp, Homo sapiens
ttggtttattatattttctttctgattgtcctgcccacccaagatgggatgagattgtttttatgcattttcccaacttcgctggcaaagtacaattcactaaaaccccaagagatgggagcagagtgcaccgtcagtcactgtagggccagacagtcgtttgtgtgatgagtttcttgttcttactacttcataataagacagtgactaactagtctttgattcctggttcttagtgattgtttttcttctcagccacccagagggttgcaagtccctgacgattccttcttgaaccgcctgtcacttgtaactcgccagactgaattttctttcttgaaaactgagatttagaactcctgggcatgtctggagtttagatcatttctaatcacaaattagaagtaaattgaagaatggtcaaatatagcccaagtctcaacatcaacccttatgtgggtccaaggtcatcctttactgtggagagaaataacctatcacatggtttgccttatgtgaaaacacttgtgcttaggcactgaagacatcagccaacccacaattacaattcatattttcataaaataatttcagctctttaaaactcatatgagccactctacttttcgcttccagtatctttcttaatttttattacttccagaagatttgcagttccagaaaactccagtaatttctaactcccatgactttaagtatatgtctaaatttttgtttttttcctaattgaagccagtttggacagaaattttgttggaaactccaggttttatggtaccgggagcaaatgctctcaatgctaattcctctgttagtttgaatatttttgcatatgcttgccttagtttttaccaaagttatacataaccagagtttaagcgaacaagctggttgtgaaaaacaataggctctaccccccctttccccttattttctcctcccagagacaccacttttcctactttcagcaagtaaggaagttttacctccatttc

SEQ ID NO: 72461 - DNA, 1037 bp, Homo sapiens
aatgtgtgtatcagagtaactatggaacttgatgtaatttttagtagtttgtacaagagggtttgcagtctgtcatacaaattttacttggaaatgagttgtacaaacaggacaaaacagaacagcgctcactttagcatgcaactggtacttcaacccctgagatctgtgagctataattgctctaagtatttacaggttaccttatttagtaaacagtcagtgcaactttgcttgttgaaaatgctttctttgttttcttatataaaagagtaaaatgtatctctggcaatactgtttctttagtttatttattctctcacttccaagatgtaaatctatcaaatacacttccttatgcagtttgtacactcaagggaatcactgaaaaaccatcaagtatgattaaagacttttatgtgtaaaactgaagaatttaaaaacagtgaggataaagttgcactaagtttggctaaaaatactccagtgattttctataacctttggaaatagcataagccttatttacagaaacattcacaaggttaatattcctaaattaacatttactttacatttatagtgacagctgttttaagtcaaaatttgccaactgtttatgaaaactatctgagtaatcaacagttattatgttacataaagtatcttagtcacattttcactttagctaatgcccaacatgacaaaaccaaattatattgctgtaccgaatttgaaagttaactgttatttttttgtcagttcatgatacacacacactcacgctcacacacacacacagtaaaatctttacagtgaaatataaaaactaaatacaatggaaaagtaacactgttactttgttcgcgatgtttttttttttaatgttctagtcctaaatttatctgggcaaaatatttaattattatcacaagtctatttgatgctagctgaaccataaagaaaccataagtgataagaccagttatcctttagtctgaaattctgatgaaacaggaaaggtctaatgagtctca

SEQ ID NO: 72462 - DNA, 1170 bp, Homo sapiens
agagaccaacgggttatgttatgaaattttctctttaaatgattttctgaaaaatcttcactattgaactttctaaaatgccattgaaaataattcctgaaaatattgccaggggtcgtaggaggcatggttttcttcaaaatgagaaaaattgctttttaaaattcttggtattggaatgtttaacacaggaaacatgtcagggagtctgttttgggtgcagaatgctagtctagatattaatgaagtgctgcagaaacacatctctcccaggttgtgaatgatctcctcgtcttctcctttagggacagctatcttgaatgctaagatatccgtatcactgatgaggacactggggctgccctggtgaaaaccacaggccaacttcccagttctcagggagttaagattccgatgctgcagggcagagctattatttacaataaggtgctgagggaaggtttattaaggtgaccctaggacagggccctgaaagaggggaggaggcagagacacccacagcagaggccacagctggtgactgagtcgataggtgcatcacgtagggctcctgggccgttatgaagatacatttaacttccctcggactcctgttggaagtagagttgaggggagcaagggaggaagcaggagctcactctcctagtttcagcagagcatttttagctggcacagtagatgtatgtgctttgagaaatagtgtggcttttcacccctttctcaagagttggttattagtttatttaattcaatttatttaatttaaataaatcatgtatttactagttatgtgttaataatattataatatttgctatgttttgtttgcctcttcagatagtcaaggaaaattagagttgttgttttttttcctaaacccaagtgaaacacgtatttgaaagaggttaacttaagcttttatattctgccgtaagcttttacattatcatgagtgttttctatgattttaggcccgggggacacagatgaaggcctgaaaaataaaatcaggggaagctctctctgattactaattttctcataactatctcagttgatatcccaagactaatgcaaacccatctacttgatgtttttcatggaagctcatgtaggcttcgctgtgaagaaggcttgattttgagtcct

SEQ ID NO: 72463 - DNA, 1026 bp, Homo sapiens
gccgttaggaggactggaggtacacagaagctgaagcagcaagaattggtcctggtttattcacctcacagcgaggtggctgtgttgagtcttctggttaaaactaatcttgttaaattattctccaccatctcctgttggtttgggtgtttcgagtctcttaagcattaaaaaggaaataagcatctcgttaaaattctagaatttttcagcaacttttgggtcatgtttgtctttcttgttttgagtcagtttatttaaaatcacggtaacctttggtagagtaggactttatatcctttgctgtctggttgattcaaaccaaacactaatatgcctattttaaaaatatgtctattataaaaatatatctatttttagaatttcttaaagaagagagagctgagaagtccatttcaaggttttacacaaaccataattgccccttggactattgacagattgaaagtttaggaaagtaattcaaagggaaactggtctctaacttgggcaaataggggcaaaggtaataccaactttttaaaaacttttattttaggtttgggggtacatgtgcaggtttgttatataggtaaactgatgttacacgtttattttacagattatttaattatttaagcctagtacccaatagtttctttttctgctcctctccctcctcccacactccaccctcaagtagaccccattgtgtgttgttcccttctttgtgttcatgtgttctcatcatttagctcttgcttataagtgagaacatgtggtatttggttttctgttcccgccttagtttactgaggtaatggcctccagctccatccatgttcccacaaaagacacgatctcatccctttttatggctgcatagtattccatggtgtatatatgccacattttctttatccagtctgtaattgataggcatttaggttgattccatgtctttgctattgtgaatagtgcagcagtgaacattcatgtgcatgtgtctttatggtagagtgattt

SEQ ID NO: 72464 - DNA, 1065 bp, Homo sapiens
ttaaccattttcaagtgtgcagttcagtggcgttaagtacattctcactgtggtgcagccatcaccaccattcaccttccagaacatttttcatcctcccaaactgaaactctgtctccattaaacagcagctcctggtctccccattgctccagccccctagcatccccccttcttcatctgtctgtatgagtctgtctactctcggtaccttatataagtggctcatcatttgtttaagataagaaaaaaagagaaccttgtattccttttcccccaaaagtcacccaaagggaaacatctaaatttccgagagcagtgttgaagtgttattaaagtgaaagctgccagaaggaggcactgtgcttcacacctgtgctgtcttccctagggccggtgcgcttgctcccatccatgtgctgtgaggaggcctgcagccccaacccggcgactcttggttgtggggtgcattctgcagccagtcttcaggcaaggtaactaggtgctttcaatcaatcatttcataaccccctgtgcaaatatgcattctactaatttaccgattttcatctgaaatgatggaaacatcacctcttaaatattaatgacattctggatattggtggggtgcagttctcagggaagaattaggtagctctctcaaggtcactcatatccagtgcaacattctttacactttactcttcattaattttatttttgtcttatgtctgtgatttttgacacctctgtcatctgtaagtaattaacatgtaagtaatttttacccatggaataatattttagaattttagaacagcactcaagaaactcagatgagacccaggaaactgcatgttttagacattggattaagtataactatattaattagaaggaggtgtcaaaactcagttttcaaataaatggagtaatttgacttattgtattgagatgagtttataacaataggaaacactagaattctgatgcagtaaattgctatttcatttagaagacctaaaattacggctgacatgcttctttgtagtagtgtttttctcc

SEQ ID NO: 72465 - DNA, 1001 bp, Homo sapiens
ttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgaattttctaattttgtgtatatggaatatatttttaaatagagatttttctactttagataatgtgttaatattgctattacctagg

SEQ ID NO: 72466 - DNA, 1022 bp, Homo sapiens
ttctgatctcataaaattcacttaagatttttcaaactgccaggctagcctttgtagctacaattcttaatcagtaggctgagtttggcacatataattatttcagcagaaaaaagagccattaaactattatgatgaattattagaattggtaatggtgctgagaatactcaaacctccttttcactcccaaatctgtttagataatctgctttttggtacatccaagttattgttatgtctagtaatggaggacggcatagcacagacagctgtatatttgagtgaatcgcaggttctaaaaagagatttctgatctctttttaaaattgtggtaaaatatacatgccataccatttgccattttaaccatttttaaatgtatagttccaagccattcacaatgtcctacacttacaatgctgtggagccatcaccagtatccattttcagaacttccccatcaccccagtgaagaccctttatcacagaagtcaacaggtagaaaaatggatttattttaattccatcttttatttcttttagtagataaacagttacctaataagcagatggcaaaaagtagaaaaaagctgtgatttatgagctggataagtagcttgtgattgtgagttttatgatagttttatgatatttaatcacagatcaatgttttggaattgaacttgtgcaaaaatagtaagcaacctcctccttcaactcttgaactaggaagcaggttttcataaatcttcgggtctgattattatagtgagttactgagcatttctgtgtgttaaatgctgtatcttatttaatccttattaacaatctagcaaagtagatgacattgtgccagttttatgaacttcaaacattatactaaactccaacattttacttttacttagatttcctccagcaggggttaagtgattagtctgaggtccttacccagttgtttaacccagggtaatctcttactaaacccttgctctaaccatcaggatatattgccttct

SEQ ID NO: 72467 - DNA, 1048 bp, Homo sapiens
aaaccctgtctctactaaaaatacaaaaaatagctgggcgtggtggcagacgcctgtaatcccagctactcgggaggctgagacaggagaatcacttaaacccaggaggcagaggttgcagtgagctgaaatcgtgccattgcactccagcctgggcaacatgagcaaaactccttctcaaaacaataaataaataagcaaataaaaaagaaatgtcttagctgtgcattgtgttctaagcatctgtctcactgtgtcctaagtaaattaatttttagttgccatgatttattcaagtaccaggataaagattcaggttttagctttcaaagtgttacttatactctaatagaaaaattttttatttgtcataaactcttagaaaattttcctttagattttaacaggtcacagtgttttttttttagtctaaagaactcatttattttttattcctttatttctttttctgaaagtttaaaactacatattttcaagaaattccaaggcattgggttagatttgtttttttacctgttgaaaaattagaacttaatatctttaaggtattacaattctttttttctatgtaattttctcagtaattttttatttgagtatttttactgaaaatttaattgtaaatggaagtgatcatcatgatttttcatgtatgaatataagaacattgaaacatgcttacaaatatttataggaagatatgaatgttactagataattgcaatatattgatggttatatttgcagctgagcttgactatctgaaaagttttctggctatctgaaaaagtgcatataggaaataactttcaatattggagaagtgttttcattgtagtaattgagtgtgtctgggtagtcatgagtgtgatttaaatgtctccttgcctaagactgttgaatctaatgcctgtactcctttttagcagaattccagattcttgccttcagccattcatttattcagcaaatatttgtgcagtgccttcagccattcatttattcagcaaatatttgtgaagtgcta

SEQ ID NO: 72468 - DNA, 1127 bp, Homo sapiens
gcctatagtcccagctactcgggaggctgaggcaggagaatggcgtgaacccgggaggcggagcttgcagtgagccgagatcgcgccactgcactccagcctgggcgacagggcgagactctgtctcaaaaaaaaaacaaaaaaaaaacactgtttttaaaactgtacattttttaaaattattgttttaaaaataggctcttcatttttctgtgacttaataagtttcttggccccaggaatgcatgactccctgggtaggcagataggctcatgtctttggaattgtttagtttatcagcaaataagcataaaaagaatgcacatttaatttattttgctctgttttcatatttaatttattttgctctgtttttataattcaaaaaagttaccccatgtttatatcattttgtaaaaggcataattgaagaaatgaaactcttgaattctgatttatttatacattggggcaaaataacacctcagttgaggttagaatgtaagagtttcagttcctgataatttactctgttagaatataggtaagacattgagtaattttggcctccctgattatctttatgcatcgttactcattataaaatgtagaattgaaagagctatatttagctatatgtttagattaccagttagaagaaagcaatatttatatttaggaaatgtctgtatttttctagggaaggtttaaacttaactttataatttagaaccataattctatatctagatgcagccagaagccagaggtcatttaaattttctcttttaaccaaactaatcctcacttctttcaagtcaacagctgcacattctctacaaatcccatttctgaatcacaaagatacatatcagaagcataattgcgtgtcaaaatttgtcctttaaaataaagcattttctacttgcctgcatgaagtcaaatgttcaagtcagtgttgaaaaacaatatttgagtcagatgttgcagtgaaaaaatgctttatgtttattttagatttctttgcaaaatttagttttcagtactttgtaaacagcagatttcatgtccaaactttctttaatgctttcttctcccactgtgtttcagtggcctatatcctcta

SEQ ID NO: 72469 - DNA, 1132 bp, Homo sapiens
aagccttaaatcacatagggacattaaactaagtgtccaagctctacagttctttcagattcgaaaagaaaataatctgcaatacattattatgactatttgttaggatgtcagtttagctttaacactggcggacactgtgaattaccatttatttcttgacattttcatcttttagtcctattgtcagtgattatatgcacttaaaagtcaagagagtatttgaacaggcactcactaatagcaaaggaacagaaaaagtattccctttgaggttttaaatagatttttaaagatcggcgccagtgtcttagttccacgtaatcctgtattttcatgtacaaacccttatttgacaattaccactttttgaaattaaacagaatgtctttattcatgttgtcttgccaactaaaatatttaaagttattatttttaaactataatgaaattctattactcatgttacatttgatgttatttttaaatttcctggcttatacatagtgcagtgacttattacgcagtttactcacatatatattcttttgttttatcaagccactgccaaaaaatatggtgtctcgtctttgtgaatctaaaaaggtttgtgctgcagctgatatgcaacttcaggtatgtatgtacctttgttctgaagttttccggagtcattatcccaaataaatatataactttacattcttgccaatgatacctatttattataataattatgcttctaaaacatctttcatctgagttcaaagaacttgaccaaaattgactcatttagtcctcacactgcccttatgaagtaggcgttgaataaaattatttcctggccaggcacagtggctcacacctgtaatcccagcactttgggaggccgaggtgggcgaatcacgaggtcaggagtttgagaccagcttaaccaacacggtgaaaccccatctctactaaaaatacaaaaattagccaggcatggtggtgcatgcttataatcccagctactcaggaggctgaggcaggagaatcgcttgaacctgggaggtggaggttgaagtgagccgagatcttgccactgactccagcctgggcaacagagtgagactctgtctcaaaaaaaaaa

SEQ ID NO: 72470 - DNA, 1589 bp, Homo sapiens
aacaacacaattattaaaatgcaagtaaaaaagcagtacagtgtaacaactatttacatagctactttgtattaggtattacaagtagtctagacatgatttaaagtatataagaggatatgcatctaggttatctgcaaatactatactattttataccagggacttgaacatgtatggattttgttcttggaggaaggtcctggaaccaacccccctcagatactgcaggttgtacattccttttctggttccaggtagcaggatcaggtgagattcattgtgtattacccagctgcttagtaggatgccttgcacagggtgggatgctcggtgaagatgagcccagagagtcttgtgacaggtctcacctgcttttcttgctctgtcttctcttacagcccatttcgtaagcacaggaggcagccagcttcaaaccagggctcatttggacttggtgggattctatagtgacaaaaaaaaatctgcagatatttttatgaaagaaactaggaaggggcataaattatctgaagtataaagttcactcagtaaaaattgctttgaaataaattcacattaacataaattctcaatccatgtttaaaatagtctgcccttgttaagggatacagattttatagaaaactgtttctgaacaactctatagtaagatagtttgtaaaggttgcagattgcaaagctttactgagggtataactagatttactattgtatttcaataaaatgcctccataaaaataatagttgataggtgatatctgaaaaaataacagagtgggaatctccctcttcactgtggaaaaagaaaatgttgcaggagggaaatgtggagcttgcagttggtattatttggcgtttttcagtatggaggcagtgttggatgctggctatttttcttctgttttggagcagagaaatcagaatgagttttgtggatctgctaatgcattgaggagaccagaacatacagcaccttctgtgctctatccatttgttccctggccataaggaaaggcaaattagtgtgctttcatgagctccatcaactttcattccttagaaatgcacactctgatggggcattggaactggctcaggcaccagagcggcaggacaccctgcaggcaagttcccagaatgtctgggggctgtgctggcctgggagaggcagagccaggtgcgatggagaagagctgaagagaagctttctaataaagtgggtgtaaatataagactggaaagaagctgtaagatagccagaataacagctgtatttattcctttatttctttacgatgttttatttataagaattctttcttttattagtgaaagttacatttaattgctttaccaagtcattttccaactagtgttgtacatattaaatcacctgattataaaagatgtatggggtggagggagcaggtgttctgtgctcaaataattttggaaaatgggtgtagcattaaatgggtttctataaaggtaggactacgtataatttaatatgctaataactggaatccccaagaaaggtgtttacttgagtgaatttcctagac

SEQ ID NO: 72471 - DNA, 1289 bp, Homo sapiens
tttttatagagacaggatttcactgtgtttcccaggctggtctcaaactcctggcctcaagcaatcttcccacctcagcctcccaaagttttgggattacaggcgtgagccaccatacccagcctcttcagttttcttctaaacattttaatgctttcttttctctttcaatttttaatcaagttggaaattctttctgggtttggcataaggcgggaatccattttactttcttccgtgtgagtaacaaactgtcccagcaccatttagtgagtaatttaccctttcttcagtgccattactcatgtacatgcaattgtcagtttgtgggattctctttcattccattgtttaagctgtctgtcctaatatcaaagccatgctgtctgtattactagagctttggaataagttatagtaataagcttactattattaataagtaataataagccttgatatctggaaggataggccttcctcgatttgttcttcaaaatttcttgtctactcttggacctttgtattctttcatatacattttagaatcaggttatctaatttttgaaaaattctggtaagagtttgattgggattacattaaatttctaggccaatttggagagaactgatatctctgaatattgaatctttgaatccatgaatatggcatatctctccatttcttgggtcttttcaaaagtctttgaatacagttttaaaattttcttccagggccttggtcagcttttgttgggcttcgtcctggatgcccttcctttttgatactataagcagtatatatattcagattgtttgttactggtgtttaaaaatgctgtttgtccatttttgtatagtgctcttgtttacagcagctttgctaaactttcttattaattcacagaatttgtctatagacttttacaagcttttttaaccagataattacttctgctaaaaataatgacagctttatttttcctttccaaccacgtatcttttctgtttaccttgttctactccacttatgagagcctccttaatgttgagtaaaagccgtggtatgggcattcctgccttgatcctggtgtttaaaggaaatgtttttaatacgtcaccgtaaagaaagatgtttgttataggtttgttggagatatcaggaaaaggaaattcctttctatctccagtttgctactatttttttaaatcattaatgggtattgcattttatcatagttttttcctgcatcttttgagctgtcagattgttcttcacctttaatctg

SEQ ID NO: 72472 - DNA, 1027 bp, Homo sapiens
gtagtgattgagtctctcctataagctatgtctcttggagaggggatagatagtaatattgctgatttttaactcaagctgggagctgcattgtggtgttttcaaattcaagggttataatttgcttgggcgtatatcacgacattccaggatttgaaggaaaaataatttgctcctaaaattgtccagccagcacttcttcccagctcttgtgggtggttagtaaaggtattgtagaggataggcagtcaggacaaaaggccctcatgaggaggatttcctgtcctggacacagaattccaaaaccaaaatcattcaagagatggagcagaagaggatgcggggaaaagagaatctatctcgagataatgtggggtgtagaatgtaattaaaatgtctatatgtgtggctatggatgtttaatatacagattcttgtgttagggattttagagaatcagatggcctcatttaccaccaaatttaaatttttttttctaggctgttgttcatgaatctgaaggattgttggggtacatttactgtgatttttttcagcgagcagacaaaccacatcaggtgatcctttctttataaactggtctctctagaaccgatcggcatttcatttgtattgatgtgaactttgtatcattttttaaattccatgacatttaaaagttactaatgatggttaccaaatatatacatttgaaattaagatagaattttaaaattaaaaagtttatggaaataattacatcagtctatatttgtcacttttatctgggtcatggtattaattatagtaacaatgacaactgacattttatgaatccttatttgtgccaaacagtgcactgagcccgttatacacatcagccttttaatgttcgcctcacccttttgactagttactcacattatgaggaaactgaagccatagaggttaagctacttggccagaagtgctaggacttgaaggcatacatcctgagcagatccccaacttttaactcttttccata

SEQ ID NO: 72473 - DNA, 1017 bp, Homo sapiens
agagttaccattataactgaaactgatcatattttgcatgtaagtatgtataaggaatgtatacagtgagcagttgagactgcttaattgggttagtgaaagagtaaataacagggaagggacaaaggttagggaatgatatatctaccttaattactgacttataactaacactagtaataatcagactgtcattctgaagaaaactgtctgaaaacccctcaaatgatataaatacacttttatgttttgaatccttctttagctccagtgatcttaagtattaaatgaaaagttaattgaatttaccttcagaaattgaaataaacaaagatgctgttgaacctctcttccttctcttaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggtgagctcctcctgctcagcctgcagttgcaggcatttacctttcggttgggcagttgagtcaacagcagtttcaggtttacatcaactttgccctgactgagtgtgtcccctgccttatttctgcttcacaaaaaaaatccaaattgcacttctgatttaagacactgtataaaggatccaaacataaaacagcagagttttctaaaaaagttttttggaacttgatagaaggttgaatatatatgcaccttcatatatccacaaattctatttataggaaaattgtcctttactttgtatataccttcatagctgtgtgtccgttttggttaattcccaaatccattggataagtgaccttttttctctccaacccccatcccatgttgtaggggcttatatttgcatcagatattaatttacgtccgtgttctgatttatttaacttctttgataataacttcaaacctagcaatcatctttctcctgtgaaggccc

SEQ ID NO: 72474 - DNA, 1011 bp, Homo sapiens
tttgctccaggaaagcacactttcagttacctctagcaccgtccccaccaaagacaggctgagctctgatcttcccttcttgggccactcactcctgtgtatggtgagggcctttctgagtggtggagcccaagctgcatgcagctgctctagaagcaaggaagactgaagccgggcaatgtttggccaatcacaagcaccgtttggtgaggtgagcatattcagatgatcattttaagtagcagttcctctaaaacttccactaaaggccattcagcagaaatcccccaaacacagacaggcttgagatgctgggtggccaaaccaaatggcgagtgccctatgccagcaaaaccagagagagcgttaagtcagggttctggcctggggaggagggagatgacctccactgagtgctctctatgcatccagctctggacaaaggccccgtgtgtctcacaaacctggtttttcaaatcaggaaatcagtggcttgagaagtttaaagtcctgaggcctcccaggtggtacatggctcaaccaacagcatctgtctatatgtttttaagagcatgacaagtagtcattagagtatggagtgtagaaattcacagcaccgcccttgacaggaaaccaggtgtaactacacttttgtgttctacagacacacagatggggttggagaggaggctaccaccaggacactgtggacattggaaggcaagggtaaatagagtcttggggtcccggggagacacaggggtccaggacacaaagcctgccaagcaccaattttgtaaagttcagttttaatgaggagaaatgacttgaggagaatccaactaggcctcctctcctgtggatccaaattgtaccaattgaaagggggaaaagggtcgcttcaaggcaccccaactttagattttttagtagtctgaggctcttctcttcagcttttgctgattgtttgctgtcgttcctttataaaactcttcccagtttttgaggata

SEQ ID NO: 72475 - DNA, 1042 bp, Homo sapiens
gctcctccgagagtgcggcgacctcggggctccgccggcaccggaggtggctctgagggcagggacgtgttggacacgctgactttgtaggctccgccaagaggcgccgcaggaggtaagacggcttcgggcgcgcggctctgccgggcgggcgcgggcatgggctgttaggtagaatatcgggaggatttgagtcccagtggactgcctcggggcttcgggatgtccagctcccagctgcttggcctctgcttcccccgccggtggaggctaccgggtgctcacctgttaggtccgtgcgcccgctccctgcccggcggtggctctgcgccctctgggccacccggcaccatcgcttttgggaggacatgcacgtggtgttctcgcaaaaggccgtttccagccggaagcctgcagggaggtcgccttgtaacttcacccgcgctcccagctcgcggggcctggcctacaggggcggccgtgggggtggcagagtctggggagcctggcgcggcggagccctgtaacgctctgctccatcgggtggcgtggctggtgcctccggggacccggagcgatgcggttggagagcttagtttagaaagcaagtttctcttggtaccagcggagtctcgtcccaggggaaagattttgggacccggtgcccatcgtctgtggactgcagggaatgcattggcggagttggtttggtcccattctgtgcaggaggtgggggaattggtactccagccccaggcaggtagaagcccgcgctgctgccagcgtcagggggagctcgggtgacttgggctgggccacccatctgactgcaaggttacagagcttgagcaaatttcccctccctccaagtgcaggaaaaccaaaccaaagcaagcaaacaaaaccctgtgggtcatttgcttcccagcattgcatagggatgtggataaatagaataatactgtgaatttattcagctcttgttcccatggcttcccatagccttatattatgcacctccccctgccagcattttctctgt

SEQ ID NO: 72476 - DNA, 1077 bp, Homo sapiens
gcagcatagcaagaccccatctctaaaaaataaaaataagaaatcagctggttgtgatggcgcactcacctgtagtccaaggtgctcaggaggctgaggtgagaggatctcttgagcctgggaggttgagactgcagtgagctatgattttgccactacactgcagcctgggtgacagaacgagagactctgtctctaaaaaaattaagttaaattaaaaaagaagactactgccagctgtctcctcccgtgcattgagagttccgtttcactttagctggacagatctttatggtctctgttagctgtgtgactgtatgagtcttatttatatccatttcattatgtaatcttaaagccttgtccaaacatttcttttttagtctttatcttcctaagagttggaggcaagtagtatttctactttacagatactgaagcagagcatgcaccttgatagctgaaagggactttatattctacagatgaggaaaccgtggtccagggaaataaaatggcatattcaagggaaagcagcaggacaaagttggctctaaggcttctctggttcagggctcaatgcctggccctatagcttggtaggttgacctctctgtttgctgctggaagcaacaaagtttctttccccttcctttcccttgagctaagaggcattggaaggtttcacttagaaggggaactcatcagtgctttcctttcttttttgtctgaaaactaaacatttaagaaatgtttgcctatgagacatgtaatagcataaatgggatcataacatcacagtggtataaattcaaatgttttagaaagaactatcattgttatttctaaaacaccaggaatgaacaccaaatgtacatggttttcttgagggaaactatataatacatggcaatttgaaaatcagtacctggaatgtttaattgtattttacatttgtggagagaaatgcattggtacaaagtgcttacctgattttcctcatctttgcatcacaaatgaaagagcagtaaagggggagcatagagtaggttgctgtttttctgttggcctctgctg

SEQ ID NO: 72477 - DNA, 1091 bp, Homo sapiens
acaacagcaactccgaaaagtataggtttatatgattcgttgttgggaacagaagagtgttctttgatgggattgttttaaaagaactggaatgtccagtggccagttacacttgcatggttattctcttccctctgtaaactcatcagtgcgggattcagaaagaacaagcatggaacacattcctccatgccccttctttctgaatcctgcagtgatgagtttacagaaggaagacaatttgcatggaattttagttggaaatacattttcccattcgaaggaccctacaacatcaaacgagtgagacgttcaacagccgctgactgctcactagagctgggtggttttagatccccaggaaatggctgtcgtgccatctgagcatgaggcacttggaaagcagtgcccatcactgcctcatgtgttcagcgctgtcatttttcaagagacgaaggaagatggtgaagtcgtgacccttgtctcagaacatgcgggtcagatctgacaacacctgctgcttccatggggagggtggagtgaggagaactggtgctgggaatgctgatgccatcacacgtgtctcacgtatggtttcctgttgaatgacagtagccatgtcctacttctctcccacctacagtgtcctgcagatgacagtgggagtgccacaaggatgggtgaatggagcagcatacagggctgataattacaaatggcccaacaaggaggtggccacgtgtgcttgctggtgccccactgggtcagctgtgctgacttccacatgttcagacagacttctgcatttgtccttgtatcagtggtgaggtttggctattcaagaaaaagcctgtaagataattttgaacttgcagattaatggcatacccaaacctggtgattggttacgtgaataacaaagttttggtgcatagatgagtttcctcagctggaggaacgttgggaaagtcaacatctgacacagaagaggcagaactggttggcctaagaaaagcatagggatttgaaagttaaggcagtatataattgtatcagcaaatacctcaaaattcttatttatcagtgtttta

SEQ ID NO: 72478 - DNA, 1020 bp, Homo sapiens
tgagatggagtctagttctgtcgcccaggctggagtgcagtggcatgatctctgcttactgcaacctccacctcccggattcaagcgattctcctgcctcagcctcccgagtagctgggattacaggcgcccgccaccatgccagctaatttctatatttttagtagagacggggtttcactgtgttggccaggctggtcttgaactcctgaccttgtgatctgccccccttggcctcccaaagtgctgagattacaggcgtgagccaccgcaccgagccaccttgttttgtttccagactcactggactaaatgtcaggtcctcccagcctcctgcccactcctgtacaaacagaatcataggaagtctctttataataaagcagcaagcctatttcaggtacacatgtgttttgctggatgttctaggaaggtgaaaaagagtctagaggtctccaaaaccctttgccattaaatccttcagacgcagttaataaaatccataggaatctcccacagaggcgttgttgagtttggcttgggattactatagaggtatgattattaatcttcattcttgtggcagtttacatcagtttctagataaatgttgattggaatttaaaactctatgtatgttcaagcaaggaggtgagttttgtttggtagtctctttttctttgtccttgttctttctgccaagtctgggtcgtcctgtgagggctatcccacgtgctgccacgaggacatggaaactagtaaagtttctgcaggtcagcaaagttagatgagtaccaccagcagcaggtgtcagctaataagcagagggcatttcagactggtacctcttcctcaggggtgatgcaggaccttttctgctgttgattaaaggattgtatttttagaatatatattacatattcttagaactataaaatctttttttttttttttaaggcagggtcttactctgtcacccagtctggagtgcagtggttcattctttgttctcttttcagg

SEQ ID NO: 72479 - DNA, 1084 bp, Homo sapiens
attcgttgatacatctaagtttatccttgccttttaaaagataataggtaaggatatattaccttgttgtgtgttgtgagtttactttttatcctaggatttaagtgcaaaaggacgttaagaatcctgggctatggaagagcttgatcttcctgcctctgagccccagaaccctcttttgtttgcagagctaaacagccacaccgagtagatggcccagcagcagtaaatgtggtgcccacagtcgtaaaggacagttgattctgcagggaacggcccgttcctgagcctctcctggaacgagtgtgtgcttgggcgctttctccaggttggatgccagtgttggcctcagagacctgtttgctttctttctttccctttttttttttttttttttttttagcttcacttgtactttaaggtacaatattagaatgttcctgtgactttttttttttttgtatttgtagatttgggataaaaatggaattaaaaagcctgaagggagcgggaggagggaatcttgcaaaatacagacggaagagagtgagaactgtcttattagatagtttttttcttttgttcttcatctgtttttgcatttattatttgagataagaaattttcattaagcaaaggtagtgaaacactcccaggagcctggaattacgttatgaacacggcttagtttgggaaataaaaatggcatcatacggaagcattccacttacttgcccaatttaggagtggagaagtcgacaagcaaacaggaaaaccctaacttaggaaacagtatgtaattcctggaattatggtgagattttttttttccctcaagttttattttaagttcctgggtacgtgtgtaggatgtgcaggtttgttacataggtaaacgtgtgccatggtggttggctgcagatcatcccatccctaggtattaagcccagcatccattagctattcttcctgatgctctccttcccccatcccctccctccccacaggccccagtgtgtgttgttcccctccatgtgaaatgatgggatttttactgtcaagctttctgaagttgaagttgtct

SEQ ID NO: 72480 - DNA, 1051 bp, Homo sapiens
gttctttgcagcactattcacaatagcaaagatatggaaccaacctaaatgctcatcagtaatagactggataaagaaaagtggtatgtatacaccatggaatactatgcagccataaaaggaacaagatcatgtcctttgcagttatatggatggagttggaagccattatcctcagcaaactaaagcaggaatagaaaaccaaatacagcatgttctcacttgtaagtgggagctgaatgatgagaacacatggacacatggtggggaacaacacacggtggggtctgtctgagggttggggatgcaaggagggacagcattagaaagaatatctaatggatgctgggcttaataccgaggtgataggatgatacgtgcagcaaaccaccatggcatacgtttacctaggtaacaaatctgcacatcccgcacatgtacccctgaacttaaaataaaaatcggaaagaaaataaaatctgttccagtccccagtttcagttcttttgggtatatctccagaagtggaattgctagagcatgtaatagttctgtgtttgagtttttggggaaccaccataatgttttccacagtggctgcactatttcacatttccaccaacagtacacccgggttcgtttctccacatccctaccagcacttgttattttctgtttttttaaggtaacaggcttctaaatagatgtgaagtggctagtgttgttttttatcaagacaaatcttaggaaaagaatgcagtatttgtgtgacttgtaaagataaactatgcaactgtaaagaaatgttcagcgttcagtaacctgctacctctgcgcatcacccaagatgcagactggctatcctgagccatcagggaggcagtcgcagtggattaggaacacagatgctgtggccagactacctggtgtaggtggtggccctgtcactttctatggtgtgatcttaggacctaacctcagattcttgcatctgtgaaatggatgtgataatagagggtagttgtgttgagaatatctggcgtatagacat

SEQ ID NO: 72481 - DNA, 1297 bp, Homo sapiens
cctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtaagggcagcggcgaggtccctcatgtgggcgaccctcctgcgggaagggagcttgcacaggtgttgcccttggtccctaacctgtcaaggtcagtggccctctgctgaccttgttgcccttacagtattagtgggaatgggagttgtcaagttgctgtttaccaagttcagaagtaatctctatctcctttgaaataaattgacaatgtacgagattcattgagatgacatttgccacacctttcattcaaaagatgtttattgaacatgtaccaggtactagattctgggggaaaaaaataagttgtaaacaaactgtcttctgctccatgcagctctgactcatatctttcttctttgtattttaagctgtttctgtaacctttcccacaaagtacatataagtgaaattctttctgttaagagactattacctgtcctaatgtcacagcacctgtgggtgtcacttgaccagctggaaacctctgtgggctggcagtgcctctgcttgagttttgc

SEQ ID NO: 72482 - DNA, 2114 bp, Homo sapiens
gacttgcctgagattgcactaggtcttgggccagacacagtgactgaacatgtctgctcgattcccagcatcatgtgcttttctggtacattgtgttgcctctgaaaaattatctgaaaaaattagaaggtgatgcctcatttaggatcatagactcttgagctgtgggattgtccagtccaaaatctgagatccagaaaggtcagttgtgacttgtcccagctcacaccactagtgagtagcctagtctagttctttgaatcctcgttcagtgctcgccccatcagactgctgcctggaggctgttggtgggagccagaggctgctcgagtgttgggtcctgacagccctggacttagtcctcttaaagcaccttctatttttaagtagtgcacgttattgaaagaagtgggtagaacagcagtggatggcattacccattcatttcttctcctggcaggtctttgggggacacctatgatagttataaagttcattttactaattcacgatggtgctgattttcttttttttttttttgagaaagagccgtgctctttcacccaggctggagtgtggtggtgcaactgcaacttttgcctcccaggatcaagcaattctcctgtctcagcctcccaagtaggtgggactacagacacgcgccaccgcgccccgctaatttttatatttttggtagagatggggtttctgcatgttgcccaggctggtcttgaactcctgacctcaagtgatctgcctgcctcggcctcccagagtgctaggattacaggcatgagccaccgcatccggccagtgctgattttcttaatgccttttatcatagctcatcattggtcaccaaaccactatttcaattatggttattgaaatatcagcctagaatcagcctattgaatcagcctataagaatagatttggttattttgattaaggtttggttgtgtcttcatgttctagtacacaaataactgttttaataaacaagtaaatcaagaaaacccgaggcacggctgtggtggtgagagggaatgtatggcttgttctttctttaataccttcctggatattgagctcacctgacctgttcgcatttgaaaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaagtaagatctggtgtgcacttccccaagccagcagaggccctccagcttcctgcctctattctgtctgcacactaaactggatctgctttttctctcccgttctcaagggcggcaccatgtacttaaccaccttttcttcctgactgtgtgaaaacatgcatgaattcaaactaaccacctgacgtttggatgccttttgctaatctttctttcctgggatctcaaataatacatgagactcatttgctgtttgtttctgaataacctgagattctaaccagggaaaggtagcagggcatatttagtaagactcctgaaagaagtaattgttgaaaaagacagtattgttcattgttaaaatgtaaagataaaatgtaaagaagaaataaataaaatgtaaagaagaaatagttttttaggagatgagaaagtattttgttttccaccattttcttattttttttttgagttgcaactttgcaactattaatagtttgacaatggattaaacacttagtactggtttcttagtatagtttagtaattcaacaaatatttatccgggtatccagtgagcactttgaaaatacaaaacatttaattaaagaccctatcttggagaagtgtat

SEQ ID NO: 72483 - DNA, 1090 bp, Homo sapiens
tggtggtggggccgcagtgaagataaggaagcctggttccccgcgagcttcgtcagagtaagtgtggggtgcttgcagcttttccaaagtacctgggggagctgcaggatcctttcaggtcagaactcgccttttatcaggtcagctcttttgtaattgatatctgacatgcaagtcacacctgtaagaaattaggctgggtcggagcaaaaatgttaaaggcaggcaagcgagttgctcggtgtttctctgtggtcctcgtgcctgctggcatagccgcagccctgctgaggccatgagactcaggcgagggccaggctgccttcctaacaggtcacaggaaagtaggaacctgggaggtctcctgcctctgctccatgctgccctcccctgccccaagtcacctgtcccctgtatgtgggttgcagttgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgaggtgggacgccaggctgggacctcactgagggtcacagtatgaggctgcatgaggtgcctgggctttctccccacctccaccccccgcccccccatcaggctcccacatgtatgctcatttctccgcctctgctgtctgcactgctaagtctgagtgctgcggctgtcctagctgttggtggaggttttttagagtcagggtctcttttcagagacaaggcttttcttagagatagggtcttgctctgtcatgcagactggagtacagtggcgtggtcatagctcactgcagcctcaaactcctgggctttaagcagtcctccctcctcagccccccgagtagctagggctacaggcatgcatcaccacacccagctaattttctaaattttatatagagatagggtctcactgcgttgccgaggctggtcacgaactcatggactgaagcacttttcctgccttgatttctcaaag

SEQ ID NO: 72484 - DNA, 1949 bp, Homo sapiens
gttttttcaaaataaaaattagttgacatgacagaaagtccatttccttgtcttaagtaaaacaaagcaaaaattcttttaaaaaaaccattacaatttagttttgtccagaaaaacttattttgcgaccctttcttcattgctggaggcctctttgggggctctgtgcccattattttggcagtccctggtgtcattcttgctcctgctctctgcgccacttctgggtgtgaatgggcgtctctgaagacagcagggtctgcttggtgggcagtgtctggggacttcacaggagctgggatgaattgtgtttggtaaatagacaatagaatctgctttcaaggctttcccatggctgcgcaggaggattctaattcattccagctgtgatggagtggccctgtctgtgctgtaagttgccacgggaaagcggaaaatatagctcattagctggatggttggtctccatggccccgcattattaacgctgagcaaaacctgaatgggaagcttgcagatactggacatgctctgtgctagcctgtgtgtagattaaaactgtagtttctgcttttccggtgcctacagttttagcgggcttgggagcggggccctcctggggagaacattttagcttgacgtgactgtggtggacggaaagcaccagaaaggaagatctgttggtgaggcgaatgccatactggcatttccgtaactcaccacttcaggtgcctgtcctctcctgtcctttcccgaacagcataaaagatgaagactcagagcaaatagtcactgttgaaaatggttagtgatttttaaagtactttatgtagcaagagtggttatatgagaatcagagccataataaagactgttctttctgtattaatgaaagtcacccattgtcaccgtgactaaaacttacttatttgtggcatttactgtcattcattgtaatttctgggaaatgagtgaaaacatttttattccaaagaattctgaattgcactgggtcagctcccttaatctatggcagactgtagtctattcacaagggaacaagaaaaagggaaacagtggctaatgacgtaaatgtcactttgtctagagcattcgtatacgaagaagcgccccagtggattattttgccagtcctcatttgtaaggtgcatgttatgtgattaaaattaacctcccatcttgcagtgattacagcaacataaaggcagcatatgaggccatgaagaatgtggcctgtctgatcaacgagcgcaagcgcaagctggagagcatcgacaagatagctcgctggcaggtgtctatcgtgggctgggaggtaagtggaaagcaccccacatgatcccatgccactcgcccttcccgcacctttgatctggtgcagatgcactttaatatcctgtggtcaatatcttatattcttggctttaatggtacatataccattaatggtaaatgtatttcgaggcatactgttgaatttaacagtcgactactttataccccactcccataagaaataaaatctgaagagtatctgcagttaatttattgctgagcctctctctctcctcgtagagggagtaccgtgggaacagtagagggcatttcagttgcagccacataacatagtagtagaagtatgggggactctggagtccctgcccacatgtgaatcctgtatgatctggccaagattaatttttttatcttataaattggggaggaaaatattacctacctcataggctaccgtgagcattttataaaacagtacaggccaggcacagtggctcacacctgtaatcccagcactttgggaggccaaagtgtgagaatcgcttgagcccaggagtttgagactagcctgggcaacatggcaagaccccatctctacaaaaagtaaaaaaaatcagccaggcatggtggca

SEQ ID NO: 72485 - DNA, 1098 bp, Homo sapiens
ttaccacatgtctgaatggcactgatctgagccatttgtacatatatgaactcatttaatcctctacaccatcctatgaagtaagcactattattatacccatttaacagatgggaaaactgaagcacagaaaggttaaataacttgcccaagaccacacagctcaaaagtagcagagctggattcaaacccaagcaggcaccctggcttcaaagtccgtgctggtgatcactgtgctctaccgccattaaattaagaacaacaagcagatgccattcagattgtttttagaccaagctacattgattttacatctattaattggtcagaactcactctcccagaggactgagaaagtttggagcaagaagttaggtttttaactgaaataggctataggtggtgaaaattggagagaaacacatacatttcaagggccttatagacttctggagtttgggcaggatctctgagaacactgagtccaactcttttatttcatcagtgaagaatctagggcacggaattgctctgagcaagtaaatagaagaactattttggagtcaggctcttttgcctccaaaaaatattgtgtgtgactgggattaagggagaatcaaatcttatttaacaaaggccattgtcataccaaataccataaagtaacattggattagattcaacctaaatataataaaagtgtgtttttctttttgattttggacgctgacatttaggggataatttgtcagaagttaatttcttgctgacaatttatcgtctggccttttgtttctatgaccctgaacaagttgcaattccagggagctgccatatactcaacgcaaataatgtcaggtccataatcacgatactgtgtcccctgcatgaatgctttctcccatgtaagcctgcgtgctctcactcttggaggctccgtttgggtcagctgctgtttcagatcttgactgggttccattaattcagcatgcctcttaccagaggcttcaggctaggaagacccctcagctaacacagaggcactgtcacatttttctagtaagcaggaaaaaaaaaagaaaaggaagaaatttcagg

SEQ ID NO: 72486 - DNA, 1058 bp, Homo sapiens
tgggaggatcgcttgagcctgggaggtagagattgcagtgatccaagatcacaccactgcactccagcctgggtgacagtaagaccctgtctcaaaaaaaaaaaaaaaaaaaaaaaaaaaaaagaattagctgagaacttggacttggagtctcagcatttttatttttttcctttctggttaacaagcgaccctcagtccctgttccatctctctcccctcccgagtcaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctg

SEQ ID NO: 72487 - DNA, 2873 bp, Homo sapiens
taggtatcttttcctgtacagtaggatcctctttgaatttcccttgtatcagtattgcccattcaacattaacacactgtgggcagtttaatcacaatagaatttcttcagtaaaattagccgggtgtgttgggacacacctatagtcccagctacttgggaggctgaggtaggaggatcacttgagcccaagaggtggaggctgcagtgagctggtgccactacactccagcttgggcaacagagcaagaccctgtctcaataatcatcatcatcatcaaaataataattaagaatttcatcaataggtcaccattgtgaacttcaatgtggacatgctttttgtgaactatgcttgttaatgactgaagaatgcaccacaattatatgccctgattgtgaggtaagtgttataatttttcagatgaaacatatcacaacctaatgttaatggtaaaaatactacagtagtaaaacgtacttctagttagaaactaaaaagttggccgggcgtggtggctgacgcctgtaatcccagcacttttggaggctgaggcgggcagatcacgagatcaagagatcaagaccaccttggccaacatggggaaaccccgtctctactaaaaatacaaaaatttgctggacctagtggtgcacacctgtagtcccagctgctcggtagcctgaagcaggagaatcgcttgaacctgggaggtggaggctgcagtgagccaagattgcaccactgcactccagtctggcgacagagcaagactccatctcaaaaaaaaaaaaaaaaccctaaaatcttgcatttttgctgctgaatctttaagcaaagaaacctaacaaaagataaaactttttctatccattttataattgtgtaaagtgatcaggaaaaataaaaggcgctaaagtcatacacttatcggcctacatattttgattctttggtgacttctgtggaaaattatgtcttttgtttattttaatggtgtatattcctttaaaaaccctagcccctgttttacccaccaatccatgcaaccacattttgaactccccccctgcccctcaacctttgtgtgtcatcaaatgtacatttgggagatgccattctacaacaaggtagagaagcaaaactactgcctaaaatttttacttcagaagccattaagactgaaatctttccataagaatgagaacaaattaaggatgtaaaataaaatttacttgatatcctattcatttaatacaaatataagtgtagttcagcttatataatattgttcctggaaagttgactcaagctgtaaattcctttttttttttttttgagacggagtctcactgtgtcccccaggctggagtgcagtgactcaatctcagctcactgcaacctccgcctcccaggtccaagtgattttcctgcctcagcctcccaagtagctgggactgtaggtctgtgccaccacgcccgactaattttttgtatttttaatagagagggggtttcaccatattagccaggatggtctcgatctcctcacctcgtgatccgcccacctcggcctcccaaagtgctgggattacaggcatgagccaccgcgcctggccaagctgtaaattcttgatgttttactggataaatcagatgataaggctttgtatcatttgttttctgtggaagtgtggcaaaccctatggaggcatgagatctagaatgcagttctcattctgtcagtctagcctgggtttcctcatttgtgagatggatataatacctgctttgtcttatctcctaggattgctaagaatcaaatctgaattatgtaacagttctccgtaagcttccagactactaaaataacccttcattatttaggtttgaatgaactgccttgcaagttaaatatggttaaaaaaaacccaaaccatatattgtaattaatgaaagtttaaattataacaaaaaattacatattagtagctgcctattttgtgggaaattcctaacctcttcccttttttttttttttttttgacatggagctccttagacgtggctggctatgtgggtaagacgaagtgagccctcctcatgtggttgtggtagtagatccctgatggattcagtcttgtgggtgaagattaagtgaagggaaaggaaaggagcaggcagctggaactgtctgtgtccatatccgtcctgttctaatattaaaaaaaaaaaagacttggcaaatgatttcacatttaatgttcttaaatcattatacttgtactatttttgggattttggataatgtgtaggagtgtttataatgtgtttacaaatactaattttgattttaaggttgtgataaatctattttgtatcattgactagttttgctctaacttttagagataagtgacctgtcccatcctccgttcctattcccccatccccacacccacctactgttagccgaggtaattgacaagtgactatattcacattcttcagacgcactggtgagctgggccctattaaaggaagtcattcaagaaaccttcctgaaattgttatcactctttttaaactttagatttgtattattacctaatatttatttggaataagatatacagagaatggaagaatctagtttaaatttagtgaagtctgaatttatggaatatttgaggaatgtagtttattacatttcaacaaggtatctactctaaaaagtaagatttagattcctgtattcacgttagacttataatttatctttaacttcagaggcctaggtaatgctgtttacttcaaatgtaagcctaaaatccattcaagattaataggtatccttttgttcttatttctg

SEQ ID NO: 72488 - DNA, 1085 bp, Homo sapiens
agagttttgaacatatgttactattttttttttcactttttttgaaatagagtctggctctttcacccaggctggagtgcagtgatgcaatcttggctcactgcaacctccacgctctgcctcgccaggttcaagcaattctcctgcctcagcctccctagtagctgggattacaggcgcctgccaccatgcctggctaatttttgtatttttagtagagatggggttttgccatgttggccaggctggtgttgaactcctgacctcaggtgatccactcgccttggcctcccaaagtgctaggattacgggcgtgagccctcattcctggcctaacatttttaaagtaaaattgaaagtattgctagtatttcctttacagttatggtagaatgaagtgttttggttaattaactaaaaattaattaatagttgccaaattcgtgattgcttccaaaaattaaagtgggtcaaaaactcatataagcacggttttctccttgatttacaggggatttcaggatctttaaggttatcattaactttatgaatagcacacttaaatagttgtttaggttctggataggcataatttattgggtgactttgtttttttaaaccttattttgtcctaaggttgctacagctgtaaatactagacaacgctactacccaatggctggatatattaaggaagactccataatggaaaaactgcagcctaagacgtatgttccatgtgtacttatttgagtatttaaagtcaatgtgttactgaaatagttttagaattattgataaaatgtcatccttaagtctgcatttctaacctactgtttatggaatgctctttaagttcatacttcatcttagctgtcagtggaatggagacttcagctctttaaagaagcagcgtttgtttgtccttatttaaagaaagaaaaaatgttaaggattaccacatcaagaaaggctgagagtacactggctaaagttactcgtgctggatggaaggaagttatagagaaaaaaagtaacttagttctctcttgattctttttaaaaatttttaaaattctaagttt

SEQ ID NO: 72489 - DNA, 1020 bp, Homo sapiens
ttagctgggtgtggtgctgtggtcgtgcacacctgtaattccagttactcgcaaggctgaggcatgagaatctcttaaacctgggaggcagaagttgcagtgagcagagatagcatcactgcactccagcctgtgcaacagtgagactctgtctcaaaaaaaaaataaaaagaaaaaaaaatcattaatgggctggggaaggggagaaagcacttaatcttgctgacttttccttcaagtgtaaatcttaatggagtcaaattataatctttttttccttaagaactgtttataatttttatatgtatacatgtattgccatgataaattgttcaaggtagttttaagttgaaaaggtaattacagggcattatcccatttaaaaaaatatctttatgaaaaaaatctggaatggtctaactaaagctctaaaatatgaatggtttttatctccaggttagcaggattgaatgttatttttgttgcttgttttcacttttctgtagtgagtctatgttgcttttgtaaccaaaacggtagcctgaattttttgcaactataatatatatatgtctaggcatctgttttttagttttatatttgtatgtgatttccctcccttcttaggacactaatactgcagaagaaattgatgaagcattgaatacagcacaccatagtttcgaacagttaagcattgctggaaaagtaagcactttgcaggattaaattctatcatgaagtgaagcatgtcctctttaagtgtgtacatttggagatgttaccactgaggttagagcttagcactgagttattaagcatgataatctaaaaaagaatggaaaacttttcccatagcctgccaagattggtcttgtaacattgttgtgctaggaacttaataaaattccagctttaataaggaaccatgacttctccttgctatgagctgaattttgtctcagaagcattgcagattatcttttcaacatttgctgattgtttggctgtatccccctt

SEQ ID NO: 72490 - DNA, 1107 bp, Homo sapiens
gggaggccaaggcaggaggatcacttgaggctaggagtttgagaccagccggggcaacataatgagactttgttcctccccaccaccaaaaaaaaaattagttggacatggggctacgtgcctgtggtcattgctactcaggaggccaaggcaggaggatcccttgagcccaggagttcaaggttacagtgagctatgctcagcctactgcactccagcctgggtaaccaagtgagacctggtctcagtaaaacaaacaaaaagatatggtcttgctcacaaatagtaaaacttaatgttgaaccttgtgacttattctatttatattattatctctttacctcttgtgttattttgaagagtctagaaagtaccttttactttcaaaattctacaacttctacaaaataaaaattcccaaattaagtttttgtcttgttttttttttttccaggcacttgaacacatgcagaagcaaacgatagaggaaagagaaagagttatagaagttgtggagaaacagtttgaccaacttttggctttttttgattccaggttagtaacttaaaaatatggactcaatgaaactgaagtttctaacactaacttgtcattgtattcctttgtttagaatggtaatgggtaacttttaaacaagtttgtaatgggtaactttcaaacaagtttggaagttggtagtccctacagactgatctttagaactgcaaaatgaaaaataatgtgtaagcttttaaaaattttgcctatttaccttctggtgctgaagctaatggtggtttgtttgagacagggtcttgctctgttgcccaggctggggtgcaatggtgtgataatagctcactgcagcctcaaactcctgggcttaagtgatcctgccacctcagccttcaaagtagctggaactacaagcccacaccactacatccagctaattttgtgttttttttttgttgttgttgttttgttttccgagacaagggtctcactacattgtccatgcttttcccaaactcctggcctcaagaaatcatcctgcctcagcctcctaaagtgctgggattacaggtgtacataacggtgcccagc

SEQ ID NO: 72491 - DNA, 1025 bp, Homo sapiens
agtggttgtgtgtgccctgagccttgagatcagcctgaggtcaggcttaagatcttctcagatgttttctgagcatgcatcttgcctgggcctcagtgtggctttttcaattcccctgtatatataactgcttttatatgccttaatgtcctaaagagtctgagctcagattctcctccaggccttagatggtctattgtatgtctctacttataatctcctgccttccacaaaatttgcttttctctaattatgtatacatagcttttaactataatacatttcagttcaatttaatgcctcatttaccatgttatatgttaattttatcaacaagtgaaagtaccctttcagatacagttcagttactgtttgcctcatttaaccatattatgtaaaattcatcaactactgaacttactcttcaagatactatagatcgactttttctataaatatttatgaaatactgcaaaataactttggaatcttaaatgaaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcaggtaatttaatagttcacaatgtgagttatttctgtggtagcttattttacatgctttggaatatatttaagacaagaatttgtttttcagattatcctaacctatattattatttagaattctaaattgatgacaatataggttaggatagtctaagttataataaaataatgtatgaaatctaagacaaacattgtaaaatttatatgaccttttgttttttttgaccagttagggaaatggtgcaattaagtctttgtaacacttgatctgagagcaagtaaggtgacattgaggtgaaagtttaggtttctaggacacccgattaaaaaaatgaggacaaataagggtag

SEQ ID NO: 72492 - DNA, 1045 bp, Homo sapiens
tgtatgtcctctgttggaagaggcagataaacatgcatcattgctaaatccagttggctttgttgatcgttatttccacagtggcttcttaaacactgatctgtgaagaagctaaatccatcatggaataactaaaatataaacttcatgaaacccaatcttatctcattgtaaaatttctatacttgtagatttgatagcctaaaaactgtctggatatgtggagaaaatagaaaaatatggagtagaatggataaataactggcagtgggtcagtggctattgaataatcatgcccaaaagattcagattaatgtccatggtgggagtttctagtgacttattcatggttgtaccatatacctctgtattcatagcttatatctctgtatttttaaacagatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagtaagttaaaatgtaaaagcagaggggaaagatcttgtatctgtaattagacacagttggtacctttttcgtccatgcatttaacagaaatataattgctgttataatcttattcctcattatgagttaaaacctgttcattccatgcccctactctcacattttccagagttaggataatttttatttttaatgcagtaatatagctaacctctgaggtataaattaatatctggtttaattagggtattttgagattttttagtgttctcacatataagccttgtataaaagatataaatagagagatgtgatttgtggacatagttttattactt

SEQ ID NO: 72493 - DNA, 1402 bp, Homo sapiens
acagtgtaattatggtaattaatttgcctgtctctcttcctttcttgagcttcttgatggcaagacagtctcattcatctttgttcttattgctcataagctggttgtcattaagtgactgctaacttagtattctttaggtgtttatctccctatttagcttgtttctgtataacaaactatcataatatgctgtattatatctttcttatagcacttgaacacagtgctatatcatcattaaataaacgaattaagactttttcgtggtagaactaacgtgtctgtaaacttatgaagtggcttttattgataaatgtttataacgatttgtttccctcattatttaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactgggtatgatattttataatatgtatccttggcctgcttagaaacattttggagggaggtggagttaaagaataaaggaaattagaggtagagaggagtaatttgtcattcttaacttccaagacatacgttttattattttgctctactgttgtcttgataagtaaaactttatcatttaccagtattactagatggagagcttagaaaaggaactccaaacttaagtactcttcttatgtcactttaaagcagggaataatacacaaactaattcttttaaatgttacagttagcaacagatgattgagttaaatttttaatcagacttctgtaatttcattaatgtttttcaaagtgtcatactgtctaactcactgtaggtattttaaatggttttctctgtcttctaggaaaataatacaaactgatatgtttctgtagtaaggaccagtattaaccatagcatgatcacttaatggttatagctttatgaataagtagatttatatggggggaagtgtcattatctcctttaagttcaaactgcatgagtatgtgaaagtgcaaatgtagctgagatttctttctgtggaggaaaactgtctctgcttataaaagctaaactaagtctatatagtaagaaagtattaatttggactataactttctaaaaggtgtaacttaagaaaaattatacttagaaatgcataccttctgtgggggaaaacaaatttaagtttgaagcattattttcaataaatattacttgaatttctcctagagttgttgatacccatgtgagaccagaacactctgctaagcaacatattgcactaaatgatttatgtctggttctaaggaa

SEQ ID NO: 72494 - DNA, 1067 bp, Homo sapiens
ccatgatagcaccactgcactccagcctgggtgacagggtgagaccctgcttacgcttttcattatgcttttaattaggtttaagtcacaatcactaagaagtcactttgaaaaaaatactactttacactatcatccacctattttgcctaaagaaatgacagatgtttcagtaacggtttgtcatataaatagtcctggagatttctatcttcagttggtaagtatataatgtgtttttgaaatgaagtttttaaaaaaattttaattagacatgtataacaagaatgagtatctaccgtcaattttagtcagagcaaacgtaccactgttaaccttctatacgtttaaatttcttagtagttgcaacttcaaacaagtttatatgatttatcacaaattgaaagaacaatgaaggataattaatgtataaatgtttcttgctaccttctgaaatctggagactaggaaagcatatagagttagcaaatagaaatataatgataaaataaatttttttctaacctgtacctctgaaaatttaccgattattattaggtgttttctgaatttgaacaccaaaatagacacagattaaaggcatttcgtattgaactttggatgtgtgactgatgtgtttagatagtaacaataatagttcatccttattgatttctgggtgctttatatgatttaactcatcataaggcccttaagactttaagggaattaactcattaatctttgcaacaatcctgtgagaaagacactgttgtctccatttgaatgtggagaccctaaccacagagatgaagcatcttgcccaagatcacacagctctgaaagggtagaaccaggattgaccaagcttcagaacttgtcgtctcaagcactgcatcacactgtagtggctcctcaaatgagttgtggaagctccttatctaagttaggatttgcgtttatttcttttgttgattttttacagcgtcttttatggtaaaatatacataatataattttatagtttttaataattgttcagtgtaccattcagtgccattaaggcc

SEQ ID NO: 72495 - DNA, 1022 bp, Homo sapiens
cgaatcctccaaaaacatctcatgaagttagattatattggtatacccgttttacagatgaagtaatgaggcttagagagaaaaagtaacttgctcagggtaatatcttagagatattaattagcttgctttaggtcacatagaattttagtgacggagctagtgttcaaaactggtcagtctgactcaaagcctgattcttaacttttaagtcataccacctgccatataattttgttatcctgattttggctatcctttgaatatttaaagcatactagtttttcattcttataagtctgcactatggatgatttcggggttcacatatttgaaatattttttacattttaaaaagtattaagtttgtatattgaagctaaaagtattctaatctagttggccataaaccaatctaaatttttctagataattctgtttccaagtttgtaatttctaatttcataatttttcaaggattgcctggacatcaggaagttgaagttaaatatgtggactttggtaatactgcaaaaataacaatcaaagacgtgcgtaaaataaaggatgagtttctgaatgccccagagaaggtaatttatttattatgaattctagggctagaatatcagcacaaatatggaagtatttttagaagctattgtcatcatagaaatgttagtgtccctttttgtctagttgctgatacagggactatagataaatgttgctgtggttactattgaggaaataatatgtatatcatggcaaataagcgtattaaacattaatcaggtatagttgtgtcttaagtacttgttggcagcttttaatatatcattttgagatcatatattgtggtaagagtcacgttcatgatatatcaagttaaaaatgcttatctcagaagtacttctactgtgatcatatttatacttaagtatatatgtgtgtacaatagagaaacctgggagaatatgtaaaaaactgaaccttgtttatctctggggaggagtagtatt

SEQ ID NO: 72496 - DNA, 1079 bp, Homo sapiens
tgtatgaaattcaaacataaagattagttttgtacacacttaataaaacttgaattctaaagtaggtagaaattaaatttttttcttaatggtggaattttgtctgacacaggcaattaaatgtaagttggcctatattgaaccatataaaaggacaatgcagtggtccaaagaagctaaagaaaaatttgaagaaaaggctcaagataaatttatgacatgttcagttatcagtaagttccatttttacttgttatgtaatcacatataattttaaataataatatgaataacatttgtcaaattttagaataaattcagtgtgccatcagtagtggtggtgagagataagatttgttgagaattaggtacaatggaattatatcttttatggactctaaagtcatcaggacaaaaatcaccataaaagatcaagtcacccttgacatggccccttgaaagccctaaagccaggaattagcttcttttatttgtttgcatttttgctagggctctgtccttgtccttaacatagtggatgctaacgtttaatttccaggaaagtgaggggaggtgggacatgattggtaaacagcttttccttgctgttttttgtctcactggcttaaacaaattcaactgtgggttctcagcataatttgaaaaaagttattccttttttagagcaattgggaccaaaatagagtctgaccactagcccacgattttgtaacataacaagttctgaaaatcaaaagttcagcagcaaaattggttctgaattggcatgaggctgtatatagtttttatctcgtttatagtgaatattcatattttacttcaagataatgtttgtgggctgctgccccagactctgctggggtattagatacatatacacgataggtgctgagtagcttttctcaattagacgaattttgaattctgaaacatgcctggccccaagggttttagatagggggattgggaatctggtttggtttttttgttttttgagacagggtttcattctgtcacccaagctggagtacaatggtgtgaacaatggctcactgcag

SEQ ID NO: 72497 - DNA, 2232 bp, Homo sapiens
ctctactaaaaatacaaaaaattagtggggcatggtggcaggtgcctataatcccagctacttgggaggctgaggcaggagaattgcttgaacctgggaggcgcaagctgcagtgagccaagatcacatcactgcacttcagcctgggtgacagagcgagactccatttaaaaaaaaaaaattttttttggattgaatcttctcctttctttttaaagtgagggttattgaagtataacttatatacagtaaaaagtcacctgttttaggtccacagttaaatgaattttgacaaaatagtcatataagtatcatcacagtcaagatacagacctgagcaaatgcaaacaaatattttgcatacagttcttttcattaacttttgttgtttttcagatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaataggtataatatatatatataatatataaggaaaatattgcatatgattttatcctttattctgtttcaaagatctagaagtcataaatgtagattttactagcaaaattattttaactaagtagtctcagctagttagaagtatgaaaataggaaatctgttggctgttttcactgcattagaatttattcattctacaaatacctattgagcacctactatatgataaccagtattataagtgttagggataccctggtataaaacatagacaaatctttgttaccatgtagcttaaactctagtagagggagagagagtgaacatataaaatttttagtgtggtagatggtgataagggaaatagaaaaaactaaagcatttagggaggaaggcacttttaggatggtcaaagaagacctcagagacagtgacttttgaaacaggccccaaagaaggaaggagggaggtaagccatataagtgtctgagggaagtttatctcaggcagaaggaagagctagttcaaaaacctgaggaagaaatacacttgtacattcaaggaagaacaaggtgcccagcttggctggagcggaatgagcaagcggagattgtaggaaacatgtagccagagaattatataagaaaaggtttggaaagttaaatattttttatctctatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtaaattacagagttaaaagtgtaattgtgaaggtgaatgaatgcattttgtatttttttccctggagttaaaacagttttcattgagtttttcagtttgccaaaaaaatatttcgaaatgttgtttgtctgtagacttaaagttattattttcttaggtcttgctgtatgatgtgggtgttgaactagtagtgaatgttgactgtttaagaaaacttgaagaaaatctaaagacaatgggaagactctctttggaatgttctctggttgacataaggtagtttttagctgagtaattttctcattattttaaatatttttaaatgcgttctcgtcagttttaattttgctaagatattctgaaattttcctaaaatctagttaattttggacttcaagagggaaagagagaagtttggagcacgtaaatttagtggcattaagaaatagagataggtgagtatgaaagtgcctagatagaattcaaaccgttgaatattaaaaattttactttgaggaacaacaaacacagaaataaattgtgtaagtttagaattgcatagaaagctaaaaatatgtaaattaccaaaaagtgaatttgtggaggattctgggaaaatgacagaacagttttagtctactggaatcccactataaaaacagcaacttggatagtaaaactaaagactacacagccaatatctacaacaaaatcagatgacaagttacttctgtgagccctcaaatattagcaggtggggtacaccatgaaccagg

SEQ ID NO: 72498 - DNA, 1005 bp, Homo sapiens
aagaacttccaaagatgggcagtggaatcatcattacaaagagactttttttctttctattaaatatttctggaatggcttctatgtgacagggcactatactagtcatcagggaatatgatgatgcacataacacatcatcattcctgttctcttggagtttacagtctagttgacatacatgaaatgtatataatgacttaaaaagtatttaaaatatacctgttttttacagctcctcaatgtagctgcagaaaagatacacataaataagttaatatgtaatatgggccctcagtaaaatagagggatgaaaaaaagataggaaaatgagggaaaaaattgtaaaaataatacgaatccatgtttaaattgttttttttactacatatagttggttcaaactatgagtgtatctgtgtgtaaatatagtgttttttgtatatttcaatattgtatgctatttttataaaacaagttgccactgttttctgttgtagaccagctggtgggagtgacaagtggacagcaacagcttgtgactgtctttcattgtacctgactggagctgtagcaactataatcttacaggtggatagtgaggtaacaagttacaagagatatgtgctgatgatctcattaatgtttccatcgattccatttattttctttcttgtagagaaaatagcagccaactatttggattttgttacaaattttgtcggttttatttcaaagtataagaggcatatatcttttcagaccacttcaaaaatattctttgctttcttttttctaatttaaatgttttattacattgagtagaattttgtaattcattttattactatttatgtgctttctccagttttatacctttttccatatgaagcagaatatatgttttgtagttcttttgctttttgtaggagaaaaaaggcacaccttggaaaatatattttgattctctaatttacgagaatgcaaaagaataaagaaacttgt

SEQ ID NO: 72499 - DNA, 1044 bp, Homo sapiens
ccaggctggagtgcagtggcgcgatctcggctcaccgcaatctccgactcccaggttcaagagcttctcctgtctcagcctcccgagtagctgggactacaggcatgcgccaccacgcctggctaattttgtattttcagtaaagacggggtttccccatgttggtcaggctggtctcaaactcccgacctcaagtgatccgcccacttctgcctctcaaagtgctgggattacaggcgtgagccactgcactcggcccagtgctatttttggatgtgtttagatatcaaaataacttgactcagctgggaatatttcttgcttagagaaatgtagaagaactgcctgtgaaatgcacattgtttatatgaagatttcattttggtgtttcatatttactctgctcttaaatcactacaggaaaacaacacaacatggccattacctgtgaaaattttctgcagagatgaaaaaggagagcgtgttgatgtttctaaatatttgattaaaaagggtttggctttgagagaaaggaggtatagacttttttaaaaaattttgacatcagtttgtgatggatgcctcagttgcgtgtgcaaatcttatgtgtgctttcaagtctgaattgcatcttgtttgctcttaaagatttataagctgaccctgaggagccagctcagaaatagattccttcagaattgctcatttcatttttcaggcatgtcagttcttgcacacttaagcctgtttactgacatacttgcttttgtaatttcccctctcctttgacatttacactgtaaaccaaagaaaaagagaacaatgtagtggataccagatctgagccctttggtatcctttacttagacataaatgtttaggctttattttagaaattctggtaggtatatacctactagatgtatttatatgaaatgtaaatgtatttatatgaaacaggatgagtagcaaataaataattgaacagtatttacgtttaaagatcctttcgggttctatgtttggagtttaagcacctttggt

SEQ ID NO: 72500 - DNA, 1215 bp, Homo sapiens
ctgcagcacttgatgatactgacaggtactgttattcccagaagatgctgtttcacccagaataggtggtggtattatggaaggataaactgaggcttattggaggtaagggaactacccaagatcacacaactaaagcagtaagatgggaatggtaactgactccagagcttaccttctatggtatcagttatggatatatatatatatatatgtttactgtggaactaatgggccaattagcaataaaagcaaaattgaaattttaatttatattgccatcatcatactgtatctaagcaacaagtagtatataacctgtgtcctattttacttagggctgtcaaactgaccctattttgaattggtagtactttcatattaagctagctggtatgtgtttagagctccttatgatgtttgtactctcaaaatataatcaaagatcataatattgtttatatgctattactagtatgttttaaaacacacacagatttttacaaaagttctgtttgggggactggtttttaattatactactgaagaaatgaagttattaaattgacaaatgatagggaattttccttaatgctttctatctttaatactttttttcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtgagtctgatattcttttgtgacaattctaaagctaaatgctatagcattaaatagtcttgtgcatttgaacacgagaaagttggattaaaacatcttttgatgaaaattgtgtaggaagatcagttatattgtacttttatttgtaataatttttcgttttatttgcaaatatatttagtaacctgaataagcaaaaaatagggagggatttgatcattggttaatggatagacctcttagttgtaattggtagccctgtttccacacatagtgttaagtaaaacaatatgttttccagtatgttaaatatctcgctagcaaatttgtttatggccctgttagtttttcaggataacgactaatttacctttccagaataatgaggtaactaacactcaggtttcagtcaaaatcttcaaaaatagct

SEQ ID NO: 72501 - DNA, 1110 bp, Homo sapiens
cactttaaacatgcatctgggaagacgtcgctgcaaaggtaacatttgagtcaacaccttaaaatggttagaggacagaccacacgggtgcagggagatgagtgctgaggcaggagcagggctaggagggaggggactgcattggcagaagagggaatggtaagaagagataggacaagatctgctgggaggcagcaacagtaattcagtgaggagcagtaaaacagtgaggagcagtgagtttggacaaaggtgggatcagtggaaatgaagagaattgctgtaggtcagcttatcagttagggacacattcagcacccaataactgtaagtgaactttattcagagttttaaagttaccatgattcctgcttttagactgtttcgagtcccaccaattttggatttttaaatgaaactttatttcttcacctctgaacgtaaccttttctttctctttgtacgtagtgtaatttattagtatcatctaaaggtgatgtatttgggaattggaattatatataactagttattttgtggtaaataactagaaaactctatgaacttgaaagtgtatattacataaaccaaagtagtagaattactcccttatagcgcgtcaaaataccaggaagaaaattctatgaaatgagtcactagccaaactgtctagttaatactatgattgtcagaagctaaatttgatatttgctgactataaaaatgtcatcaagtggagtttatttttatgattatctttattgaactttaaataggagttacctaaaaatccatgggagaaattgtctattcacctctattttgatggaatgtcactttcttattttatggcatactataaatactgtacttctgaacatactgaggagatgttgaaagaagtaagtgcactatttttctataaaaatctaaagtgtagaaaagtctagttaaaatgtcacattttgtcttacactgtgtcttaaatatgattctacatatctgatctattaagagagtctagaggacttacacatttttgctgagaaagatgaataggctgtgtcatgcattataaatgtcctgtaaaagactttaattacattaaga

SEQ ID NO: 72502 - DNA, 1094 bp, Homo sapiens
gccgcggcctccaaaagtgctgggattacaggtgtgagccaccgcgcccggcctaatttttttgatttttagtagagatgaggtctaactgtgttgctcaggctggtcttgaactcatgaactcaagcgatcctcccacctcagccttccaaagtgctgggattataggcatgagcctccatgcccagcctaatcatgttctcttgatcacaagataagtgtggtaggatgtgggaaggaataggaggtgaatatcaggaggtgtaggggtctctgggagcatcgctggaggctgtctgctacagtaattttgtccacatacgtgaattcttgacattccagaatctgaaagttttcctttcattctccccacttaggtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacaggtatacttactatatttgaatgaaacaggatacttaataaaacttggattttgtttcaatgggctgatgaccttgggctatctctaatgctgatattttcctcatattcactttacatgcatgatttcctgtaatcctcaagatacccagaagatgacttctttctcattttctagataaggaaggtgaactaagagacgctaagtaaactcccttggagaacactttcacgttccacaaataagacagcgttggaaaattgcataaagattattttctaagtttgaggttatcagtagctgaaattgcaagagttgtcattcagaccttaatggtcatcatttaaattacaagccacctacaattataatcttgaggtggaggctcaaagtatgacctgttctgtcaagacaggtcagatttctactcttttatcttttcagtccattcttcccatctttattaaatatgtgtgattctcctctgaggaaaatgtatctagttattgcggtatgtaatgcatagagatgtatttattcttgatattt

SEQ ID NO: 72503 - DNA, 1004 bp, Homo sapiens
caccctactctgctctcaaatattagaacttattccttccaactatatgtttgtacctatcaaccaacctctcttcatccccccaccccaaacacatgtatatttgcctttcatggcctcatgtaactgaaccattaatctccttgttatcttcatgagatccacttctttagctctcatatgagtgagaacatgcgatatttgtctttctgtgcttgtcttatcttagttaatataatgatccatccatgttgctgcaaataacaggattccattcttttttatggccaaatagtattccattgtgtatataatcaccacattttctttatccattcatctgttgatggacacctgggttgattccgtatcttggctattgtgaatagtgctgcaacaaacatggggtacaagtagccctttgatatgctgatttcctttggattaaaaaaatttaatgaaagacaatatgattttttccctttttctgtctttccagaaatgccttgccttgcagaatatgatgatggcttatggtatagagcgaagattgttgccattaaagaatttaatcctttatctatcttagtacaatttgttgattatggatcaactgcaaagctgacattaaacaggttaaaaataaatgtcggggtgttgaattagatttctttttttttaaatagttttcttattgagaatatttttgcctcttttaaaagaaaagggttattctaaggctgtttataaattaggaatttttttcgtgttaaagtatacataaaatttaccattgtagctttttttttttttttagatgagtcttgctctgttgcccaggctggagtgcagtggcgcaatcttggctcactgcaacctccgcctcccaggttcaagtgattctcctgcctcagcctccctagtagttggaattacaggtgcccgccaccatcccggctaattttttttgtatttttagtagagatggggtttcgccatgttgg

SEQ ID NO: 72504 - DNA, 1905 bp, Homo sapiens
aagacatccttaactaatggataaaggacagcagttcacaggatatgaactaaggaaatgtgtgatcatactaataaaattttcaattaaatattaaatctaactcttgacaattttattctaataggcaatccacctcgaagatccaagtctgcacctcctcgtgatttaggcaatttggataagggacaagtaaatctctgtttttatatattcttcaaacatacattacttaggcttgaaatcaatttgttaatagacttaacgtttctaaaccacgtgtaaaaaagagtttttacttaacattataaatgttatattttgtaaacactagtcctagaaccctatatcagaatctggctttggaagtaagagtaggttttagctgcttgaaatgtgttgtgcttacaggctgcctctcccagggagccacttgaaccactgaacttcccagatcctgaatataaagaggaggaggaagaccaagacatacagggagaaatcagtcatcctgatggaaaggttaaaaaatgtttttgaaataatgaattctataaaaaataaacatgggttaaaatagttgaaacacatagaatctaaaataagggctctttggacaagatgcctttagttgccatttctcgttcagagattcagcaaaaggcggcatacaatctctgtatgatctttgttcttactccaaagcctttgtaatccttggcacttcttaaaagcttctgttcattctaggtcttcctttcttgcagcctttcttatactgatcctgagtcagggacctctctcctcatctccagctagcacagttttattcttatgcttaggaaagtttcttagtgggaaaactgcctgggggttccagctaaagggaatgaggaagaaagggatatatacaggttagaggtgatgagggaattttttcctcaggtttatggaaaatttacttttcgaatacctaatctggtccatttctattgaaattatagggttggagtgctatccttgaggaatgagagaaggacaaagaacaacaggcaaagcagtagttagactttcctgtacaaagtctactttagggtaacaaattgttgataagggaaggttttcttttttaggtaaattccagctaatacatggaaaaggaatgagaaaattagaaaatcacgagtttgctactcctcacgaaataaaggatcttttgagggaatgttttacattttattacaaaaaatttcaaagtaggcagttgggaggagaattagccatactttcgtcaggagaaaatcttaggtgataatcttgtgttggttttttaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtggtatgtttccagaggtgttctcctccatagtttaaccatctctggagaaaaggcagactgactgtgtgtctttacagatctactactatgcagctgcccagaccactcacacgacatacccggagggactggaagtcttacatttctcaagtggacaaataggtacaaacttgctccaccctctcattaaattcttcccttccttcaaaaaatatttactgtaacaactttttaaacagaaaaacattacccagatggaagaaaagaaatcacgtttcctgaccagactgttaaaaacttatttcctgatggacaagaagaaagcattttcccagatggtacaattgtcagagtacaacggtatggcaacattatgttcacagaaaaaccactcagtgtgacacctgttcatctgtgctcagaaggtgcc

SEQ ID NO: 72505 - DNA, 1130 bp, Homo sapiens
atttcccagcctctttgttctttagcactccccaggatgctgcaagtctttcgttagtgtccagagttccgaagtggttgattctgacaggtgctgctagttcaatagctgctttggtggagggactgattgttggagcttcctactccaccatcttccttaacatctcttccgtatttcttttctaaaacctgaaaaatatgaattctaaagcacatctggcccctaagttccagataaaggtttatagacagctattaatccacttaaaaaggaaattcggttactatactataatctgcagtatgcttaaaaatcaaattctgaaaatttgttactttttaatggaaacatctttgtttttcagctgatacatactgtaaatgtatgcttatcatagtagttatgggtaaaatgtggaacttattccaatccgttctccacccaagatcacttttaaaacgtctctgcttcattatttcaaaacggacatctttttcttttaaagaacatttaagtcataagataatggctgggtttttgtttttttgttgttgttttttgtttttttttagcattttccctatttcggttttgctttgttctaagcaaaattcagtcctcgaatttagacattgtgttatccttcccaattgacagatgaggaaactgatgcactgagaagcaagttttttaagtttacctccttagtcagtgacagagagcctcagtgccagcctaggcagtgtggttcagtagagccctgggctctactgtatgggctctttaatctgctttttattttatttttatttttttgagacagggtctggctttatcacccagactggagtacaatggtacaatcttggctcactgcaacctctgcctcctgggctcaaaccatcctccacctcagcctcctgcgtagcggggactacaggcacgcaccaccacgcccagctaatttttgtatttttggtagatacggggttttgccatgttccccaggctggtcttgaactcctgggctcaagtgatccccctgccttggcctcccaaagttctgggcttacaggcatgagctacgatgtccagccttgcttttcatttcaacaacataatagaca

SEQ ID NO: 72506 - DNA, 1029 bp, Homo sapiens
ttctacgtttcctttcttccccagacctggttcaagtaccccttcctagaggtaccagtattaccatttcgtttgtgtattctaaagagtccgtgcatataaaagcatatgtgtcagtttgtatataattacctttctatacaaatgaaaagactctttttgtatactgtcctgcaccttgcttatgataaattttgaagattgttctaacgcatgtacacacctacctcattccatttaacggatgtgtagtatttctgttgatgtaacggactttttaaactcaccctgaaagattcctttccattatattatattataaactagcagagcataggtgctttaaaatagaaattaaaatagaaattataacgttaattttcaaaaattctgattttaaaagtaatttttttgtacaaagtttggaagcttaaaaagcatagaagcaaaaatatttacaacttaactacccaaaagtaactgctatgccattttgggatatttcattccagtcattttttctatgtagttttaatatgacagagttgtataacttagctcatttctttagccttgtggatcacatttagtttctaaaaaagtactaattgataaaaatgcttgaaggacagaagcactggctattttacattttaaatagcaaatttgataaagggaaaacaatttgcatttatttgattaatagtaggggtaaactttgattttggtgttgattagctcttcagatctcttgtggattacttattcttaagctatttatatatattcgtctttgaaaaattgatttgaatgatttctttttatgtatcatgttgattccttgtcaggtcgatactcttttgaggtagattaattcttccataaattcccactgatttcctcaggaaagttaggtttaattttttttccttttcatgtttgaagcattgtttctaatgcattttaatagcacagatgtttgccatattcttggctcttagtgttactagctagctagtgtttttgctg

SEQ ID NO: 72507 - DNA, 1020 bp, Homo sapiens
tgtccgccgccctgcgccggagatggacggcggtgggcgggcaggactctgctcggacctcggggttggctcggcggggcgaggagggagcggggcgccgggacgcgctcaggcccacgggcgcgctgaggcccacggcagttcagtggcttcgttcattcgcgctgctttgttcttcgcagagctggggaagccggcctctctggggtgtctgtctctctgacctggctgtggcggaacttgagttcctgtgggcagcgcggcagccgcagtccgctggagcagggtggtgaagtagcgttgctggctgtcctaagggccggtcttgccccagctttgtcaagggcttctctcttgaagcttcgtgtggattcatggctttcaagaacgtgttgtattttaggggactgctaaatcacttcccagaccaactagttacttctcacggtctaagagtggctttgaatttgctgtttgtatccactctcctccctcaccgtgcagagaatttatctttttttcaatactgctttaaagaatgtttacatagcactttctggagatttcaaggctgtcagtttgttacattttttaaaagttttattgaggtataattgctatacaataaaaatggcacatgtttaaatgcattccatttgatgagtttgacatacacgtgcacccgtgtccttcagattttgatatctgtaaagtctgagtccacatactaatcctatctcggcatatatattatcaatgctccctttaccaagacctcagtatcaataataagtagcaggttctggtgacgctttttttatacttcatgctgacattaaatatatttttagaatcgcggtcatgaaattgaaggtatagaaggtgtgtttggtggggagttggaggaggagatgcaaaagtctggctgctgcatcccaagactgcttgcacttgtcagtctagtagggaatttttctagttttccatattatgaaatgaccttgtagtttgtctcccttc

SEQ ID NO: 72508 - DNA, 1506 bp, Homo sapiens
tgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgagtcatgtcaacgcagcgtgttgctaacacatcaacacagacagtgggtccacgtcctgcagctgctgctgctgctgcagctacccctgctgtgcgcacggttccacggtataaatatgctgcgggagttcgcaatcctcagcaacatcgtaatgcacagccacaagttacaatgcaacagcttgctgttcatgtacaaggtcaggaaactttgactgcctccaggttggcatctgcccctcctcaaaagcaaaagcaaatgttaggtgaacggctctttcctcttattcaagccatgcaccctactcttgctgggaaaatcactggcatgttgttggagattgataattcagaacttctttatatgctcgagtctccagagtcactccgttctaaggttgatgaagctgtagctgtactacaagcccaccaagctaaagaggctacccagaaagcagttaacagtgctaccggtgttccaactgtttaaaattgatcagagaccacgaaaagaaatttgtgcttcaccgaagaaaaatatctaaacatcgagaaactatgggaaaaaaaattgcaaaatctaaaataaaaaatgcaaaatctaaaataaaaaatggaaaggaaactttgaaccttatgtaccgagcaaatgcaaggtctagcaaatataatgctagtcctagattacttattgatttaaaaacaaaaaaaagattacttaattttgatttaaaaacaaaaaatcgtaaaatacaaaaaccagttaatgttttgtagaccctgggaaaagaattttcagcaaagtacaaaaatttaaagcattcctttaattttttaattctttactgtggaatagctcaaaatgtccattctgttttaagtaacagaattgataactgagcaaggaaacatggtttggattataaaattcttgctttaataaaaatttcttaaacagtgaaaaaaagaaaaatcatcaattttactaatagtctttctttacattttctattattctatctcccactatatttcaaatatgaaaatcactttttcaccaaaattttaggtctttacataatagtgtttatttttaatattcataaatgaaaatatgcaatgacaaaatagtaattataaattcagtaacatttgttcaaaattgtaagacaattattaatttatac

SEQ ID NO: 72509 - DNA, 1034 bp, Homo sapiens
gaggaatcccttaaaatatatggttgtgagagaaaatgttatacctgtgttgtgttcaagaaacatgactttattacctaattatgaatgaaaaaggagaatagagataatacagaattctgagacaaggttagactgtgaatacaagaaaaaactaaaatttaaatctgcttcggaagccatcgcctgatttataaaaatgaatattaccattactactttgcatctataggaaagatctctgtgtttttctcattatattaaggttgaaggagaagacttattccctgtggccatttcttttggaagaccaaaagaagtacttaaatcctctctacagttccgaatctcacagatttacagttttggagccaaatacagtatctttcaattttaagtaagttgacatcattggagtatttatacttgaattttctcaaacacaatttattgaaacttttttttgtcataaaggttttggaggaacatgtaccatcaatttgatcgaacactgcatcctaggcagtctgtatttaatataattatgaatatgaatgagcaaaataaacaattagagaaagatattaaagacctagaatctgtaagtattctgaagtatctaatatatttggaatgtgaaattagtttacgattagactaatatttgtattgttggtgtaaatcagcacataaacttctgaagtaagcagtttcttcaaaatcaggtcatccctactttgattgaatacgttagttcgaatcactttctttgtattttaaaatacattaaaataccggaagtatatagcataacgtatagataaacataataactatctgtgtacccaccagctagcttttgtgggattttaacatttactatatatgcctcagatctttcttgttcttgttttaagaaataaaacataggccgggcgcagtggctcacgcctgtaatcccagcactttgggaggccgaggcgggtggatcaccaggtcaggagagtttgagaccagcctggtcagcacagtga

SEQ ID NO: 72510 - DNA, 1066 bp, Homo sapiens
cactgcaacctccacctctcggttcaagcagttcttgtgcctcagcctcccgagcacctgggactgcaggcgcgtgccaccatgcctggctaattttagtagagacgaggttttgccacgttgaccaggctggtcttgaactcctgacctcaagtgatccacctgccttaacctcccaaaatactgggattacaggtgtgagccactgtgcctggatcaagaacactattttttacattaaaagattgctaatggagaagcactggctttttgtttaattacgtttttgcaaatttaaaacaaaactactcaaatacagaaattttcatacttcttgtcatcttttcttgaccctcccttccttccagcagtgacttgaaaataatagaattagttaacagataggatcctctttctttcctgtggttctcttttgattctgcttgtgtttgggaaaaccagatagttttgataagacaaccgctgagacaagggagagaaccaagggcatttcagggtcccattttaatagtaagctcaaatcaaaaggattttgcaacatgaaacagtggaggaggcatctttatagtgagatgctgtaataagggttgcttatattagtaaaacttacctttgtagcctactaatagaaggccaagaggtactgtatgttaaatggtttacatgtatgtcttcctaactttgtaaggtaggctttactaattacctgtaactttcaagtggggaaactgacattcaaagagggtaaattacttccttgtctcacagcaagtaagttgaggaattctgtgccatttctgactcccagtcctttgggacctgattttgttttctctgagaacttttagaatcctctttttccccagtgttctgaaatttcttttttttttttttttttttttgagatggagtttctcttgttgcccaggctggagttcaatggcgtgatctcggctcacagcaacctccacctcccgggttcaagcgattctcctgccccagcctcctgagtagctgggactacaggcgcctgccaccatgccca

SEQ ID NO: 72511 - DNA, 1035 bp, Homo sapiens
tcgagaccagcctggacaacctggcaaaaccccatatctactaaaaatacaaaaattagccgggcatggtggcaggcgcctgtaatcccagctactcagaggctgaggcaggagaattgcttcaaccggggaagtggagattgcagtgagccaagatggcaccagtgcactccagcctgggcaatagagcgggactcagtctcaaaaaaaaaaaagaaagccgggtggggtggtatgtacctgtagtcccagctactcgggaggctgagatgggaggatggcttgagcccacgaagtggaggttgcagtgagccaagattgcgccattgccctccagcctgggtgacataattgggggggggggggcggaaaagaataaaaaatcagtaaaagtaaactgaatctgatcaactagagcaaatcctattcttaggtggatgataagagtgaacagacttggaaaatatttaggatcccttggttattttaaatctttcctcattcaatttattatgaatatatatctttgtttttatttgtagagttgtagcccctcttattagctctttgaaagttgtcactggtgactttcattttgtctgatattcctccttatctaccaactgatgaacttttcttcaagtaatgctctgattttgacttatctttacacagtggtctcatgctagtggtttaataaggcctttttagagactaagaaatttctgatgaattgtctattaaaactacttttcaaatatgctcctttattactttgggttgtttttctagtattggatcactactctggagtaatattaagtgagtgtatgtagaccgcaaataaatattttctaggtacctagtatgtgccagacactgtattgacactgggtatataacagcaagatagaggtggacctcagggtacattctgttaattgttgtggggactgtaacatgttcttaaattattaatgtattgggaaataacttacttttaaaagattggtttgaacatagccaaacttttgt

SEQ ID NO: 72512 - DNA, 1049 bp, Homo sapiens
agtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtagtcgggcgcgggatcgccagtcttcaggggccctgctctgacccggctgaggcaggaggagacgaaggctctgctggcctgactggggctgggagccggcccggcggagacccggcccggggcgggagggtctggccaggcctggtctgggagggcagggttagcttgggccaagcggggtgcagaggcctcctgtacctacaggagcaggggtcccactttcagcatcttggagtgcgtagagataagtctgggaaaactggtcaccgccctcctagctctacgttttctcgggcaaaattggggctcctttaactttggagtctttcagcctttcgttgcctcatcaaccggaaaaccgtcttcaaattaacattatgatgctgtgtaagcttgtccttgctcacatttcattgtcccgtgtcacagattcacagtacgagttttggaggaaccgagatcagcactccgctccacctccctttgctgtctcggtctccagtctttcgcatccggtgtttccgtgtctgtgcttcatacttcaggcattgtcctgtgtcagtagtcaagagttctggagaagggaaaaatgttattccatattttaaaaggtcggatgcagctttattcgattgaccttattgcactccatgcttaatttttgtgtgtggaagaccttcattttgagaacgaacaaatatttttatttcgttacaaatttaaaaacggaaggaaatgacatcagaatgttaccaaattacgtttccaacgacatttaagtttaactttgagagggagaaaaacataaatcgagacgagaagaataacattttaaa

SEQ ID NO: 72513 - DNA, 1536 bp, Homo sapiens
gaccacaagtacgcagcaccacgcctagctaatttttaaaaaattttttggccaggcgcagtggctcacgcctgtaatcccagcactttgggaggccggggcaggtgggtcatgaggtcaggagatcaagaccagcctggccaagatggtaaaaccccgtctctactaaaaatgcaaaagctagccgggcacagtggcaggcacctgtaatcccagctactcgggaagctgaggcaggagaattgcttgaacctgggcagcagaggttgcagtgagctgagatcacgccactgcactccagcctgggcactagagtgagactccgtctcagaaataaaaaaaaaatttgtagccacagggttttgccctgttgcccaggctggtctccaattcctgggttcaagcagtctgcccaaaatgcttgatttttaggtgcttattttttcacattttaacatctctgaaattgagatacatcttacaagagtctaatattagaaatacatattaaattatgtaaatgagacaaataatatacttaatgttgaaatagctcttagaaatatataagaaaaataccgtaagaaaagtgtgcaaatcacaagtaagcagttcatgaaagaagaaatatacttgtctcatgagcatttgaagaaaatggttttcttcaccaaatataaactaagaattattatgaagtggcatttttcacctacataactggcaaggttttttataaaatatgtccgttgttgtgagggtgtgataaggtattcatggcagatgggaagataaattgtgatagttgttttaagggattgtcagattggagaagtacaggtaatctgacagtattctgtactgatagggccttaaaaagtgtcaggtaaagttatcaggagttaaactggtaggcaacaacataaattttccatacaggatatttttcacggaagatggttgagaaagggaaattcttgcccttgaaagtatatgtacatctgccatatatctgcttatgtgtacagatgtcttcataaaatgctttgcttctgagttcatgacgagggttgagaaagggaaattcttgcccttgaaagtatatgtacatctgccatatatctgcttatgtgtacagatgtcttcataaaatgctttgcttctgagttcatgatgagtcatgacatcacatgatgtttatgaggcaagcaaagaaatgcttaacagtttatatttatactttaatttgtgttaatttaaagcttgtatttggagtatgttgttcaattaccaattttttttacgtgaagcttcttgaattttctaggtgataaaacgggaacaagaccagagtaagtttacaaatttacccttaaggcattttaattgaagagtttaacttattaaattgtaggcagatggtataattgaaagtaaatatcatatacatttaggagaaaaaacttttttgtaatggtattcgttaaaagtaaaataatagacgtatgttctggtaagataatgaaaggtcaaatc

SEQ ID NO: 72514 - DNA, 1994 bp, Homo sapiens
atccacatattaaccatagtcaatgtgaaacttcatttagccgttttgtttattattcttttaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtctgaacgcattcaagttatagcttcttactgttccaatgcagaacatttatgtgcgtttttataagtcttccatttgtgtgagcactgaagaaatttctatgagtagctgttccaatacaatctaaaattgtgatggacacgattataaacatacctgataaaaaaggcagggtagtcttagcaataattatacatcaattagatattgaatattgtgaatctacttaatgttatttgctgtaatgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaaaaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcattgttaagttatggagggaaaaagtcattatgggattgattcctttgaggattgatatttcttcttaaaaggattcaatcccataattatgaccatcagctctcatgattacctaaccagttaatcaaaccaaccatagtactagtttactttttagagccagtattaatcctaaagtagataagtgtagatttggttaagtgttctttaaacatagtgaatttccattctattaaatagaacttgagaaatgtcagttatataaaaagttatgttgtaagtgaatatattctatgataaatacctaaacttgaagcaaaatctcctgtcaagggtttgtgtgtgtgtgtgtgtttaactttcttatctatagattattattttgagaaattcataggttttcacttatacattttgagcttgtggacatatggagatgtgtgttcattctctaaatgagtgcctactatgtgctgggctcgaggaatacaaaggtaga

SEQ ID NO: 72515 - DNA, 2689 bp, Homo sapiens
ttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatactaattacattaggcatttggggtgatcatggaaaattataaaatatttttagcactttagtcctttttctgttaatgcagttttacttttaagaaagtaaaatttattctggaaaatatgaattacagcgctaaacctggttttgttgtgtgtgaatatattatatggtaacttttgtaaaatgttactctacatgaagatttcactttggccagtcattggtatatatcactacaaacttaattttatttatggaaataagaacctctcattggatgactattcaaatttcaaagcagacttcttgaattgtttacgtaacttttgcctgaaggatttagactgctttctaatagtgaaactaatatatatggtggccagagtgtaatatatgctaatactttggcatgggagatatttatcatgagtttttactattaaaaaatgttatacatttgcctacgagttttataaatgatgttgccttcagaatttgtgtgaaggtacaaaactaaaaatatcatgtatctgatgtgcaatggaaagtcttgtcatcattagatatgagttcttgattatattctgaatattgatgattagaaaaatcttatgttctgttgctcttaacaacagacccacacacaacaaaaagcatgctatttgagtaactcttacgacttacaaggctgagggctgtggtgtgcattattctttagggtcttccaccagcagtgcctcctattaacctgtgacaaacaagtctctcaatgttaaagaactggacatgtgttttttatgttttttgttaggaatcagaaagtataataatatgcttggtttctttttcctatagtaacattttacaaaagagctgctaggcaggtattttattctcaaagtgatctcaaactggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaataaaacattgtcttgttttttatctacttattgtatatatcatttatatttcatatgagaaatcatgcctagttttttgggtacttactcttatgaaataacatgatagttttgccatgttagtgtcagtctctcttgatcaattgagacttgactctaacactaaggagctcgattaaaaaaagtaaaaaccatttactgattataccaactagttttatcagaaaacaagtgaggagatctaaaataattctagaagtaaatctaaaggaatgataatttatgatacattaaagatttcaaattatttagtagattaaactaacgtctttcattgcggtaagcctcttttaattgtctagttctgaacaggttaatttttttaaaatctttttttaatttttagatagataaatcagtttggataggtaagttagactggagagacatcctgaaaactaagttttaacaaatggaatcagttaaaagtaatcactgttcattttaaaaataatttcataaagaatctttaatcttgaaagagtaaggcaaatttgttttttttcccccccattttttttttttttttataccagggccacagccatctctgggagttagttttggaacgccattcggctcaggtattggcactggcttgcaatcaagtggcttaggttcttcaaaccttggaggtacactttaacttttctaatatttcattgaactattatatatttgaa

SEQ ID NO: 72516 - DNA, 1025 bp, Homo sapiens
tttcagattcttaattaaaaatgttttgggaaagagcagagtaaaataaccttgtagtatttagtgtttacattgtagtgcatgtcatgcttattaatgtatttagtcctttttttgtgaaatgaaatacccctaaagtggaaatggttataactgactaaaatcatacttgaatggtgggtaaaattttctagcacatttagaagagaaaatactaatttcttttttatggccttgttctttaaaaattgatgggtcacaaacttagtctaaatagatataaacgttttatttcagaattagtctagttcttctaaaagtctcatgcaaaggagtaagcagatttccttaataaggccatgtttttcagcactgtatctgttagacctctgatgattttcggttgtacttgtccatatcctttaacctgtgttttatgtgccattgtatatttttctattacccttccactaggatttggaactagctctggttttggatgcagcaccacaggggcctccacatttggatttggaacaacaaataaaccctcaggaagtcttagtgcaggtttgtgtgtttctgcctggatttcaggcaaatttaaaggtgtaaattatttaatttaaaagtatgtgttgttatttccagtaacccaaaaagttccctccctgattcagtttttactccctggatgaagtgtgcaagcctaactaatcattttactttatctctctcataaactaaagggcaggtttgtaaaatacttctaacaagacttcttagtttgatttaataattaattacatcttctaactcagagattcatttgaactctagtgactaacttcatggttaaataattttcttcattattacaaaaaggaacccatcattgtgaaagtttaagttttttgtcataattcatcctggagaatgatttctattccagggtccctctggttttaagaataccacagtcttacaaatgattattaatttagtttcttgttcatttttgaaat

SEQ ID NO: 72517 - DNA, 1454 bp, Homo sapiens
tattagttaactaggcagtagtagtactagatcttaattttgcaaaagctcttataaaatcaaaacagtaagtactgctcttttgtttgttcattgtcttgaacattgtgggttgaagctttcctggaggacttgggattgcaagggtaggtccagatatgtgaatgtctctcttctacatgttgataaaatgtttttggtgggtctaaggaggaaggcaccttgacatatttaattaacaggaaagtttctggcaacttgaagtttatatagattttagtaatttgtgctaaggtttctcttttgacctgcatcactacactctctttcagggtgccacttagttgttagctatattattttcctgttaaaatttcatgttagaaatttagggctttaatatatttgctattcttacagattatgtattcttttagatagaaatttactgctcctccctgtttttatatttgtttttggaattcaacttctgatatgaatatttttttccctaaacataaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggc

SEQ ID NO: 72518 - DNA, 1575 bp, Homo sapiens
ttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcatgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtcagttgctttgattctttataggtgtcagtagctgttcttaatatgtaattttattattgctcttttagtctccggttgggttttagtatattcccttcattggtttatacatcttgctcttttttaaacagaagagtgaacataagatagtaaattatttctcacttgcttttgtcttctcaaaatgacaaaaacagtgaacattt

SEQ ID NO: 72519 - DNA, 1049 bp, Homo sapiens
cactgccccacccagaagtggcccagtcctgggggcaggggagaaagggaggggtgaaatgagaagagccccattcttcctcagtgctgaggagctgaagatgccacccccttctcctgccccactctgggctccaggaaggagagcagatggaatctcaggcctgcagcttctccacaccactgccccccaggttggaggggagctaagagatatggtgagagaaggggacagaagcaagaaaagatgttgatcaagaaaaatgagaacggggagggctgaaggagaatcaaagatataacaccagtaaaaaaatttaaaaaaaaaaaaggtgagggtaagagttggggaggggaacaaaaccaaaaaccaccccaaatccgaacgagcctggaaaaaaatgaaagttctcgagtatcatagagacattatttggcgcggctggctctgcagtaggagcgctcatattcattcttttcaaccatttttctctcagttcagatttgatcattttaatcgatcttcaagttcactgactcttctatcattttcattgttattgatttctacagtaatttttatttattatttatttatttattttgagatggagtcttgctcttgtcacccagcctggcgtgcaatggcttgatcttggcttactgcaacctccacctccctgcttcaagcgattctcctgcctcagcctcctgagtagctgggattacgggtgcccgctaccacactcggctaatttttgtatttttagtagagacggggtttcaccatgttggccaggctggtctcgaactcctgacctcaggtgatccgcctgcctcggtctcccaagtgctgggattacaggtgtgagccaccgtgcctggcctctacagtaaatttttattacagataccatagttttcagttctaagatattcatttggttctttattgtagtttttatttctccactgagatttcctgggttggttttgtgtgcatgtgtgtgtgtgggggcggggtttgttttttggttttttttcctcact

SEQ ID NO: 72520 - DNA, 1061 bp, Homo sapiens
tggaggtggcttatgtcagttagtgctgctgcccactagaaaccctggagcctggaagatgagccttgtaggaaatacctctttctaggtgcacactcaggactacgagaaatgttgaggaaggtgaaggattctcccataactcagtcctcctgggcaggtgactggcggggccagactttgagcatccttgctgaataataagcctgtttggtatgaaatccatgtgctactgatagcagggtaatcctgtggatttgctgaaaccataagggactagatgatacataaaaaggatatcagtgattccacgagtgtgtaacacgagacaaaagacataataaaagccaacctaatactaagcttagatttccatactgctcaggctatgtattaaaaattcttactgtagaatttttagtcaactggagttttctagtaaactgaattggtgtatgttaaaagggtcggaaagtcgggtagggatgatgggtggggagaattgcttgagtaagagatagtagccttaagaatatttccttgcaaaatatacctgggtattcttcatgtttaaaactatgtgattccagcaaagataagttatttcatttgataaaagcaaaagtaagaattatcctcatggaactaaaaccctgttatatttagtttactataccatgtcttccattaaaactatcctgagattaacttgatttatcttgtctcagtttaagtttagcaatttaatccctaaaaatgtagatagtgctcattgtatagaattctcccctttcccaaaatgatgtacgcttctcttttactaaattctcaactttgttagcccactccatatttcagtcttgctgtaagttttagaaagcagaaatcgcatcttctatttctaacttgaaaggcattttttacaactctgtgtaacaaatgtcatcgttcccactacgtctgtttttttctgatagggctaagaggcaagttttattgatttagaatttttcaccagtttatatgcattatgctcttcaaacttgcttttatgtgtgcat

SEQ ID NO: 72521 - DNA, 1031 bp, Homo sapiens
aactggatttcagtaataactgctttagggtgatagaaagcccaagatcaagaatggagacttcatgtataggctgtagaaaagtcagtgggccaacagaaagagcaccttctgtagcaaatgaggaagaagataaaggaaggaggacacgggaattcgtgacgtatcactaccatgatggaaaatgatcctcatgtttgacaatcatacatttgcttgtagaggatcaagagcaggatatgttcccttctgctccttttctctaagctggtcagccttaggtgtgagatgtagattttgaccctcggttttaaaacacccttatgtatgcaagtaaaatgtaattatttatgagaatgcaattcgtcattttttttcttggacttgggagtttgttgccttttacctttagttgaaatagcttctatttaaaagtatcacatcaggaaactcatctctcttctggtaaatgtctgtactttcaagtggtaaataatctccattgcgttctaacgatacatctgagctgcgatattggttttccagcagatgtcctaagagtttagaatgcccttaacttctcagttccaatgtcctggcagatcaagtggactatttaaagatggatcaagaataggagttatatacacgccttcttgcctggtttttcaaacagagagaaggcaaagtagattcatcctattaaatactacatgtgcctcaagagcatgtcagtgaaatattgatcaaaatattgtcctcttttacccaggaattataggatgaagtttatttttattcgtttaattaaactgcatgttgttttaataatcttttttgtcagtcccttgcccatttgaaagttgcttttcttaacatgaactgttaactagaagcttttacttccctgttagttccaccttagaggttgcctttattctactgaaagtgcttatttgtatagtatattattttattttttaaaaataaggtataatttacacggagtaaaattaaccctttttaatgca

SEQ ID NO: 72522 - DNA, 1637 bp, Homo sapiens
ccgaagtgcccttgagatatggttgacgaaagaattttataaactgataaattaaggatttttattatgttgttattattatttcttttttgttgttgactgcacaggatcaaaatgcctgttatctcccttttacctgggactttttttttttttttttttttttttaatcagacagggtcttgctctgttgcccaggctggagtgcagtggtgcgatctcggctcactgcaacttcagcctcctggattcaggcaacactcctgcctcagcctcccacgtggctgggattacaggtgcctgcccccatggctaattttttgtattttttgtagagatggggtttcaccatgttggctgggctggtctcactctcctgacctcaagcaatctgcctgtctcagcctcccaaagtgctgggattacaggcgtgagccaccgcccccagcctgagcctttttttttttctaatgcatccaaggttaaggggaagacgcaaataacaggactattctaaaaggaaacctgtttgaactctgtgagatcagtcatcagtctcagtattccacaggcacaccttaatttcattgtaaaaagatatatatattttgtctatttttgtgcttttgggggcctattttgtgcttttttaccttatgtagagatcttattacaaagtgattttctacattaaaaagagactgaaataaattgtatagttacttaactaatgaagacatttcagaactctgggatgattttaatcttgaagtagtaggtggtatagtcataaaaccattcatccccttcttgattgtatcttaattttctggctttaaggtgacatctgagaggtaatgcattcttttttatattgaaatcataaactatcacccgctgcttctctgagttacttttaattttgccttgtggttatggtttggcgtttccttctgtttggttttcagagccccatgtctatatagtcctgagtgcaagtaattactatacttgtaaatgaagatcagtatttctgcctagatctgataaaaaaattttcttgtcttagttataaaaattcaaagaaatgtgttacaaagatacttagtatagctcctcagccataacctgagacttgggatgaaatttaaaccagatacgatttactttgcagatcataaggctttttatactcttgttatcaaaatggcttatttttcaggcactaaggattgttaagagaaaagcttttcaacgaaggattgcctttcttctcccacactgttcttgatttcctctctctttcaggcctcaacaggcactgtattcattgccaatgttccaaattatcaaattcaagtgaatttatttgtgtgttctttacttatataaaaaaagataactttaaggatgtgcaagtacatttccaactgctagcacaaccagtattttgtaattaaacaaatcgctgtatggtatggtcttctacacatttatgtctatagatatctatcgatcatctttctattctgtttcatgactgaataatgtaaaaccagtgttggcaattggtatcatcaatgatactcattttttaataaccaaaggcaggggaaaatcattttacttattaataa

SEQ ID NO: 72523 - DNA, 1052 bp, Homo sapiens
gaaagcccagagaagggagccagaccccgaactgctacagtgagatgtctgctagattgggctcattaatggtctccaaaaagttgggatggctttggattagtcgggacttctcaggacgagacttctcatgacgccctgtgttgtgcatggatgccttcttcatgctacttttaaacgtttttttcctaaaaattgtatttctttcacttttcttctgcagtgaagggcaacatgcctaattaagcctgccggggggcttatagtagcgttacattccttatccctgtgtagttatttacatttccaattaaaaatcctggaaagagaacacttatttctccccaaaactcattatgtggactgaggctggtttcagctagtttctgctatgattggggtacattttttttcctgctttactactattaatttattttttgataacatatttagggctggtgtcttaatttagagaatgaaatatttataacacgccaaggaaaaagcctgcatccacttctccagtgatccgtagttagcctgaagtgatagtgtaattaggacagttctactgctgggcgccagctgtgctgcagacactgtagcaaatgtttctacctgctaaaggggcgctatatatagaaattgctctgttcagcattgaaactccaggaaatattccacagtcagcctttggttaaatacctataaagtattgttttacttacagggcattatttctccataattccacctggtattatactttaaaaacactgactccagcaataccagaacagtgaaaaggagcataattagaaagcccggctgctctaatggatgatgaaagggtattcatagagctgacctcaaaggcgtggtctccttcctaaaatgctgccccatccgactctgggctggcattatgctttgccaagaccagtaagacccaatccacccctgtgcttatgtatttcccaaaaatatagccaggaggttggggcaagaacacatcagaaaatgcaggctcttggtaacatagggtagaa

SEQ ID NO: 72524 - DNA, 1046 bp, Homo sapiens
tgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtatgtgaactatgtttttctgttgttccactgtggtttattcaccctccactaatatttcatactagatgccaggcagtgttatgggatagagtatttcccagacgacagacaaaagtccctggcttcatggaaaaga

SEQ ID NO: 72525 - DNA, 1049 bp, Homo sapiens
aattttacataaagtttgtctttgtattttattgatattactatattgataaagcaatttaaatgtaaacttttggtagtggacatgtttctcatttgccttagtattttgctagtaatgggcagatagaaagtaagaatgaggatttctccatagcgttgcataaatagtatttaaagctttgtaactatgtaaatagtaatttaatttttataatatgcttatagtagatatacttttcttttagaaagttgtctttttgccatctttcattcattaaaatccacagatgttctttaatttattacaaactttgtttttcttacaagttttcaataaagctgtaaggtgtgtcttaggaattgatcttaagttgatttgctttgctttctagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaat

SEQ ID NO: 72526 - DNA, 1050 bp, Homo sapiens
aaagcccaatgtgttccataaagtttttacaaatgaactaatggaaatttgtatgtttatatattgtgtgtttgtatattgatgacccatataatgaagtatttgggataaaattcaagtaaatatttgaagttttctctataaatgctcccttaatttctttttaactgacaaaaatccacagttatagcttatagattcctaagtgtatcaactggcagcactttaccaactattcaaattaaatcttattttaataatttttaataaaagattaataaatgaagcacaaccgaattgatgcacatttgtaccagttgaatatttttaactgtcttcaatttacagaacatatgaaagtaataagacatttgtcttctataggttactaaagattagtcttacccttcatgaggtctcataaaacttaattcagaattcttaaatgagcagtttttcattgttttaggagaaataacatcagaagaactgcaacagcggttagatggcgtcaaggaacaactagcatctcagcctgacttgagagatggaacgaattacagaggtactatggagtcctttccataaggaacaggcttgattggagcacttgcagaaatgaaattcttagaccttgtatagtatgtttgtcttcaattttttccagttttaatgtgatactcattcagataatatatatatgagtagtaaagcagtatggttaagcagtataggacagaggaatgaatgcaaagatgtcttaaacacacagattgccttcagagagctttatgtaataatatacaattaagttaattcccagcatgcttctttttaatcttggaatgtacacattactttttctaaagtgatattacttagcttctaaaaatttatatacagaaccgtgtagaaagactgagttaggaaacctgtttttgtttctttgttctgtttgatggtttacatataaaaagttcttataaggaaagtactataaaagaacttcaaactaaatgaagtatgtagagttaaaaggaaaagccactt

SEQ ID NO: 72527 - DNA, 1112 bp, Homo sapiens
ctgggatgaggagggaggatcgctggaggctgcagtgagctacgatcgctctagcctgggcgacaggatgagaccttgtctcaaatagagatagacagacagacagacttcagaatttattagggtttgtaatttccaggttccaaagcacagcaagggaaagggcctggctgggtagtacgttacacccggaagtaaagagacgcatacaccgttgggtgcactttatagtctggctggcaaacgagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagaggtgggctcgagggaaagatctgggtcccaccactacttcctggagacgccggggaaagcaggccatccttcgagccacccatctcttctccgattggttaactgccttcttattgcgctccgctggctggtgattggttgggatgcaccgtctatcacctgcttccttgtgagaatctaggtctctaagggaagcgttacttgaggctcggttgggaagaggttggttgggcctcttgagcccactttatttatcgtagtggggatcgtcccccggcgcgagcttccgtcgcaacggccgggaaagaaaccagtagcgggacggagggcgggggtggcaagaaagtcaaggtttagaag

SEQ ID NO: 72528 - DNA, 1645 bp, Homo sapiens
ctgttgtgcggctctgcccttctgtttgagtgtatgggagagtgagtgagtgagtgagtgtgagcgtgtgtgtgagagcgtgaggcgtgagtgcgcgtgtgagaggacgagagcccgcctggccgccccgccgctcccgccgcagcaggagcagaacgcgcggccggagagagcggcggagccggcgcccagggagcccgcggggacaagggcagagacaccgctccccacccccagccctcgtccctcggctctccttcgccgggggatcctccccgttcctccacccccggccggcctctgccccgccgtccccctggatgtccctggcgctttcgcggggcctcctcctgctcttgccgcatcagtcgggctggtgctgcggccggcgggcgtagagcgggcgggttcccgggggctgcggctgcccgtgcttccccggtccccacccctgccccccggccccccgacccagctctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggtgagtgtgtgtgtctgggccggtgtccgcgctgggcggcgctcccgcaggccgaggcaggtagcccggagggagagcgggccgccggggtgccgggctctgacttcctcgacgccggcctctggctccgccagccaggtttggggaggaagtggtgtacgagggatccaaacccacgagaaatcctgcgtgccgcgtctgtgttctgctctggtggtaagaggcaagatgagcctctgcaccgtgggctgtatacttttcaaggatttcaaagctgattcatgaaaaaattcgttctaaaacgccgggttaaatgttttttgtttttttttttccttggtcgatttattatggtaaccttctggggatttcctcacccgcctctggagtgtcatccatcggtctagaaggaaggctgtgatcctttcccccaccagtttgtgatcgattttttatcaaatttgtattttatttgaggaaaggaaggcagcgagtgaatgtggttctggagagagttccccatagtgatcatctgcaacataaatgttgcaattgctatttagatattattagctgtgaatttttacatagaacaatgggggtttggtgcagggtgggtggtggggaagaaggcaagtgacatagggactatctcgttcaggcggtttcccccaaatttagcggctggcagtgaactttaaataatccctttgctttaaatattcttccctagtaacaacttaattaaacctatgactggtaatgcttccaatttagtttcttaacaggcaagtgaattgttcattttttctctttgtcagtagatgaatgtcttgtaatattgacaaaagagaaggcaattcttagttggggggaaaatatattttattaactccatgttttcttgtaaaatggatgttgtctctgttgcctttgacagaatagaaaattattgaaaagtcaaagcttattatataatccttggattttattagaaacgaagtagctttacttgag

SEQ ID NO: 72529 - DNA, 1022 bp, Homo sapiens
atgattgtgttctccccagctcttggcatattgccaaattttgacaggtattttgtacttttgtgtatgtgtgtgtgtgtgtatctgaaattcatgtttgaaaatcttttttctaaacttgctaacattaaaagcttgaggcatattacgggaagagtagaaaagtaatacctgtgaaaataccaggagaagcaaaatttgatgggtttcctatgtttttacccagaatggcactgaacaataccaaaatcaatccaaaggcaagagcaagctcggtagttggctgaatcgaaatggaaggccaaggtatttgaaaattgagccactagaaataatatttttttgaaatatactttgaaaatgaaccctttaaaatgtggatcaaatctgtatttctaaaattaaggaaaacgtaattagtttctgaatcacagttggcatttaattttgcctaaaatcactggtctgtatagcatgatcgttttatttgaaatttaccttttgttacatgagtaaaaaattatttagactaacttctattcaaggtaactcagttactcatctcactagacaagttctttaaagtctataactttattgtaatccatgaattctaacaaataatcatcctacagagaggaatttttacatcatgatgaagggcctactctgggtgtttctagacatttgaatctataggttgtttagaggactaaagggattgaataaaaagaaaacttgtcaagtcgtgctaatgtagtttatattaaacaagtcatatttttgaggaaagaaggagtaggttttttttgtttttcggttttttttttgagacggagtctcgctctgttgcccaggctggagtgcaatggcgcgatctccgctcactgctagctccgcttcccgggttcacgccattctcctgcctcagcctcccgagtagctgggactacaggcgcccgccaccacacccggctagttttttatatttttagtagagacagggtttcaccgtgttagcc

SEQ ID NO: 72530 - DNA, 1028 bp, Homo sapiens
ttacctggtatggtatcacaggaagaaagaatgttcctctgttagaggcctaagggtgagacttaagagtggtatgtgggggatgtctgagcattatgagagatgccatcatctgagtagtttgttggctccattggagaggttctgtaacattggtagagtttaaagttgacgttagagcattagtatcaatgtagattctgcaaggttgtcctttaatatttaaagaaatttctccctgtgagtttaaggataggatgggacattccccataatgtcacctttgattaccttcttatctaacagtagaactaattttattccaattcccttccttgatgatggtatttaagagcgtcttcatcaagagactccttgctctggaaattaatgactggaatgtgggcacctagtttttaaaatgtgtaacgccatcattgtattctgagtcttatcctgcttttgttcagtgagaagttggtagtcagtctgtggggctatttcccactctggtttttgcttgcatattacattctctatttctgacttaaaatggttcacagaaagtgaggcaagagtgcggacccatctgtgtcagaatctcctgaatgctgtctgcaggtgttaatgagcctggccaacacagcaagcaagatcccagctctaaaaaacacaaaacaataaacctgataaacttctggattaatcaaggactatgctatttaaagtacccataaaacaccccaatagaattctgcaatggatgccttctttatttgcttatgaactgaattaaagacttcagtcgatttccaaaagagaaattgtgaattcttccaaaacttataacatctatagtatttctaaaactcgttggtttcttatacaattcaaggtttcacccaaagggtcttcccaatttttttgcatttgagtttcctatatatgaaccaattgatatggatctgggagcctgggattatatgtttctaaaagtgttcgcgattcatttggaagggtcttttcat

SEQ ID NO: 72531 - DNA, 1062 bp, Homo sapiens
ctttacacagaatattctaggatatatattataatctttgcttttgttgctctcagcccttctattatatttacccataatagtctattatgacctggaaatgttaaacaattttgcaagtttactaagattctgtaccaatgagtcttcaactcaagtagataaaaataatttacactatgttgaggaaaaagactcataaatctaagagtagcatgtcaagcactgtgatagaagtatatgggaatggagaagggtgtacatctaaactaaagtagaaaatcaaggaaagttccaggtttgggaacgaatgtaagaattactttcatgagggaagaataggggtgagatggaggatattgttaaccaaaggtagaccatgctgaaagatgtagttcatttaattgatacttttttaatacttttcaatcttgagaccaggtgtctgtatgttaactgtcagttattcaacatctattctgtatatactcgtcagttttaaagagttaaaagccattaaactatggtcagtggtgttagaagtcaggatgttgattacccttggagggaatacagagcttcagggtgctagtaatgttctctgatcttgcactgggtctagtaacacgggttatatatgtgaaaattcattgagctgtgtacttattgttcacatgcttttctcttgtttattagtctttaacaaactgttttttattagaaaaaaactcagttcagaaacagctattatctttgcatatatcgtgataactataaatgcacttaaatacagaaagaagtatgaaagcctacttttaatgtacttgatcatggctcttcaatctaagatgaacagaaatgtttaatttttatgaagtcttactaatttttcctcttatggctattttctgtatgtggctgaagaaatctgtacccactgattgtgaaaatatttcccaatattttcttctaaatgctttataatttttttatttctagtctatgatatactcaattaatttttgtttgtggtatgatacagagtttgaattccccctccca

SEQ ID NO: 72532 - DNA, 1098 bp, Homo sapiens
ttctgcttttatttcctttttttctttaccgagctggttaggccatctcacacaatgttgaatagtggtgagagcagttatctttgatttattcccaactgtgaggaaaatatttccgctttcactgttcagtataatgatagctgtgtgtttttcataggtgctattaatcaagtttaggaagttatattcctagattctaagaattcttttcataaatgatattgaattttatcaaatgcttttttctgcatagataaaagcaaccatataattcttttcttattctgttaatttagtacaaaatattttcagttttctttgtgaaatttttccttttatctatgagttatttcgaattatattgcttaatttttaaacgtgaggtatttctagataacttactgttactgattactaatttattttcattgtgggtcagagaaaagagaccttgtattttagagatacatactgaaatatttataggtgaaatgatacaataactggaatttacttcagcataatccagggttggctgggaggagtggatattagtataaataaattaagtttgtctgtgagtggctaatggtacgtaggggttttttttaatattcttttttatttagtttggaaatttgtataacaaaaagttaagaatgaaataattcccatgttttctggcaagtttttatcaggccttcctcctttacatttcttaattcttcctcgaagaagttgtgcgtccccagcattcacctccattaactctctatgattacacccagtttgtttctttaatataacactcattacaaatgtaattacgagggggttctttttatctgtgtgcctggttacttactttgttatctgttcccccaaccctctagactgtaatgcgtttcttccccagtttgtgctaggtgtggtgtatagtccttgctctgtaagtaagtgtagaagggagggagggaggaaggaactctgaaaatttcttctaaaagcaaagagcattgcatatcttcatcttcatttttttgtaagtgatttgtcttatacattgtcaaaatttcctgtgagctgtaattccta

SEQ ID NO: 72533 - DNA, 1876 bp, Homo sapiens
aacctattttatttttatttatatttattttacctgtttttattaagcttggagagagccaaagaatcttcttcttgttttttttgtttgtttgtttttgagatggagtctcgctctgtcgcccaggctggagagcggtggcaggatctccactcactgcaagctccgccttccaggttcacgccattctcctacctcagcctcccgagtagctgggactacaggtgcctgccaccactcccggctaattttttgtattttttagtagagacggggtttcaccgtgttagccaggatggtcttgatctcctgacctcgtgatccacccgcctcagcctcccaaagttctgggattacaggcgtgagccaccatgcccggcccaagaatcttcttcttaaggagaacagacttgattgtcacatcatattttaggacaggtgacaaaacagcctagattattaaattgttgtagctctgttttgtttgcctgctattaaatactttgaaaaaaagactgagaagaaaattaaagtagattaatgctgctaatttagattagtcatactacatatgtgcaaactgctacactttaccttctcgtagatatttgctatatatttttaccttggagagtaaagctcctttattcattaatcattagttattccttacttgtgtcatattctgtatatcataagaaaatagcaagtgaaaatgttaacttataatgttaaatatctcttatttttattatgtctactaatttcaagaacatgcttaatatttacttacatgtattggccaagggtctgctctgtgcaatattaggttcagggatatgtacagtggtgtgcaaggcatagtttactgcagccgagttatagattttcctgcaatttaagagtgatctaattaagaaaatgagtcctatcaagagcatttgaaacttttcaagaaaaaacttgtaaggcacatttattcataaagtaatttttctatgtataaagttgtgctttgttttactggatgtctaacaacattatacatagaaagctttgatggatggtacaaggcagtttttattttcctcagaatctttcccatttttacatttttccattgtgaactggtatatcatttctttgtgcttgtgtgtattttattgaagcatctccccacttgctttctttataacctgtgtcataaataggttctaattctatgctatgtcaaccagccagaagtatctcttgaattttgttcttttttttttttcattttatctaccagataaacaggaatcaagtatactctgaaagtaattgatttttaattatgctttaaaaataaaagcacaatattttctgattccctattgtgataatttatctcctgaaatgctgtcatatgggtaggaaatggaattttagccccagttattagggaattttaaagttgtttatgttattcagcagagtacgaaattatattttcaatatctatgggaatccctgagtgtttctttttctgttaggaaaatattatacatcaaattatcttttcctttttttaagcttctgttgatatttttttctttctttcagcatataatcaagtttcacagagcttctaaagcaaacaagaagccagttcagttacctcggggaatggtgaagtcactattatatcagatcctagatggtattcactacctgcatgctaactgggtgttgcacagagatttggtaagttgacctgtaattggtttaaactagaaagatgcattacagttggatacttttctagtcgtctgtagataccagtgctatatgtaggcctgcaaaccttatagaagtagtgagaatgctaccttct

SEQ ID NO: 72534 - DNA, 2046 bp, Homo sapiens
cagagaattacttgaacgcaggaagctgaggttgcagtgagccaagatcgcgccacttcactccagcctgggcgacagagcgaaactccatctctaaaaaataaaagaaaacaaaaaatagatttacataacagaaataagacaaatcctttggcattttgtgaagctcaaaataaattttggccattggggtggagtcaagttagggaaaaacatttctacttttgagctaccagtcctttttatgatctctaaaagaaaaaactgtggcttaaggacatttttttccccgtagagtcagttatgctaagatagctctacattttctttttcttgtaaatttttttttcacttgaaatacatatgtatattaggtaaatacagactggtttttaaaaccaatatttaaatttcatgtaataatataaatatacttaagccacttagattagtattaagtatggtagtgaaaattatgataccgagtttcttttatctctcttatggtaaagctcttcctgctaatgcatcttaagtagattctctttgacataggggtagtatagaacagatcatttcagaaggctctgtctgttagtggtgtactaagtggtggaaagtggaaggattggtgccccctaatataggcaacaagggatgcattatctgtagatgatttaaaaataataataaagcacattaaaagttagttgctttttattgtcactatatgctggcaattctgaacaatttcagtaataaaatatttctctacggtgaggcaaatcactcttactcctccatccctcttgccattatttaaagtttattaatccaaaaagttctgcagtgtctgctgctatcttctttgatttccatatttgagtgagatttcccatattttctgtgcatgacttagtgttctttataaacgtctgacccttctgtgtgtctcacgcacgcagaagtccactgaaccattgtttcatgaaaatgatagcctttgcctctaatctagatcctactggttcagatgcccacctttcaaattcttcaatttctgaagaaaaatctcatttaccatatatgtacattttaaaatgtgaacaccttcctgccaactgaaaaagttttaaagttttaatgtttatagtgtttgaacaatagctacatatgattctaatgtatgtagtaatatgatattaactctcaagaacattgttcagaagctgtatcacataacttttttaacattttttctcaaatatttgttgttacttgcatatgaaatatttaccctatcaaaacaaaaattaatagttcattatattctttacccctgtttagtcagatttagatcaaatgtgataatgctgaccttaactctcttcatagatttctaatgctatgaattggaccagttggctgacatgccacaagaaacttcatattaaggtggataattggcacagacaccctaaaaacaccattttaataatactctggaatgttattgatgtctttgtttaataaaattggctttattaattaatagaaatactggtttgagatggtagagttatgaatttctttgatatgtatagttgagcttttaaaattaacagtcctatttaataaataatgatttatttggttgctattaattatcacatagaagcagatcagtagctgaaatccggcatccttggtgggaaaatagagatttattaattctggaaatctttttgagctgagagtcgtaatcagtgtaaatgtatgggtgttttaagaaatatggaccagaaaagaaacataagcagtatttattttgtgaagtaattcattgatccaaaccaaactttttagttttagaacattaaaatatgtatatgtaagttgttgcttatacacttgtctgtgtccactagaggtaaataagaacaaagttatgtctgttaagttagctttgctccttcccttgatgactctcttcccttttctttgtttattctctttctctccttgggaagggaaaatagtttgact

SEQ ID NO: 72535 - DNA, 1044 bp, Homo sapiens
ataagattttcttttatctcagctaaagctgttatctaaacctattttaagttattggtgccattggccacataaagctttcattaaatctttttcagtttgacgaccatatctctttactggatacaagcaaatgataaatggtcaaataacagaacaaaagtaagtcttcctacagaaacaagcacaagcagagagccatatttcaaaatcagttcaacccagaagttcaagttcttgtgtacatttttataaattttgtttgaatcaacatacaatattttttttaagatttaatacaatgagaagtttcctcaatataattagatgtaaaatcagtaaccgttactgaattaactattgaaagaaatgttcgtttattaaagtctcctactcccccaatacaactggattttaccttcccttttaatagtgatcactttgttatatgacctatatctattttttattatttaatttttataacttgcctccagatttttatcttactaaaagtataatactctaagtaggtatgtgttctgaagattcctctctgttcccaaatagatgtgtgaatttctaaaatcaatttctattctaatttccagtcttttcagatcacagacaggcttgtaattcaggtcagtgtagtttaagatgcctatttaataaaaacatagaagttgggaagatagattgctaatttttaaaaattcatttaacatctgtttatgtaaacatcttgaaccatttgaaataagatcattttttgttttccctaatttcacagactaataggccttaaagttggaaggcatcttagcagcaacagactattccagtctcttagctgccatagtaattcttggtaatatgcggggcagacaaccctgctgacactggtcgaacatttccatcatggctaactttctgtcttattagagtaaacttgttgttacacagctataatccttgaaggtagagtcagaaatttggaattcctaatactcatcctttgggccctctcttccttgattggtc

SEQ ID NO: 72536 - DNA, 1036 bp, Homo sapiens
gcattttcttcatcaacccagttcttgtctttttcaagatagagctttttgaattctttatttttccatcagagttggctcctaaaacgaaaccaatttgctatccttggtgtatgccaaaatcattggtgcactctcctccagcatgacatgctggagaacagaaagcttctgccagaatggttgtctctgcaatacaaacatctgctttaggaaatatcaatgagttttttgggagtgcagcagcaaaaagaagaagaaaagcctgggagaaataaaacaacaattagataagggaacccattgcttcaaacagtagtatctcatagatttatatcatttttcagatggcaatcaaggatgatctatcattatttctgtgcatggctttgctatacttgaagatgttgccatgatattataatttaagtcatgtaggatttctgatctccatggcaacaaatacagtttaatggagtatatgcctcatcagaatgtcaccagcaaagttctatatgttcttttaaggtgattatgtttgatagcatataaaagatcagagattatttaccaaagttacctctaatcacttcatgtaaagttttggtgctagagcttaaaaactgctaccaaattctgctactgatagacgaggaagaaaaggaaagaagtatatatcaagaaattagttttttgggcgagtagaatattgtttcaacattgcattaagtactaaaacaaaaattattcatcaagtcttttgaagtcttccttaatactgattaaacaacaaaacagaacccatgacaagagtagtcatcattagggcctttcctgtgtttttctcttaagattcccattagattacattcagaaaagaagaaatttagagtttgatttgtctactaaatcatactgtctttccctggggcatatgtagtgttaatggaaagtaacatgaggagggacccatcatttctaaatagtgctattacaacagcacttaagaccattgtcttttgtttctggctgtagc

SEQ ID NO: 72537 - DNA, 1053 bp, Homo sapiens
tactatttatccccccaccagtggtcaaacttagatttagaactcgaccagttcagtaagtctagaataaaagaaacctgaaatgaaaagcaagagagggattttccccttcttcaagtgccaagccaataccatccatcccagggcttttcagatctgtgtcccagctgctgaatgagtaagaaagtgtgtttaaaaagagggaaggagaaaaaaagatggtgtgagagtgagatcttttccactccatctcagatagacagaggagagacatgtgcatgtattcgttgtgcttttgccagatacggagagaatcttttaggattgaacactccggtgttagaaaaatcagtcacagcaatctaactaatcaacttgtacctctggagaaggtagtgggatttggggtagggtaaaggagggatgggtggtaaaagggacttttaactgtgtgcagctttatagttcgaattgtttaattgagaaaatgtttgtgtattacttctgtcattaagggagagggggaaaatccaattttagatcagaagaaaggtcagggacagaaaatggcatagcgatgacatagttgtgaaaggttgcagtctattcaaagaatggcgaaaacatgaaaacatgcatgcagcaggagcagtgggatgcaggggaaggcagggctgcgggtgatgggaagcagcctgccaggcgccttgcatcccatcacaaggactggaccttatgtaggagtgggggaggaccaatcaaagttaaagtagaagtaggtgttctttttttatagactgagtctcactctgtcacacaggctggagtgcaatgtcctgatttcaggtcactgcaacctccgcctcccaggttcaagtgattctcctgcctcagcctcctgagtagctgggattacaggcacgcaccaccacgcccagctaatttttgtattttttagtagagatagggttttatcatgttgttcaggctagtctcgaacccctgacctcaggcgacccgcccaccttggcttcttgaagtgctgggattaca

SEQ ID NO: 72538 - DNA, 1050 bp, Homo sapiens
accagtcttgattgattaccgtggtgcatgaaaacaattttatttgtcctgggtagcacctgtgtgtagctcccagggaatactgttagtgttgtggttagaagtgcgtgtgtgtgtggtagtgatagaggttctgagatttttttgtgaataaaacatcagtattattattattattacagcagtgcatattaattccaaaaactgctgcataaaattactttcaggatgataaattaggaagggagccccagactattcaaagacagggtagactctgctgctacccagtcttgctgattatatttagggcaagtcatttaacctctctggtgcctagtggactcaactttaaaaattgtaggagtttttaacctctgagatgttagtgctgccatttcagcaatacctttttttttttggctgggaataactatctttggtaggtgataggctagtatactacacattaaacgttggcagtaatagcttaggggccatcactacatatggttagagaagcctgtgaaatggttaccactataaacaggcttcactacaatctttgattttaaagtgatttatgtcagtatccgaagaggtgttcaatctagtttcacttttatttagcagactggtagaattcaagtcaaatcaagtagatagcaggatagtacagtgagtaaggagtaaaccagttgcctttttcttcccctctctgctttctctcccctcatcccctccttactccttctgctcttccttcgctttcctaaagaaagggcagcctttattcattagtgtagtagataccaccataaaagactataggtgacaatcagtatatattttaaagatttaaaaactgaaagctttgtaaactctttctttaaattttagcttactttttcacttaaaaatgaaaatcttaaaactgttcctgtcatgaaaaattcctattacttgactaacttgtttctaaagtactttattaaatttctcaataattcgtttatttaaatgtaggtgcatactttgtcatttccaaaa

SEQ ID NO: 72539 - DNA, 2583 bp, Homo sapiens
tgaggctggatagatacagaaccttaagttctaacaagactgtctcgtagtaggcctttccctgatgggaaaaaataatgggcattctgtacatattttctgatagctctattttcttacatatcaaagcaaaattttacccacttctggtctgataatctgtaaggataaaactaagtttatttaatctgattttttttcattgtcatttccaagttgtgtttgtcacatatatttagtttgttttgtgtatttgtagaagaaatgtttaaattgtattaatttaaagacatcaggattgtaacaaagttaatagcaacttctgatcacaagatttaatataaattggaagtaacagctgatttgtatcacttcaccaacaaagaaacacatgtgtgttcttaatcctaatattcttccttataaatccccccagatctcactttccacttctaattagactcttaaaatactctgtttttgataaaactttgcaaatgtttagttatgaggaaatttgatgtgccttaacatactccaagtttggctttccttgagaagcagaacctgtcggcactcaccctagtgccttccaaaatgcctgttaagtctttacatgtgcttttaaaggagtctctccagtccatttttgcggcatcaaattcaaatgtaagttcaaagcatgcaaaatagaaaagagccagccaaacagtaattacaaaagtgttctttactgtataatttagggaaaatttatgtaatacactaaaacaatctagtttggaattatagttctatgtaatatatgtgatgttggcaggtttggggaacgctacgtcttaaagcattcacatttaagaagaaatactagttctgtaaatcagtatttagtaatcttattcatagttttaattatttgccaacttttgggtttttttttttacctttgtaattaaggtgattatagtaaggcctacttcattaaaaaatgtgtattaggaaaatagaactaaacttatcaaatggtgggtgaattttgaaatttttgaataggtggtatgaatagtgatcattcaacatgtattaggcaaaagctatgtgtaatgacaactgtacatgatactattagggatagatatgaaagagacgcaatttttgcctttaaaagatgatggtatagcaggataaacagccatgcccgaataactacactacatgttaaactgtgttaaatgccatgatgaactgtatctaatctcagttctagctctgaggtatgagtatgtacctttgtcaaatcacctaacttcttgaaccatattcatctggagaaggaggtgatttaatcagatgacttttaaagtcttacctagcttttaaaaaaaatactgtgattccttaaaattaagttagtgaaattcatcccaagtaataggggaaataatggtgttaaaatattgcatagtcagcttctgattaattataccagtgaacaggcttgttgatggaaataatggaaagccttactctaactgatcccatttcctggtgcttgtgaccagtactaagaatggaaatgcagctcaacaaccctgtccctaacggtggggtgacacatggaaagaaaaatctgcccagagaagcaaggtcacccctgacctcaggcagcagagcttgactataaccccattgaagaactgggtaacagtaatttgaagagaatggagctttcaaacttgctttatgtaagacttctaaaatggatgttttgtgggtttcttcccctagaattgagcacatttttcatcttactgaataagatggtaaattagactaattggttagatttgtaaaaatcatttacttagcatgattttttttttattattttacagctgacatgggctttgcccgattatttaattcacctttgaagcctttagcagatttggatccagtggttgttacattctggtaccgagcccctgaactacttcttggagcaaggcattataccaaagctattggtgagtagaactaattaaaattccatgagtttttaaaagtttctttaaaagacacacattcctatatatttttaaattaagtagtatagcaaattataaaagtaagagcagactgagtgtgatggctcatgcctgtaatccaagcactttgggaggcggaggcagctggatcacttgagtccagtagttttgagaccagcctgggcaaaatagtgagacgttgtctctacaaaaatttttaaaaattagccgggcatggtggtgtgcacctgtagtcccagctactcgggaggctgagctgggaggatcgcttgagcctggtaggcaaaggttgcaatgagtcatgatcgcaccactctactccagcctaggcgacggggagacactgtctcaaaaaatataaataaataaaaaataaaagtaagagcaaggcctaacccaacattctactacctagaaatactatcagtagcaataggggtatatcattccacatacttctctctgcatagaaagatatcaaaaatctttgtaattaaatgggatcatattatgc

SEQ ID NO: 72540 - DNA, 2555 bp, Homo sapiens
atagttcccacagttgtttatacttaagttgtgcatttaatgctcagctgctaggcctttcaccatcgcttgtccattactcaaacctgattctgcttcattctctttggttgcattatcatcaagtagtttttttgtgtgtgctttacctttcttcttttctttattttgtgtctttatggtttccttaacttgttctgtatcctccaggatggtattaaacccacttttcctttactgggtaactgcatcctgaggttttctattttggattggttggtctccaggcatattctaccacttcatcctgccttttcccttttttattcctctgggttagatctattgctttctggatttcatgatttcatttcttattttgctacagtatgttctcatgtaaattcctttggaactgtatcttagaggtaaattttctagttcttgtatttctgaaaaatgctggtcggtatcatacttgctagcttgccagggtttacaattctaggtacaaaagaattttcctctcagaacttggatgacacccctccattgccttctagtgtcaatattgctaatgaagtctcctgcctgtcttgttcccagtcattggtagatcacctgggttttttctttctagaaacaaaaaggatttctcatccttgtatttcacagtgatatgctgaccacttggtgggcacactcaatctgaagttcatatcttgtatctgtgggaaattctcttgtgtagtcctttgatttcctcctcaatgttttctgtttctctctttcctcaactcagtgtcgtcagatgttaaatttcttggattaatcctttatactacttttttctcatgtttttctgcctttgtcatatccatttctaaaaacctcttcttgttctctgattactttttcatagtatcttgtattttttaatagaaagaaaagcctactatctgtgaagacaatgataacattgctgatttgtttgtattttgcagtattcccagaataattatctgtgttttctttacagtcactcttttcattgtatgttttgatctctcccttccatgtagcaagcattcttcaactgtttggtgacccttgagtgtctctttgtatttaaaaatcaggttactaaaactgcttgagaactttgtataaatcatggggcttatagagtgagaactttagggtgatacagcagagagccaccgttgcctggggtaacctctaaatgccagaaggcgcaggtctttcctctgaagccaaagtcttcagggaagagtcctccaacttttggcccatgctgtatgtacctggcagccccagggtgatgatagagagtagggaggaggatcagctcctcctgttcaaatacagactttgtagctggtattcccaagaacaaaatcttcgcagcattgtaggggaaaagtctgcttcccactcaacaacagcactgtgtcctgagaccttctctgaactgtcttgtctgccttccatcttctaggtctccacatggccagtttcttcttctcattcagaccttagtgaaaatagtaccttttcagagagaacttcccggattacatagtctaaaatagcaccctacctccgccttcacaccttcttttaccttattgtcttcattgactcaaagggtatctaaactccactaaaacaggtgtacctcacctcactgttcaccgttgtaaaccagtgcctacatagtatgtagtgagaactcagttttctttgttggatacttgaatgaatcttgtctctgacagtctcctcctgttcttgttactgtgcagttacacttgtatgactttgctgtcaattaaatgtagattcaagaagggaaaaggagcaatgtttgtgatcttcccccatattaatcttcaatccaatatatcatttccaaaaatctttatgttctaatcttcacacatgctttaagatcacattttattttacagaaaaataagtcagttagatatgggaattctctatactatctttgtaacttttctataaatataaaattattaatacaatatttagttaagtcagttaaaaggaaaaataaggatgatttattctagtcctattttggaatacatgttattacctaaatacatatctgggtatcttctttgcaagtgtactctaaaggcatttaaggacatatataaactaatgtgatacacagagatttttttccactcagaaaatgaatgtttaaaagcagtgttacttttggtaaagcatattaacaaactatacaaataagaaagtgattgcctaatcttatttcctattcactgaacacctgagacttgaatttatttaaattgagtaaaaaatatactatcacagaaacttgtgactctggctcactgtttattatcttgttatttttcctgagaagcttatgtcttattggaaacattaagatttatataaccttttactcactaggatattctacagtctagcagttctaatgcagggagtgtgccacaaatctaaactaccagcac

SEQ ID NO: 72541 - DNA, 2355 bp, Homo sapiens
tgatagaagagcctttctagttgaacatacagataatttgctgaatacattccatttaatgaaggggttacatctgttacgaagctactaagaaggagcaaaagcatagggaaaaaaatctgatcagaacgcatcaaactcacatatgccccatctactacaaacagattgtagtgctgtgctggtttattccgttgtgcagaactgcaagctgagtcactaaaccaaagagaggaaataataggttagtaaacattgtaatcccaggaactaagtttaattcacttttgagtgttttgttttttatttttgtttgtctgatttactttggggaaaaggctaaaaaaagggatatcaatctctaattcagtgccactaaagtagtcctaaaagtcttactgaagtatggacttttaagctcaggtgtttgtcctcaaatagctgcatggccactaaatgtgaggcattctgctaagtgggaaatacacattaaaatagagaaaatgagaatttcttcccttttatcaaaacaagaagcttgctattactacacttgttgattcaaatattattgagcaaagtcttttctcctcccaaatttggtctgtatagcatgccaattcctactatttcctttgcctggttagctcagtagctacctataagcatcacacattttgagaagtagatgaaacttatatgtttttaatttggaaagccattttataaggagtttggcaggcaggtgaacactaaagagactttccatgaattgggcacaatctaaaaaaaaaaaaaaaacaaggtaggaaaaagaaacttatttacaataattagaaatttatctgcaataatagcctgatcagctgactcagagttaatgattaatgtatgggtcaggattttgaagaaaggaagaatggtaaaattgacaaaggtgagagagaatagcagttataaagacagaagagttactagatgggagggagttaagcaaggttcaataagttatttttcctgttgactggactttttctttaaaaagcagtgtagctttgcatacattttttctgtgaaatagggtcttgctatgttgtcaaggctggattcaaactcctgggctcaagcgatcctcccgcctcagcctcctgagtagctgggactacaggcatatgccagtatgctcagctaagagcagtgtagctttaattatagctaaactacttacctttcatcttcctttacatattttattttcttctttggaatttttaataactaaccagatgaattgttacagtgtttattgggtgtgctgtaagtagaattttaaacatgcaaagccatccatcatccctttttgtgatcctacttagctgcctatgtggccattgattatcaaaggttagatttatagggtatacccatataaaaagaataatcacaaaataattaattttcccatatacctttcgatgacaaaaacaaaataggttggcctatgtttcttgatgagacttttccatatgatggtattggctaggcttggttctctgatatgtaaatacgatgtcattttttaaaatcacttgctgcagtcagtgtgaatctttaagtaaataggtgattaacttgttactttgaaatgtaaatatgtgaaattttagattaaattaaatatctctattccagttttggaatttaggaattctcattttaggttttttcttatttcctgtttaagtgacagttattaacatatctgaacaatcagctttgataaaatagtaattttgatttgttccctttggttatttatatttgtcacaggtattggttaagtcagtcaaaaaccatgtgttgagggtctgctatatgcacaccattgtacttagtttaggatttgttaagagtagaaatgaaatattttcagctttaaattctaaattggcaaatagatcttacctctactaatagttcttttgagtacaaatttaatttgaatgaaagtaaatctgtatcttgtgaatgaaaggaatttactttgttgtgtacagagaaacccatttgcctggcttttgtcaataattcatttgaatttataaccctttttttttttttttttttttgagacggagtcttgctctgtcgcccaggcaagagtgcagtggcgcgatctcggctcactgcagcctctgcctcccgggttcaagcaattctcctgcctcagcctcctgagtagctgggactatagccgcgtgccgccatgcccagctaatttttgtatttttagtagagacaggatttaactatgttggccaggctggtcttgatttcctgacctcgtgatccgtc

SEQ ID NO: 72542 - DNA, 2704 bp, Homo sapiens
aatacttaaatttgcaaaatctgatactgcttatggcatcaagaaccactttggaaaaaaaactttgttaaagtagaaatgctgttaattcttaggcgttttgaggtcggacattgtctcttggtggaataccaccttactgattagtgctaacatgagagggtaattattagaccttgcaaattagcaagtaaataaaataaaaaatattttatcacaaaaatttacactgattatgttaggcgagtgcccaatttcaaatactgtttgggttttccgtttgtttttgtttagttttctttggttgtagttcccatgctccatatgcagctttactgtagttcacagaaaaggtatcacctggacattgaaaactcaccaaaatccagccagtacatttaattgggcttagagtgaaaccatttgggtggtatggaggtatacagaatgaaaaatcggggtggagggcatgggaatatatacttataataatgtttcatggtatttagtaattataattgcttaggaattaatatgagttattagggaaagaaagaaaaaaacactccccaagaaaataaaattgcattttcttttggaaagaaccactttattttgcacctttctttttcttttttccttgcctatttttctttctttttttttttctttttgttttaaagatatttgggctatagggtgtatatttgcagaactactaacgtcagaaccaatatttcactgtcgacaagaggacatcaaaactagtaatccttatcaccatgaccagctggacagaatattcaatgtaatgggatttcctgcaggtacacattattcgtttttgtttttgtttttaaatcactgttgtttgaacttagatgtcttcgttggagaggtatatatttttagctgatggaagctacttttacttgagtctttgttttttgacttgcatttatcaaagatccgtagaaacagcaaaatttgtagagtttacatattggcatggaaatatttatgggtttcctgaatttcaggactgtatttttgtttcatcttgttttacttttttgttttgttatttggtatttgaaatgataaaatatgttcaatatctgtattaaaaaggtacctttagctcttaccagtagaaactataaatgaattcagtagtaggaatttttttctggcagcacatataatactgccactatttggcattcaaatataaattttgaaccttatttctatttagggcactatacagaatcacattatattgaataatagcatttaagtcttctcttagaacagtcacaatgtgggtgagagtcatagtaccctatggtgagttagcctgctgttttgcaacagagagatggtttacatgtatcctatccctggtattagatctctccaactgtatctcaatccctagttatattacagaacggtaatcaccaaaaactgctcagaggtccagaataatgagaatttgtttaaaacacctaaattttggctagtcaagtacttagtagaaagtgtttcttattaggaatatttctcaggtcactataaactcaagactaatagagataatacctgggacttttaattctacattcccttgtaagggtgttaattatcagtaaatgcagaataactacacagatactgcctttctccaaaattggtcaccagtgtggagaagacttctgttgtgatgggaattttatttattcagtaaatatttattgagtacctgccatgtgccaggcactgtcttaagtaaaaagttattgatgatgtaacagacatgatttttgcccccttggagtttgcattgtactgctatatgtagaatgtttaaaaagtaggtatggttttgagtagagacagaagaattctgttttcttcctgcttctgaatgtgtccaccatttctgagcccacgggaaaggcatagcttctgtgagggagtagatgtggtgaagatgtctatcagtgactcttaatatgtggttcagaggttagggtggtttataaggaagcttggaaagcaggcagcagaggttagatttgatagctaaagaatgagaatccatcagttcttgagtactagagacatgctttatgttgcattttagaaagatttagtaagatggtggtaggtaaaaatctgttaaaaagagctaactgaaatcagaaaccagctgtagcagtgctgcagacagaaagtagagtgaagataaggatggagaaaaaagggcagatggaaatgttttataggaagtgtataagcaagggaaaactaaagattatcttaaaatttctagcatgagaaattgataaaacacagaaattggagcaaggaaaatagttaaggagaaaattccatttaggagtgtagtgtatgtttagtttacaatatgtgatgtctttggaggatagttaccaaatatttttacaagtaagttcaaagaaaagcaagcctctaaaggccatttaaaagctaaaggttttgcgaggccgcggtgggcggatcacctgaggttgggagtttgagaccagcctgaacaacatggagaaaccccgtctctaccaaaaatacaaaattagctgggcatggtggctacatgcctgtaatgtattacaggcatgggattacatgcctgtaatcccagctactctggaggctgagg

SEQ ID NO: 72543 - DNA, 1033 bp, Homo sapiens
ttgtatttcagctctttgaaagactgtttacaaagttcttaatttccaaaatacctcttataaccttaaatgttaacagtcattcagcgattatatgtgctatttgatttttctggaagaatgtgatagatgccatatttatcagtgtgtaatggaaaaatgatttaacctagaatctaattgaatccgtgcactaacaaggtaatttgtgatgaaattatatacagccattaccaactttgtttacaataaaatttccattgttacagcgtaataattaataatgttttttgttttagaaaaaggtttataacacatagaaggggagtttggggaagcaggttgtattttgcttggcttgaaattcttttaatccttattcctaagttcttaaatgagaattctttcaccttgaagaggttaacctttcctttattgcaaccaggccatttggcaaacatttcttctgttcttcctttgtttctcctttttcttcgctttctactgcttctccttctgtattttctacttactattatatcagttcacattttatatcatgtatttcatatcttaacagcaatttaaaaagtcattcttaacctgtcatattaccacacaatatattatccagataatggtttattataatgtacttacagtaggacccaaattagaggtctaagttagatccttcgaaattatggacttactgattctaataaaataatgatagtggcagaagattagaagtcatgacttaggggaattattattctccttgattccctgctactcattatagtctaggatgactctgcctaccatcaccactaaaactctagagatataccttccttgtagcttatgtgcttgtttttaccagggtgacccatcttaattggaggtaatcttgagtagtctcttaggaaagccctattataattccattaaaactgttgggtattttcaatagcaaattcaggcctttcctttcaaccctaaaaataaaattgtgctttctctgaaatat

SEQ ID NO: 72544 - DNA, 1553 bp, Homo sapiens
gtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaacatggagtcagctgtcttttttatatgtacaaagggtttttgttttaattttaaaatatgccttaataagtagcctctgaagaaatctcttcacttttcatgaagaatatctatgtgtctgtctccataatagagtactgacttgagtcttagatatggatccttttttcctgctatactcggtaccataatgtaagatatgaaacacagacacctatctaattggaagatattggtgagccttcaatcgctggaatcattcctaatttattctgtgttgtactgagaaggatttgactgttgtatccctaataattaattttcctcctccagaaaatacagaagattaggaaaaaaaactaacttttttcttaaaaacccaactcaatgatataaaaacattctaaaacaaaatcactgaggaatctctgtccttataggcccgacagtacagtaatggtaatttctaggagctgaattcatgttt

SEQ ID NO: 72545 - DNA, 2732 bp, Homo sapiens
tagcataactagtctctaccccagtctgactggaacttgtgtgagcatcctggtggccacagtgaaaggaaatcatcctcagctctatgctgtcattttcaccatgcataaagaagataccagtttcttttccttaatatgtcccccatttcacacttggggctttgaattggttacattgaaaggtgtagtaggtgatgtgctcagtggcattcatgtggtacattgaacagtggttcttgtttggctgtttatcatgtccttaaataaagtgaaagtacaacaatcaaaaacaattctgtggaggatcaaactgacatggtttattatatattttctagttgtgagaataagcacacttcatatccctcaaacagtcattcaggaatataagtgatctcaggtggattttttggtgaaagatgtatagaagatagtttgaagttactgttacagatgcgcttggagtgccagtattttgtcaattaaaggtggctttagagaccgagagagatggttggttagttcaaaatcagtatcctgcatggcaagcttgttctagatcaggggttggtaaactacagcctgtgggccacatctggctctttgcctgattttgcaaggaaaattgtattggaatacagacgtgtttgttcttttatttgtctggggttgctttagtgctgcaaggcagagctgatataggggtaagtggtggcaacagaggctaacttacacagtacgacatatttgctatctggctctttacagtaaaaattcctgacccttgttttggagaacatattttctgccttttctgatggggctcacattgtagtaggtgagaaagctaataaacgacattaaaaaaaaaatatatatatatataatctcccttcacttgctttgctttctttactatgctttctttagtatacagcctatgtgtatgtgtgtgcgtgtatttatacgtgtatatatacgtgtgtgtgtatatatatataaagaaagcgaagcacgtgaagagagagaatatcagagactgccatttttgataaggtggtcagggaagcctatgtgagatgacatttgagcagagatacaaacgaaagtgaaggagtgaaccagctaggcaaatattttgggaatgaaccttatttggggagaaacagcaagtgcccccttgagataccgagtagcagcagggagggcagtgtgaatagggggttgggtagggggatgcgtagtgacagaggtattaaagggccagattgtgtagggccgtatagactgtggtgcactttggattttattctgagtgagatgaaaaaccattgcaaagttttgagcagggacatgataccatttaagttagattgtaagaggatcactaggactgctgtgtagaggatagacaggggacaaaggtagaaggtgggtgtctgtgtgctctgtgtgctaggtaggcattgcgaagtgctgtggctgttggatgaatcagtggttcctgccttgaggaggtcttagtagaatagcagaagaaagagatcactgtaatgcactgctgctgacagagaagcaaaggtgccctgggatggggtaggaggggtacctgatccaaaccaaaggtgacaccttgacctgagaatttagagggggctgatgaagactctgattgtatatcagagctctgagattcttggaaggactacttgcatgcaggaattttccccacctgttaaccacgtgagcaagtgctcatccagagatgagtggtttggtggcttttaggtcacatgccagtgccaacaattgcagtctggagcattgtgttagagtgatgttaaggtggtatctcagctcagcaggatacaccacaggaactgaagggtgaaatatttgccatctttgccagagagcagaaccaaagtaattttggtttgggaaagttagtaccataggactgtagaaaagtctcagtaaattgtctgtggaatgtattgtagagtattgctactttccccgtatgcctggcagtatgaattagttgcacaatgtacgtctcagtaattaagcaaaccggtctgctgtctggagttattggatatgacccaattaaactttggaggatgtctgtaaaaatgattttatttttgggacaggtgatagtaaagtattttggataattagttgaaaaaattgctgccgttttaaattagtgtagaagaggacattcacctttctgttttctataatggggtgtctagatcatctagagagaattttaattatcataatattggtttaaaaagaagtagggagagaaaataaaatcacaatcatagaggaaagtttttttttgtactttctctgcaactgatagaacaaaggatatagatgatttgaacaaaacaattaataaaattgcctcagtgtgtctagctgttgtacctaatggcagaatgcacattctttgtaagtagactggacagtatctatcagcttgttgggaaaagcaagtttgagtatattttagaagattgaattcgaacagagtgttctataaattaaactaaaatcaatagcaaaaggtagctagaaaaccttttctaagtatcccatgatcaaagaagatattacggtgagaattagaaaattttacaaaatatgttgattagaatcaatatgaaaatactgtatataaaaatttgtgaggtgcagctaaagtcata

SEQ ID NO: 72546 - DNA, 1136 bp, Homo sapiens
gtgcactggcacgatcttggctcgctgcatcctctgtctccagggttcaaacgattctcctgccttagcctcatgagtagctgggattacacatgcatgccaccgcgcctggctaatttttgtatttttagtagagacagggcttcgccatgttggtctcgaactcctgacctcgggtgattcacccgtcttggtctcccaaagtgctgggattacaggcgtcagccgctgcgcctggcctgccctgctcttcttttcatttctttttttttttttttttgagacggagtcttgctctgtcacccaggctggagtgcagtggctgatctcgactcacagcaacctctgcctcctgagttcaagcagttctcctgcctcagcctctggtgaagctgggattacaggtgcctgccaccaagcccggctaattttctgtattttttgtagagatggtaaaagctgatttctgtccacttacttgccttcctcctggtgtcaggctgctgctctgcatctagggacttcacaggtgcctgacgtgacataggggctctctcagctctcctgccctagcaccttgtgcactacccatgtgtatttgattaaggcccacaggaaagagttggcaagtggatgcagatttgctgtgttttggggctcctggagattctaatctatcatttcagctcacatggagacattaaaagtttgttaacagttcagctggtatcttcttacccttatctattggcagattctttgtctttccaccactttgccacagatgaaaacagctgtggattactactttgcctatgaaggccttcttgatatctgatacttacttcctgtaggtttctttgtgttctatccacattttctaaatcctggggcaaattgtctctgtgtaatgttatagaatggaggttacagtcatcccatgggatttgattcattgaggcaaagtggataaaatatttccaaaaggcatcatttctaagtggactggggagttcacaccttggctttgccacttagagctttgtagtagtattcagttactctctgaaagtactgctttgttaattggaggttaaaacacccacatctgtcatcctctttgggctccgaagatt

SEQ ID NO: 72547 - DNA, 1019 bp, Homo sapiens
ctggcattttatgcagaattcaagttattaacagaaaactctacaagagcaaatgaagctttagttaaataaacatgaggatttcaaatatcagaatatcaactgtttggaatatctacattcctgtaccctttcagtgagtaaattggccataattatctttatttgtagaaaacaaagaggtgctggttcagggatatgtgatatattggccactggcctcaagcatgagttttgtcatttggagacagatcagtgctgccacctaacctcaaagaatgaggatgtggcctgtcatctgcatacacaaatgcaaagatatcatcacttcctttttgccaagagtgggctgagtaaatttgccagattgtggtgattgtgcttgtctgccgacagggagcatgttttgcttttagttgtccagggataataactgccggttattaaatgcctctgctaccttgctgtgttctttgtccataagacttcatcctccccttcacattttaaggggaggtatggttagctttatttttataaaaggggagcttgagactcaaacagtactaactcttccaaggtccagagcttttcgatggtagttccggggtggaactcagatctctgacccccatacctctgatctttcccctttaccatgcagcctctgggcttcagaaaatgtttcctacaggattatattggatgccactgattaaatgattactgctacttaattaattggagatagaatttgatgctagaaatgtttttggcaataatgagttacttaggtgactgaacttttacatttatttctaggaggtcattttttccttgtttttgttcgtttgtatcttctctcataaattgtagtattcttgtggcatgatggtgggccatttagttccctgattactttagatatagtgagttaggttttgactagaggctcaggagctttgaatgtagacatgttgtaaaaatggtactgctgtgtttgtcagttttgtttgaac

SEQ ID NO: 72548 - DNA, 1020 bp, Homo sapiens
tttcttgcgtctaccttgtattaaaattatctgcatttatttgttaccctcacaagactgagtaccttcacaaacaggcattttcttattcatttttatgtgttcagtgtttaaagaggggctgacttctacaagatgcttggtacagtcttgctgagtgaatggatgcatgttcactaaaattttcttgtatgtattcttcccaagtagaccataattctgagtaggaaaccatgtcatgcttcttgttacctcatagctctagcacattggtatacaacattgatcagtttgctctgtagcattgctgttaatgtccagtgtcctggaaacaccttctagggcgtatttggcagttattaaatctgttactattttatccctgtagctactattagaatatttataaaatgatctccaagacttttattgaatttgaatattgttatgggaaaaatcgatacaaatgctcttattagctacagttcttatgtgaatgattactattatttgattcagtctgtaggcagtaacaaaacctaaaatatatgtgttgttgagtaaatgaattgagcagttcagttgaatacacttagacttgactttttctttttctgcccttcagctattatttactgtgagtccttgaagttaatttcagaggtttttcaggatagggggttggaattatacaggatttcacacaccttattagctccttacttaaaataattaaaaaagaactagttcagggattagagctcccttgaaattgttgaaatgtgaaatttgaatttaagactttcttgaagacttgaatgcattttgcctactggtaattaattttttttcttttctttgtagttttagttttgattgctgttaactactactgataactgagccaaagtggtgatgctacttgaggggaatttctgcaacccatagtcaacgattacatggtaagagtgtgtgccttttacccttaaagccatttaatttctgtaacatagtttagaa

SEQ ID NO: 72549 - DNA, 1018 bp, Homo sapiens
gtctccttggaggctgggtatatattctagtcttatgcacacagcttcctggcagacatcaaatggaatttgacttaccagatgtcgtactgaatcatggtctgcagagatgcggatggatcacatccttggctggggaagtggggtggatacaaatatctgggtcaactcagtggttaaccaaaggttagtcatgttataaaaagtcatgtatatcaaaaatacaaaacagagtaagatagggggtctgaagcttatgcatgcaatcagcaacaaggcagtgtcaggagttgaaggaccagacaaaaccatctgtttaataagataataaaatctgatataaaaggaaccttggaaatgtaaaccacctccttcctttttggtcagagctgactcttaatgacaaatgatcaggtgcttagagggttaagaatggggagggacctgctgggatagagggaaagagaatgaatagaagcatcatattagaagtcaaggattacttgaataccaaagcagacaactttcccctccttggctgcctttttatcctggtaagacacagaaatgaagtagccttggcttactggcatatttataattgggacctgtaggaagcgtttacaatggggatgtggtgggcagagcaccagtggaagtgagagaccgagattctagtgtctactccaggatgtaggagattttgggtctctttgtcttaatctttgattgtaaaataaagttatgctagatctccaaggttccatttatcttaaaattttttttattaagtagctgattttgtctggctgatcaaaacagggaagaaaaatagttcctggtcaaagcatctcggaggttcctgggttaataatgtgcatcagaataaatttttatgcacaataaaggactataaaacagatgtaggttcaaatattaaatgtattcttgaatcccacatgttctgagtatctagttaaatgaacaccatggtctaaaaggacttagaaataaaata

SEQ ID NO: 72550 - DNA, 1709 bp, Homo sapiens
ccccgccctgctttggctcgccctccatgggctgcacccactgtccaaccagtcccaatgagaggaaccaggtacctcagttggaaatgcagaaatcacccatcttctgcgtcgatcatgctgggagctgcactgcagaccagagctgttcctattcggccatcttggaacagaacttatttttattttttaccaccaatatctctgctgggtcatacagccttagcagccaggctgtttgcaccacagcctagacctgctgaagggtcctttcttgccttgagccccactcaaaactggcagctgccgtgtcatgcagtctgtagaccagagccatatcacaggtgtgttgcccccagaacccaacctaatcagcactgggcttcctcagcattgggggatgcaagatataacaaattgtcttttccttaggaggagatacccagcatgcctctgagcactgggtccctcagaacttcaccgcagttgccagaccctgaatcttcacagggcttatctgccaccctctggagcatgtgtgtcttaccaagggctcctgtgtgctggccaccctgtgcttagtctgtccagtcagcatgacggtgttgctctctttcctctcttaggcccagcactttcacagctaggttgttgctggaattcgtattttgttatcaacttagcatccagaaagaagagttgcatgtaatgcctgcagggggagggtacctgctgccctgtaggggagaggcctctgcagcatattccagctcagccaagtgcaagcccagagagtcccaattgagggacttgcaggtaggttgtttagactcaacaatatcataggcattcatctagaattccccatcccagttttcagaatgctgggttttctctcttagggcccagacctgcatacttcacttgccttggctgagatttaaacatttccagctcttactctcacaactggaccttggaaatgggaaacccacagcttttcattctgtctgcccatccaattcagatggtggcgaagactgctttgtacccactaggaaggccctgttgccctcacatttagctgttaactgcttgttaactgcagttcagtatcccgttatccttatgcagggcattagtacaattttagcactgactagccaactccgctgcttttctggaatttttccactgaatctgcattattgccttggacatgaaaggtatcccttcatttggacattttccaggtcaccgtcactgtaatctttagcaatcgagccatgacctgtgccagggactaccctcctatcaggatggcatcctcaactgcagagtggtctgtgagcatgtcccagatcccccatctcaccacctgctttctcagatcattctcagggcacttgggtttgtctgggtctgagcaacagacaccaaggtgggatcacagctataggatttgattaaggatatcacctatgtgaaagaaaagggggtagaaactggggaggctgagagagccatcaaaccacagtgcaaacctgacccttgcagtggggaggagagggggttgggtgttagcgagctttcctagtctgccatgaggtctaagggagattcagcagagccgatgaggggttcttgtctttaattcacctttgtcagcttttctcggttatttcatcctgatttcttgctgcagacta

SEQ ID NO: 72551 - DNA, 1055 bp, Homo sapiens
cacagaattcatggactcagtcccaaattcaggcagctcatagttcatctgggaagaagacaactgtgagtcctgcctctgccaggcacagagacccctacagtttgcttgggatggttaatggggaaatgaatgaagtgccgacatgttgtcccttccaaatccctctcagagctccctgttgctctaaaatagagtgtatttatagaaaatgtgaggtatagtgaggtcaacagattaggagacaattgccatagaaaagatagcttgttacagttcccaagaggagggggtcacagcacaccacgcagggccacataggaagcacagggtccttgaggaggcagagcgggacggggagctgtgggccggagtcttttttgtggtttctgtgggaaggagtggacaaaggggaagcagagtcaggattggcgggtttgaataatttcagtgggctctcagcttgggggctgtttctacttgtctagtagtttggccatggggtgatgtgcaggtgggtagtggctaggagtgtgagagccacatcgaggaggtgataggtgtgataggtgtgtgggctctggattggttggtttgcattttgaagagggccctcttgggtgagctgttttccatctattggaattagtaaccttgggaggatggcaccaagctgtccacccccatgatccaaaagtttcccactgggccccactttcaatacctgagatcacatttcaacatgagatttggagagaacaaacatccaaactatatccctaatcttgtcaaaatgaaaatatattccagtcattggattttctagtattgtatgaagatgaggctggttgtatgattaggaggtttgaaactctataaactccttaagtaggaagttaagattttatttatcatctctttttttttctttttttttttttaagacagtctcactctgtcacccaggctggagtgcagtgccacgattttggctcactgcaatctctgcctcctgggttcaagggattctcctgcctcctcctcctgagtagctg

SEQ ID NO: 72552 - DNA, 1053 bp, Homo sapiens
aaagccaaacaatagatttgctgattttaacctactaaaagttaaaatgcagatactgatttctgcattgaggtgaacagatcagctggttattttatgtatatggtaccacgtatatattggcatgcatagatgtatggcaaatgcaagctaggaagaaaaggctgcttcttattctcattttgaatattaatattaaatatctgaagaatattttataagactcaaatatgcatgaaaatgctttttccttcaaagctttttgaagttgcactattttcccccaaacttttacatttattttctgatcttgttttctcacttcatcctgctccttttcagtttaggtggtttatgtggcatttttggtgacaggttttcacagttaaatttttcagaaactctgttaataactagaaaatcttccatgaaatgtcccatattggtagcctcaagcgaagggcaaatttttttttaactcaactacttttatttatcttgaagaaacgctgcaggtaagtattggtttctttaatagagttgtactgtattgttacggatatatttttaataatatctataatcattagctaaggcaaaagtatgtaaagaaattacataaaatgttttttaaaataaaattttcctggaatctaagctcttatgattgacttttggtagtggtaattgataaaaatatacaaattcacataattacatgaagactgcttgtaaattattgaagggtaaaattgtttttgcgtgtatttatttttgtaggaatgcttttagtctcttgtttttatggctgaaatgcctgttggcacaaagtgtaagtgatgaaagccgacataaactgtcagagttttaataatcaatctgtatctcatgctgtaataatcggcggagtgttgtgttagttgtgtttatggtgtttgcttggccacagtctcctgtaagtgaatctgcccacacagtatgccttgttctacatggcccttgtggtaaatagaatagtaatagcccctccggatatgtccatgtccttatcct

SEQ ID NO: 72553 - DNA, 1871 bp, Homo sapiens
gccctttgcttgttcgcttggcttgccagcagaatttcaacaaaatcccttgtcaacaaaacttcacaaagtgcctgactcaaggactgagagcagccctctggaagaatgccctaaagatgatacacggggtagagcgcaggttctaaatcactgcattttccaaatacagaagataatgtctaaggattttgcttttatcatctgtaaccagatgtatcctcacattttactctattgtaacttgtattaggttggtgcaaaagtatctaatgttacttctaaacacatttgatgtacctgctagacacaggcagggccgccatcacttatatataaactgtgggccaaaatactactttaaaatagtataacaactcttgagaagcctctcccgggttacattcctcagtaagacttacaaataaagctaactttaattcttcaaaagcctgatttttctttagttaacagaggcatttatctcaacctgatgtatttggacatgagttcatgtggtactaataagtccagaagtggaacctttgtcaacaaagaatgaataaattgcatttacctcaatgtgctccataattcagaattagtttagctattaatggacttgctattgaaagagtgagtagaattcagcttttcaaatcatttgctgtttgcaaaactgaagattgtaattataacactattcttattcatcagaaaatatagctctttccatttttttctcttcagacacttgtcagctttcagcagctggcaaaatattaattatgcaagtctctaaattttatgtccctttataaattgagaacttctgagtggaaatgtagtatcagttgcatgtttttcaaatagggttaggcatcggacctagaagcaaatgttgcttgtccttttctgcttatgcagcatcgagctgagagtacatgatgttgttctcaacaatagttggtgtgctttgagagtattgctgtcacttttgcaagaggctattgtgtatacactcccatagtcttggtgtatatgctgtccctattaattagttttctgtacagccgaaggggatgggatgggagcttttaaagttggactggagtatgtgtgtatatataaatttattttaaactatgaatggtcaagcagaaacacaataattggtttcattttgtgactatgtcagacattcagaaataaagaactgatagacttgaatatgaagcatttggaacgtggtgctcatctacaaaacacccagcatttcaccaaatggattctataaaacagtagttctgaaagatgttattaggcgtttccaggcccagtcactatgagaacatgatatgttagatgcttctcttgcagattgccagtgcacattagcttattaatgactttaagacaccccaaggcatagaaacatgtttaatccttctagctcctcattgcccagcctgccttgagcaggaagcatttgttggctttgtgcttgttaacaagaaacactggcatagatcatgtgtttttcattcagctgatagttgttgagcactggctgagcacaagcagtgcagaggtgaaaggcagaactccaactctcctagagcttagatgaatgaaggcaagattagagttccctgacgagtcctgtgatccaggtcagcttagggcattgtggagcacagagggggtcaaatgctcttacagagcccagtctacatcctgagttagccaggactcagttcttatgtttttgttcacttattccgaaatcttttctgagtacctactataagccaggcatgctctagacattggagactgatatagcagtacacagagctaaggggaatcct

SEQ ID NO: 72554 - DNA, 1106 bp, Homo sapiens
acaaataaaatatctaatgtttctgattgtgaatgagataaaatcccagatttaaaggccaacatgataattgaattatcttgaggaataagtgaaagtttggttcctgagattgtatttacacttaaagcgtgaaaaatgagaacttaagttgcagttagtgggaagcaacttgagcgatagctcatgtagcaataaagattctatactgtctgggatattttaaaattctacaacattgagtcagtttcagatttatatgagtatctctaataaacttcaaaagttctaaaggccttggactgtgacactttattttcatactcgtttgcacaaaatcccacatgttgacaggaataagcactggtgaggatgtgtgagggccgcttcatcagctccctaacagatggccttctccattcattttattctacaggcaaacatgctgaagacatatttggtgagttgtttaatgaggctaacaacttctacatcagagcaaattctcttcaagacagaattgatcgccttgctgtcaaagtcacccagctggattcaacagtggaagagggtaggtaattgcctgaaagcagtgagctagaagtgatgttgacaagatggtagtaattaattgcagtgtaattactgctttttccttgggatggcatgctgatatttcatcttgtctttcctagaagaatagcgagggggaaaaacctacaactttgtgttaattcacgatgaaaagattcatatgtggtctacctcataactctatactcttttttaaaaaattacaaatatagtatttgttttaaaggcttctttgaatacagtcagtattagaagccccaatttaggttactgacagttattttaaaaatagtttcttacctaaaacttacagagccactctagagatatggtccaactgagacagtgttacacataccttgtgtgacacaagcacctggtgttcttaggattgatgcctgtaaaatcctggtgattctgctgatttaaaaattttgttaaccttctcagaaatagcatttaccgaaagcctttaggctgcaggctttaaaataatgttaatgtcgacaagc

SEQ ID NO: 72555 - DNA, 1066 bp, Homo sapiens
catagtgatagctattatctgtgaaaggaaaggaatgcacatgctcttaaacatggtttttaaatggacaataaaaaatattatttggttgttctaggaggtgtttttaattgtgagtcaaatggtatttacttctaaacagttaaaaatatttctatataactcaacttgggggattttctctaaatagtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacaggtatagcttcatgagtcccagagcctctccttgagatgaggggagagctgggcagagctgggagcaagctgatgcattgtgtgggaatgtccttgatggttcatctgggttaaaatcagaattgcttcaaactttgaaaataatgattgaattatatacaatgaaactactcattggtacataattattaaagttacagtatttcagcatattgatacgtttaacagtagaaatgtgagttctgattttaacttttagatgtagctaccttaagtagaagtgagtaagttgcataacagtattgtgtgtggttatgttgttgtttttagattcgaagtcaattaggaactgcataattcatttataatgcagcaaaatacctgtttcagcactgcagagacatttgatatttaattcagaaaaaaatgtattctgtagtgttaggggttttgaagagtgaaaatatagtcagcaaattaaccttctgttactggaaaatggtaggacacgttatcaggacgagacttccaagaaaaacaatggaaaataaatagtgcaaaaaaataatatgaagagactaactaaaaatgctctttctaaacacccctcctgccttctcccagctcagcactttcttcccatacctgctgtcacctcttgtcccatatccctctttcacacactgtctctccatcccttgtggtatgtcctgtcctctcccc

SEQ ID NO: 72556 - DNA, 1250 bp, Homo sapiens
ttttcttccctgacttacaatacattgatttgtagagatgacaagaaggatgggctgaagttctatactgatccttcctatttctttgacctctggaaagaaaaaatgctacaggacacagaagacaaaaggaaagagaaaaggcgtcaaaaggtaaataatttcagtatgggaaatgtgcatatcagtgttcaaaggagattcttgtttagaaatagtaaattatttaaatggttgagatattggatatagtgctgaagtttttttagaggttgcatttctcacaaaagatcctgacaattcagtcaaacacagtaatactatcttcaataaatactgatatgttctccagcacttgctttgctttaacaaaagtagttcctaaactttgttttgttaccatgttttagtaactcctctcctgcgttctcaaatttttgtaaagcagtcagtattccatatcagatacaatgatcatgcagcacaatgatgtgcttttgtcttcttaacatttttaattgtttggttgccttctagctgtaattaaaatcttgggaagatgttcacatgggattgagaagcatatgtgatttgcacgttcagcggataggatttactgaaaatgagcctccctttaaggggtaggggtaggaagagaattgcaagtttgaaggttgagaaatatctgcatgcattacaagcagtcttcaaaggagaagcccactctactcaggttaagggatttgtgttttgaaaattgttcgttttgggcccagaaattagacttaggccactgagaggaataattctctaagggcaagtatttattaatatttttatatgtcagctgtatttaaaaatgaccatccagtttgctttacagattagagcgctttatttaggagaaatgcttagcattttgtgagttgatagccttagggttttgaggcattgaggtgtgttggcccagtaggagtgacagtttggtctggaggagaatttgaaaatcgaaaacagcattaaagggaagagaacatgagaacagtttgcagactgtgctgttgtaagacaccatggctggttccgggaaagaggatgcaaaggacttggtcacacacagtcttcttgtgctcatggctttgggagatttaattgggatatatcttggaaaagttgctaggttttgcagaatattcaagtgaagaaaaaagaaagataccaatcttttgagtggaaaaggaacaaatatt

SEQ ID NO: 72557 - DNA, 3899 bp, Homo sapiens
acacagtctgtcctctcctcttggcaggcacctgacccatactcctctgcagaattgatgccactgtcaatacactttcaatactctcagtcattccaggatgcctccctgacttccagactagacacacatacacacacacacacacacacacacacacacacacacacacacgtatatatttaaacataaaaatatatttgtgaaaataaatacatttatttttatggtacatttataatagtacctttatttgtgtcctcttgtggactgcaggctccatgagcacagatgccatgtctgtgtgtgtgtgtgtgtgtgtgtttgccatttgtgttgtcagtgcctggcgcagtacctcgggcatagcactagaagttcatgcttgctgcctggctgtggatttgatcatttagccagcatgtattgagtgtgtattctgtgtaaaaacagtatgttgagataccataagacaagagggaaacgtaggaaataaagacacatgattctcatccttaaagatcataaaattttgtataggaggcaggaaaaacttagaggcacacatagaaataacttctcacgtttcaagaagcacctgtttaagaactaagtatttgttgaatgaaacattttctggccaagtagggctagaggaagaatggtgctttttatgagcaggtaagtttttatcttgcttaattttgtgttaaactatttacaggattcacttattccgtaatcttttagaaattgggaacagaatgttttgaattattttctttgaaagataattgtacgttaagaagtcagtcaaaattgtgtggtggcgggaaataatttctctttatggtgtttccaggttgttcacccatgtaatatagatctgaaagaccttgtttaggtttaaaacaagttacaagcatattcaagtgaaagtttttttactttaatgaaaacgatggtaagcaactcttaacagttgtagcagggtaactttttgttgattctgttttgttggttctgttgggtaagaggagtgcactgctttagagtttctgtaacattagggtaatcgaaatgcgaatgtgtcttgtctgttcatcaggcatgggccttgtgcattataactgcatttaaccagctgttttcctttcccttctgtcttggcatgctctctttcctttcctggacatcaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtgtgtgtgtgtcactgctccctcagccctgatgcttgggcaactgggtactacctggttttattatcatttgaaatgcatcaatagcttcggggtttatatggcccttgatgtcttaagattttccttaaaaattgtttatctgtattttgattttgaaataatacttgaagacagtgttattttacattgggttcctttgattttagaaaatctctctgacttaaaatgtattgttgagttcatctagatgtagtgttttaacactgattctgaatttggggtaactgcttatgacttaagtttttactttaataatcatttaattctttctcttagcatggaatgttgaatttcctttgccacttggtatctaaaaatgattggcaggtggtaaagtaactaaggagtaccttcattgttcctttagtaaccctttgaaaaaatgatgaacaaaagagagatttacttcttatttcagataacttatatattctgatttcaggagaagaattctattggcgtttacttaaaaatttattagcagttaagtaaaaatatttcttgcaggcgtgaatgatgtggtcattaagtcacacttgtcaccaaaggcattcattgaacaacaggaaatgactagtcaattttaacgtttgattcagttttctatttctgcttttgtaaagttgtagtcttccatttgcataaactctcatcggcatttaaaaatttgaatagagaattcttacaatatgtgatcaagaatgtttcaaaacaacagcaacctggactttgggttgtatctgtgccctttttttctacctttgtaaaactcagtgtttagcacaaactcttaacgtattacgtgccttcaatgttcccaccccagaaggtctataagtcattgggaggatgtgaggcaagttctggtaatttttctgtacaaacttctatttgttaaatattagagaattattggagctttaactgagttttagcctcatttgaattttagtgtgagtttatttctatagaaagtaggaattataacacagttctgctcatagttctttgggtggggaggaatgtatgaacttaatagctcccatgatgtcaatctgcttttttgttttttttctaaataatttagctatgattgtttactcgtgcaaaacgtatactttgtttttatcctatatagacttttcaaaaatagatgcagatgggaaaatgatggatttttaaaaatctctcagttgaatgatactccttctagcatctgagattattccatgttggatataaaatggatggttattcagatatagtctgcctttgtatttatgttgcttacatacatctgcgtttctcttaattttcaaaaaataagtctgattgttttatttcttcagaattccttttgttgtctcctactatttcccatggcttcttactatttgcatacattatttactatcagataaatagattataactcatcattgtattggattataacccttaatttagaaatttttatttttttttactacagtgtgtcacttttttattataaaataagacatgcttattatatctggaagttacaggaaaaaattaaaatgaaatatgatctatagtttcaccatgcagagaaaccgttgtatgcattttagtgtatttctctttagtctttttctatacatgtgtttcttttttcttttacaaaattggagtcatgccatgttttctttcttttgacttttagaaattatatcccatgttttaggtattatttcgcaacatgatttttaatgattgtatccgctcatctgagtgcatccaagatactgagggaaatttaaataccaggtttcatggtgtgtgtatatgctattatataagtaatataccgtaacccatcttacatttttgctctctctctagattgttaggaatggcttgttcctgagaataaatttaagatgagcgctgggaagtgcttgcctgctgtatgaccagctctctgtcactgccactcagggagtcgcacacctccatgcccaattgtccttgttttttctcatccagttctgggccctggtgcagatctctggctgcccgcctgtctacccaaaaaaccctgggggatatatcgacctctcacactgagtctctgctgctgtgcctacttcctcccgtgtggtgtcgcctctggccctcccggccctcctcctcccatgtcagcgttgtctccagccctcccagccctcttcctcctcctcccgtgtcggtgtcatctccggccctcccggccctcctcctcccatcgtccccggccctcccagtcctcttcctcccgtgtcagtgtcgcctctggccctcccagtcctctcttctgtaataggtgatcactgaccatcatgaggcctcgggatctccactcacctccaccttggccgtgcgtctgcagctggtttctgcctccccactgggagtggggctcatctccaacagctgcctg

SEQ ID NO: 72558 - DNA, 1827 bp, Homo sapiens
gaactctgtttcctttaaaaggttgcactgtaagccagtgactcgtagtcatgcgcagagtcaagcacacatcatcagtgtctccaagggttataggaatttacatttttaaaatactctaaatctaaatacaggtcaggtccttcccccattaaatatatttttaagtcatttgctagcagctcacctagttcaaaagacataatcagaagtgcaccataatccagaattcatactgcaattagggaagaaaataatgagtagttattagttgttacacttcaattaaggaaggaaaaaggaaaagaagctgtctcttctcatttggaaggcttttctgtgccacatggtgccccagttaagaaaagctaccaactggaatcccaaagatggaaatgcagcgtgcatcttccctgctccctcagcacccccaatgtgtgtttggtatttccttcagagagagaaacacaagctgaaccctaacagaaaccagcaagtaaatgtgagaaaagtcagaacaagaaaagaagagtgggagagaaggaaaatgggcattgagtttatgagtgacgcaaagaaactggagcaggcagggagcgccaaagaggacagagtgcccagcgggtttgttgttttgctttctttgggttcccagactcagactgcccctgcttctgccgccatgagaggatgtacagcccctcctggccacatgtcctgtaacctgagccaggagcgtgtgactgtcttactaacgcccacggcactgccgggctgccacacttgggtccttcctctcctcctgagggcttagcaggaatcccgtccctgcaccccatgtctcagctctgctccactaatccaagatccctttcctttcggagtttcacacccagtttgtgtgcaaagaaaactatggaaagaaggcctttccatagtgcaccgcattgctttctgccctttttgttaagtacatttcttctgtttaagaaaaatatgattcactctactgcattctcgatttcttttcctgttcttactgttaatatttatccagttaacctgccattttatattttctaattatatgctgtcagtttcattgccactgaaatcttctgtcttatatcctgtttctaaatggaatggtttctttcatagccttcttagagaaaacgtatgctgaaatactgtgaaaaggaggctctgctgtttcctgcttgccggtctgtctgacttattcacttcaaagctgtgaatctgaatccatgtaacactggggcttgctgccgacttataataattatgttgttgcttggaatctctcacggggctatacctagttgatagtaaagcaaattaatgtctgatttttgtgtattagcaatgttattattcaaatacatccatgtgcctgttagccgacaatttttaaattaatttaaatttctcccacctcttgttttcaaatgccaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggtaactcagcatgccttgtaccctaatccctcctggccttgcatttgaatcttgctctatgtggtaggagaattttaactccgg

SEQ ID NO: 72559 - DNA, 1089 bp, Homo sapiens
ggccaaggcagttggattgcttgagcccaggagtttgagagcagcctgggcaacatggcaaaactctatccctacaaaaaatgcaaaaaaaaattagctgagcatgttggcctgagcctgtagtcccagctactcaggaggctgaggtgggaggattgcttgagtgtgggaggtcaaggctgcagtgagccgtggtcacgcccctgcactccagcctaggcgacagagcgagacccgtctcaaaaaaaaaaaaagaattgaaattaggaagtttttacttaccttgaaaccagaaacccaataactgaagtgatcgattaattaattggatctcttctctgcattctgctctaaggggaaaagtataaatgaaagaaagtgagctcatattaatgatttctttaaaaaaaaaaaagagtttgtgctggacttgtcatatttgcttgatgtcctaagccagtggtttttcagaatctataatattcaacagcataacccttttgtcagatgaaagtcccgcgttgaccccctgaccacaaaacacatggaaacagagcatctcaggtggaattgggtggggagtctgccctcgcctgtcttgggctgcccagagagcccctgggaacctccagcccacaccatggattcttaaccaggtcccaacccaggttggtcgagggtccctgacatgttatgggaatatccaagagcttctcgcctgtggggagctgcacagacttggtcacagtttagtcatctcatctggaagtgaccaagcaaggagcctggctgcagcccgccagctcagcatcagggatgtccttcagaggagctgtgatgctgctgcctctgcgtttttcttgtgtgcccatgaaccaggcccacagtgtggcccacgcacccttctaaagaccccagggtcctctgtgtacctggacatcattgacacacttttattttgtcaagataaaaaagtcctagaggtatattagctcatgaatatcaagttcggggtcattgtaggacggtgttggatttgccttttttttttttaacaccttataagccctgtctaccaagagtagatac

SEQ ID NO: 72560 - DNA, 1777 bp, Homo sapiens
tgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctcttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcag

SEQ ID NO: 72561 - DNA, 1050 bp, Homo sapiens
tgttgggattacaggcgtgagccaccgcgcctggccttccctctaccactcttgagcaccccgtgcatttagccttattataagagacgtgtgtttgaaaaatacagattccttaaccaaggactaacgccattccatctgttttggagccatattgagtgctgtgtcaaattatgtggtgtgacaatgatgggtagggtggggtcatattaagatgttcagaatgttgttttgtcagtataaaaataattgatagaaatgtgcaaaactgggcattgctgggctattaaaactgaccattgtctatctgttcattggatatcgtaaagtttgataattcaaggacatggtggatatcttttatgaaattttgttttcatttttatttttaataggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaaggtaattgcaactccggggacatagtagtggaattcctaggttagaagagcagggtacattcaagatgttcatgaattattcatatatagaacttttagaaattctgtattctctcaagataattttatttcaaaatggagttttagctttatgttttatcatttcttaaaaattttatatgttaaaatatattgtttttatttttattatttattactctacaagtactatatctgatttcctagaactttgagatctgttagtttttcttttccttttttggggtgtgtgtatagagggttgttggttaaaataaatcacttctgagtttaattgcgtatgttcagcatatcaatggttgtaaaaagcattttaaaatggcattggaaataatcttcaaagattcattttttgattttacctgtgtgtgtatttatcatttcttattagccaattt

SEQ ID NO: 72562 - DNA, 1050 bp, Homo sapiens
acaaaactttatattaaatttttaggagaaataaagtcagtcacaaatgaagaatgtaatttaacattttgggctaaattttttttttaatgacaatacagatatcctgtcctgtgtgaagcatttttattcagtcttggcctatgtttttttaagaatcagtgtatatggtacagtttatttcatgctttaaaataacacaaagactttggaaagtcatgaactctcacatcatactagcctttgccagtgagagtcagtcaaaagtgtactttggtgttttatttatacatctggtaggggttatttattcagtgtccttttggataatccaaattaagtagttctcttttgaacttgagggaaaagaattgtttacttactgataataatagaatggcatttaattctgttaattgggaactgtggtttactagtatttgaaaaaatcaaagacaattcactgtttttacagataagcagcaaagatgaagattttttagacctttctgttgacgtggaacaaaatacatcaattactcactgcttaaggtatatgtagaattatttagtttgaaatttaataattatttttagtctggaatattttttaagatacatgatttcctggtatctacaaaataaatttgttttgaatttcacacaggggtttcagcaacacagaaactctgtgcagtgaatacaagtattactgtgaagagtgtcgcagcaaacaggaagcacacaaacggtaattttagagctttatggatttttaagtgattttattttttgtaattgatgttggaggtgggcttagaaaaacaatctaggaaaatttacattgagtaaaaattcttaattctatcactaacagttaatgttcattaagtattactaggtaaatgatattctactcaatgtttattttacaaaaactgtgtaccctgaagtgatttcctatgtctagcgattatttaatcatcataaaccagtacagttaaaatatttggctttgaggctttcctgatgatgtaaacttttttcttg

SEQ ID NO: 72563 - DNA, 1019 bp, Homo sapiens
ggttgtccaacttctgctttaaagcttgccaagttgaaatatttgtgaaataataagtcaggtaagctaataagcaatttcttcttaaattctcagtatctgttatgccaatatataaggataggttttgcccttttctcaggatcaattagtagtatttttaaacaagattttaattaattttacattttccccaaatacagataaaagttttagatgcgaaagttatttgttatacattacaaaaacattgtgcatttatattttagttctgatccaatactagatattcttttataaattggttttttatgaagttatgaattctgaaataattctctaatataatgtttttattttcagagctttttgacaactacatgcaacaagatgcccatgaattcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactgtaagtatatcatacaattttgtatagagaaaaattgaattactatgttaaaggttgttctttgagaaagacagaatggaagatgaacttgaaagttgtaattcttaggtataggagttaaagatgtatttttcagttaaaaggaatctgtctgtattcttaatgtaatgttgcttattgacaatgaatacctgaggtgatagaaagatacttactgtagcttgaactgtttgattttctttcagtttaggaggccatagaaccatgttgtggaaattatgtcttatgacataatctcataggatcatacagatcagggaggcatattaattcgtttttcctttttctacgattacctttagtatccattgttgggataaaaactaaagcatacagtgtaccctcaaggaggggaaaaaatcccac

SEQ ID NO: 72564 - DNA, 1033 bp, Homo sapiens
taaaatacagttacatacttatggctttatatgtttgtttgtcaaacctggggtatttttacagtgttcgttattttttccaaatgggctttttttcttttttcatctctttctctctctgtctctctctctttttttttttttttttggtagagatggggtctcattatgttgcccagactagtcttgaactcctggcctcaaatgacccacctcagtctcccaaagtgttggattacaggcatgagccactgtgtctggccttattattattattattattatttttttttttgatagttcaatagttactaattctttttgtatttaggcagattgaattggtaacacaatagagttcttaaatacttctttgaaagagactgattctagaataaatattctaagcccatcttctcataagttttgcttcatttttctaaacttcagaaataatgcttaatagaaaagccatttttttaatagaaaagcatttttattatttgatgttgctgacatttgcaaatatgttttgaaatatatttttggcttttgaattttcccttgagaattgtgtagagaagaatatacaaatcaaagaggatttaatatattattcattgcatatctttccttctgagattttgtttgttttaaatctttggaaagtatgttactcatttcagtatttccactgactttcactggtagatggttcttactaaattaatttcctgccatactatgttaaaaattttattctcaatagatattagccccatattgttttaaccaccattgctttatgttactaatctttttgatggtcctggaaagaactgattttaatttctatttattaatgaatttttgtttttacagttttaactcatgttacctaatcatagcataagaggactgttgcacagtgctcctgcatagagtacagcaacagtggctccatgcatgttacctgctgatgggatggatgctagctgagtgtttgagtagactaatcatgatagatatattt

SEQ ID NO: 72565 - DNA, 1051 bp, Homo sapiens
ttaggagctcttttttaaaaaattattattattttttttgctctgtagcccatttctagaacatcttgggagttctaattatgttttagataacataaaaagcatagaatcagacataattaagcaagaatttcacttagttccctagtttttacagtctaaatacatttttctttctttaaaactggaggttactgataccaccattttcgtcaccaacagcctaataattcacaaagctatttgctaatttttgacacttttttctttgccagtaccattaagggatttgaatttttttgaggttccatgtttatttctttagttatgagtatgaccttggacaagttacttctctgtacctgtaaagtgagagtaaaataacatctagttcatagggttgttgactagtacctggcccatggtaatcactgtgtcatgttggctgttactgccctttaacatgatttgctcccctccctgtggtaaaaagtattcattggcactactaattaatctgttagctcaacatatactaaccaaaatggaaatttgttttgtgaaatacaattgtcagttccttttcattataagaaacgttagtttattagtagtatatacccctgagaaagcactaatttattttgaaattgagtggattaattcataatatgaaagctgagaatgtagattgtcttctttctctattttgaatagttcatagaataatttatttcttttatctgggaacaaaaataactggtctaatttgtgacattctcaaacatattttacaagtttagataagttgagaatggcaaaaaccacaattacttttgcaacaatctaatacttttagaagaaaaatctatcttaccttattttatactaaaaaaaaaaaaaagcacaccagctttttgtcattactagaacaaggtgtgtgcattcaagttagcttcaggacttattttctttcagatttttctgtttactgaggccatattattatatttaatttccttatgctctatcctttagggagcataacaag

SEQ ID NO: 72566 - DNA, 1114 bp, Homo sapiens
attatcttagtcaatttcaaaaggaatgcgataattaggtcttttacagtgacaattttgccacatggctgagctacacacattgtatgggtcatagttcattgtcaaagactagatttcaggagtggtgtgatactctttaccgactgttcattcactcaagtactgtatatcaagtatacacttagcagccactaagtgctagaggcgacgctgagtactggggatgcagtattggtcagggcagcccctgttttcttggtgtttacattcttgctcatggacacaaacagtattcaggtaaacaataaatgtatgctgtaatcagattaggacagtgagacacagggatttgccagggtcacacacttagtaagtgggattctgatcccaaggatgtcaaatcagaagctctttctagggcttccatccagatacattaattacatgtggggcgtgtgtattgttggcaaatacagaaaatgcctggccaaatgagatcgttccaaaggtactattaaaattgggtgtgtctgtattcatatttgaatacattcgaatgtacccccaaatagtgctgaatatctcaaagtaatttgcagtcttattctttaaagaaaattgccatttgtcctctgagaatcacaaaattgaaaagcaaagatacctctttggctttgtaggtgctgttttgctaggcttggaacgctcctccctgccacaccccgtatccttcttgtctggcgagtgtgtgtgcctgtctcttaagcagggagccttacttgaataatcctacccctgtccaacccgaccctccatccccttcatacagtttcatggcatttttgtaatctcagtagcacttatcatacttactgtgcagtaaatttttctttgaactcttactcaattgtgagggccttgaaggggaaggattatcatttacttctgcagtttgatctggagtaccaagttctgcattcagtataaaagttttccaaagtccttcctgcctcctcctggtatgccgggtgaagcagggatgatgtggctgtgtgtgtgtggaatggtggagagaagatgggctggacttaaacagaacacttctcagaat

SEQ ID NO: 72567 - DNA, 1044 bp, Homo sapiens
ctgactcgttttaaccaaaggcatgacagtggtagtgatagctgatatttcctgagggctcattctatgtgccagtaagcacttacaaatattatcttacttaattcttatgaaactcctaggaggtaatgggtggtacctattcctatgcatttagaagattctacagtgtacaaaaagtcgctcttcaggtttttccattgctgttttgggattgagctttctcaagtcacctacgtcagctggcatttgtccatctgtttttcagctttcaaaatgttgctgttattttttatcttccccatgcatatggtttaggtcgttagacacacacacacacccacacacacacacacacacgcacacacacccaatgggattctcggaggtaacaaaattagatgagggtatttaatccatcattttaatctggagcccctagggatgaattatttagatgcaggatacctaataattagtttaactcatattgttttagctgaattggatgttgaaggcattccaatactaaatgaggagttgggttacggagtggacattgggacattgttttttagctactcaaactcattccttcttcctactagacctccatttacttgggggccttaactcctgtcccatgtgcatattcttaggaaggtactccctacccacatcaaaactaaggggaccagaattgcactctccctgctccaataaacatagggtagacatcccttccagtcaaccccctccctgactaaaaacaatattctgatttctgtttgattcattgattgagatgggatcttgctatgttatataggcaggtcttgaactcctggcctctaatgatcctcccaccttgacctcccaaagtgctggggttacaggcatgagccagcctgcctggccaatattctgatttctataaccataagttagttttgcctaatcttggatttcctatgaatggtaccatacagtttgtacttttttttcctgtggctctttttgtttagctgaatgtcgttgagaatc

SEQ ID NO: 72568 - DNA, 1033 bp, Homo sapiens
atttattctgttattgatggacgtttctaattttttgcttctacccacagcgctgttacgtacatccttgttcacttaccaaagtttctacaagacatataggtaggagcagagtgctggggtttagtaattgaaaacttttactagattttgccacattgctttcccaaagaggttttaacatttgcgcacctactagcaggtgcgtatgtttagacgtgtggaggagaaactatttaaagacatacaaactagataatatacttgcttcattctcgtttgaccttcgtacccaagcaattatttctgcaaacaaacaaataaacaactactaatagcacttcccgcaccgccagccgcagttttccctgcggagacgcggatacaaggcagcttccggcgaaggcggtgacgcaaaggatggcgtaagcacgctcgggacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccaggtagggcctacgcgtggctcccgggcgctaggtgttcgacagacttgaaccgcgaccttgtggcctcagaggtcgttcattgggaccgtggggagactctctaacctgtttgaggtccattggcatgggcgggttaaaccatgttctgccagacggggagcagcgtgcgccgggtcgggtctgggccgtgggctgagaaccggactgcgatgttgcggccctgcggggggacatttgcgagaaagacgagactgagtcgcttggggtgaggcgactcgagttaatctttaaaagacttcgttttatgttcccgtggc

SEQ ID NO: 72569 - DNA, 2402 bp, Homo sapiens
aagaaaggtttaattcacataaaaatgtaaggctgttttattgtgttctccactaaattatcttctagttagtaattacatgcccttggcattctaaattgggttctacagatagagtgtggtagaagtcctgttgtgtttttatattctcatagagaaagggtactagtttggattctcgtatcaagttctgctccttaagagttttgatgttatagaacttgggcagttttgccaaaagaccttacttgctaaaataatgattttttaacctttcaacagaactaactgcttggtgatccagctttcagtttgcagttctcacttcgctactgaaatgtgaacatttgaaattacaggggtttggggcaaatgccagttttcagtcgtatttgactgttctgctttctggtttcagtaattcgccaaaatgacgaacacaaagggaaagaggagaggcacccgatatatgttctctaggccttttagaaaacatggtaagtaggtttaccttccttgagagaagcatggcacacatttgtgttctgttgtgttcaacatgtgttgtagttcatagaatgtgtatcaatagaattaaataactagcgtctacccagcttatttcgtgataaggtaaataaattaccaaaattatatggtgattttgtgactaagtattgatgcaagattaaactttggagagaggttgtgatttagtaggctgattgtgctgtcaggagaaattgtccattgggaagataataagcatgtaaccatcaaaaatgatatatgtgttaaaagctagtaaaattgcatttcttttactctagatttttagccttaatactcactataccaaatttatttttgtaggagttgttcctttggccacatatatgcgaatctataagaaaggtgatattgtagacatcaaggtaaacataaaattgggaaaataacactacagaagatagaaaagttggatttaatctagtgtaggaattcaaatactagtgtatgttgcatctgtaagagtatagaatggatttttttttttttttttttggagacggagtttcactcttgttgctcaggctggagtgcaatggcatgatctcacctcaacctccgcctccctcccggattcaagcagttctcctgcctcagcctcccaaatagctgggattacaggcgtgcaccatgatacctggctaattttgtatttttagtagagaagtggtttctccatgttggtcaggctggtcttgaacacctcgggtgatctgctggactcagcctcccaatgtgctgggattacaggcatgcaccatgattcctggctaattttgtatttttagtagagaaggggtttctccatgttggtcaggctggtcttgaacacctcgggtgatccgccggactcagcctcccaatgtgctgggattattacaggtgtgaaccaccgtgcccggcctagaatggattttttaaagtgctattcttagcagaatttaaattttcctcattacccgcttggagttaacagctagtggaaattgggtggtagggtgggaaattatgagtttatcaagttggaaaggaacgccttagtgcaaagtttaattattgatgaagattactattactatgattaaaaaccctcctagtgaaagctgtgttcttctgtgacctggatttaaatgtatcttggcactcgagcttaatgatgactgttttttttgattgcttgaagcaatgtgaaaaacacatttcaccggctctgaaagctcttgagttgccatttgaaagaaatcttagaatactttgcagttacttaaagtcagaattttaaaggaaggggaaatgctggtatataacattggtttctttaatagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgta

SEQ ID NO: 72570 - DNA, 1101 bp, Homo sapiens
ctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaatgtttctcttcattgagtagaagtgtggtgtcctctcccccaaagaaatatttaaagcaaattttggttgtgtcctaattcattatgtaatgtccttgctattcaaatttaatgtatttcttgctgaaggacatgaggtagcttattgtgcaacaaattactcagaaaatggcgaggtattatatatgaaatacttgtactggtttgaagatagtccttctaaatcatcaaggaagaaataaaatattttttttttgagacagtcttgctctgtcaacctggctggagtgcaatggtgtgatctcggctcactgcaacatctgcctcctgggttcaagcaattctgcctcagcctgctgagtagctgggattataggcgcgtgccaccacgcctggctaatttttgtatctttagtagagacagggtttcaccatgtttataagtctggtctcaaactcctgacctcgtgatccacctgccttggcctcccaaagtgctgggattacaggtgtgagctactgtgccaggacaaataaaacatacaaaaataagtgggatgtcatctattgcgtaacagttaagctcaggatccagagtttgcttttg

SEQ ID NO: 72571 - DNA, 1059 bp, Homo sapiens
gttacactaataagagggtgtgaggacagttgtttctcacagacatgcctcttagtccccacttatcaggctgggaaagttagggttagggcccgagggagtaatatggttatatctgacatgtccccagccctgagccccccacacctaccaccatttctgtcctccgctctgtttagcaatgctgaatacataaacatcacacaatcagtcagtcattccgtaagtttaacgagcacttccggtagggcagacaaccagggcaggggccacagaggtacaggacacagtctctgtcctgaaagtagggcagtttggggataactagcaataatattctcaggacatgtcagctggcatatactcatgtttttaaaataattaatgctccccaagaatatatgtgtccatgcaacacgatacctttggagaatggcagtaccaaataagactaacatggtccttggaagaatatcgtgctgatgtcctccccacgtaatttgttgtttgtgctcagcaggaaatgttgccagacttttctgcaaaaattcacactgaggtcacacctatactaataaggaaaatgagtagtcagaggcacaagacggatcaggcccctattctcccttaagacatttgtatggctctttagcttgcaacatttgtggaagtggggcaactacgtgggggcctcttaaagagaaaagtccccatgaaaatgtcccttctgtcgttcatgtattcaattcttggatcagcctggccagttaaagagatgagctttgttctgtaatacccaatatgttttcttcattaggagaacagttcagaaaataagcaaagatgccagtttcatctttaaaatgacttcattttttataaattgatttcaaacacattctagtctgagcctggccactctggtgacctccctaggaccatttccttatttgtaaaataatcatatttataatctctgcattcctgcttcgttaataacaacaacaaaacccaaataggattctaagtagcatagtggcctgatcaattgcgctggtg

SEQ ID NO: 72572 - DNA, 1031 bp, Homo sapiens
gggagcctgtgacccttggggtgggaggcaggtgggtgtgtttgggtgcggagatcaccatatgaggtctgagaagtaggcccattaggagtttggattttattttgagggcaggagaatgtcagataccatgatatgacgtggcagcccatgtcacacacaagtgaggaaaacgagggtcatggaggtcaaggaatctgcccagcttcccagtttttggcagagctaggcttcacactgcctcagcttaaagcccttaatttcttaaaccactgggctgcagtccatacctttgccccttgcacctcctctaatttatgggccaccttctccaggtgtcctccggggcctcattccttaacctctccagcactggaaggccgaccgcttcttccttgagaccttctctggttcttttcctcttcctcgtctgcccttttcgttggatcctcttctgccctctgcatgttccaccccgcccagctccctcttgcggtcttacatagccaccggcatgactcataacatcctttatgctttgcccctctgcccttcctcttgcccgttctagcctctaaattctgggctctgtattaccagtagatccacgtaagagcttgcctttccttttagaccggtgtgctgtattttggatactggcgctaccagtttccttaatacaggttgaaaaacttggagtcatctttgttgtcccagatctctcatgcagattaatttgacaaatgtttattgagcctactccacgcctgccgctgtgcaaggttctgtggctccgcccctggtggtatgtagctcactgtgttcctgtttgcttgttttgctcctagtactctcatggaggcctcggtgcctccctcctggacgccttggtagtatgcttttcatagtttgatgcaccaaactggttatttggttatttggggtgtgtgtttggcttttactataggttcaaaatgagtcaccccctcccaactcctgggttacaaaaggtggttgcatttagggtgttg

SEQ ID NO: 72573 - DNA, 1043 bp, Homo sapiens
tatggttctgctctaagtatctgttttacctctaatgataagccaagacaagttttatggaggcctttctggaaatccagttcataatgacatctcaagcagcattaaggttgtcagattctaagctgagaataatttgtcttaagcatgatttaggcctagtgtaggcttttgggactagtgtatttcaccttcccatctgcccagtgtgtataaaagatgactgatgtagtgtgtataatttcagaagcctaatatgaaaaagcattttgttacatgatagtcatcaggttgagagtctatgtggtatggcttaacactctggaattcgctaagactattttatagtattactattctttggaagaattagcttctataaagtaggaagatatatgtgtcttaaaacttcttctcccttggtttattaatattttggtttatataacttcttacagttgtgcagccaatggctgtgatcaaaaattcaacacaaaatcaaacttgaagaaacattttgaacgcaaacatgaaaatcaacaaaaacaatatatagtaagtatgattttatatgcttaaattttttgagtatttttacacttactgcctatgtttctgacattttcagccaggtgcggtggctcaagcctataatcgtagcttgaggccaggaatttgagaccagcctgggaaacatagtgaaatgctgtctctgaaaaaaaaaaacaaaaacagaaaacaaaacaaaaaattttggggtaacagagaccctgtctctaaaaaataaaagtgaaaaataaagttttcgtcaaccaaattttgtctgccaaatgtctgaatttacttaatgccatcataatgataaaggttttaatttggaagcagacattgtgcaaattagtgtattgggagactattccaactgaaacagttttgctttttcaaatgttatatgattcttcaaacctttttgagataaagcagaattttacagtaacaaaatgggtgaaagcagaaattttatacagtctccaaaattgttt

SEQ ID NO: 72574 - DNA, 1031 bp, Homo sapiens
cctgtgtctgctggggactccttcctaattcaccagtcctgggaaggcaggaaacagtgagccatgcttcgtttcataatcaagctgagaagaaaaatgtgtgctggtctccactccatgacattgattattgggagttggataatttttgaaaaagtgttcagaaaattcttggccaggtgcggtggctcacgcctgtaatcccaacattttgcgagactgaggcgggcagatcacctgaggtcaggggtttgagaggagcccggccaacatggtgaaacctcgtctctactaaaaaaatacaaaaattagccgggcatgatgaggggtgcctataatcccagctacttgggaggctgaggcaggggaatcgcttgaacccaggaggcggaggttgcagtgagctgagattgcgccattgcactccagcctgggtgacaagagtgagacttagtctcacaaaaaaaaaaaaagaagaagaaaaagaaaattattgctacaagttagaagaaacagtgtgtgaatggccaggaacatgatgatgctttctcactccagccagaccaagttcaggggcactggctggaaccaggagtggcctctgctttgctgttatgagaaagtaaggaccattgatggtcagtgtcctggggtctattttgagaagtccccgggtcacatgagcattgagagggagactatttactggtctactcctggaccatgttcaaaactaccaggagaaatgcacaagccctgcccacaacaccgttggtgtgcccaattggtgattttcacccttcagcaattcatccatttattccataagcctttaactgaccacattttctgtgccaggtacttgggctggggataaaatgatgaggaaagtgaatgcaatttctgtccttaaggagcattcaatccagcagtggagagcaagaaaaataatcatctccacagtgaatggattaggtgacaagtgttccctttgccttgcctagccaatctagccaatatgccaacatggg

SEQ ID NO: 72575 - DNA, 1047 bp, Homo sapiens
atgttttcttctaccgaattgtagctctgtttctgttcactttgcagttacccttgaatttttcttcgtgcatatttaacataaagtttcaacgtgaacaatagctctgtcccctctgcacaatacaaggacctgagaccacgtgactccaaccaccctgaggtctgacttagtggcaagtgttgtggctcctcctcattctcctgtccagttagtgttattgtaattgttatatactgttggggtttggttagatttcatttctgagctatgtaaaatactgaaaggctgatgcaagcacagtttatgatagttcctaacattccagtaacatcccacaaaggacatgtgggcaacagaaggccagagtgggattaatggcagcacactgacccatactatctgaaagttgaagttgcaatccagatataaggaaagactttataaaagcttgggacgcaacaacattttcaccattatattacccgtttccaagcagtctggaaatcactgaagcaatttgcctttttatgggaggggttgggggaagggcagttcagcaaaggtcactatcaccaacttttctagagcaaatgcaacttgcattgtaaatccagagacatgttttcataggaaattttggaaggcagatttagagggtttcgttttctcaagatactgtgcacagtgaccagttctcaaacagctgaatcctccctctctgtcctagctgtggctcttttctcactagaagaccctgaggtctgttcattctgttgctgtaccttcagaacttgatacccattcttttataaatgaaagtgggctgctgctttatgattcctcacatgtttgaagctgtaatcagatacatggatggttaaaattaaatctgaagttaacctgaatttcagcttctgtgggcacttcacccatttcatcatgcctgacacccatgttacagtacattaatgccctgttaattcagacttaactaatttggaatttgaaagcttaaagagaggtgaggttaacttggcactttat

SEQ ID NO: 72576 - DNA, 1135 bp, Homo sapiens
gcaacatcaaatcaaattacaaaagaaaaggataatttttcttaggatattacactttaaaaggtacacaaagaaagcagttgtgtccattcctgtcaaggctcctcagtgggctagccatgagattggataacccagcctcttgcttagaaaagttgtcgtttaccagcactcattccgctatgtgctgagacttcatgcatttttcatcagaaaacccaggccaatcttggggcttccccccatcccagaagcctttcttaacacctttttaaatttattttaactctcgctaaaaagggtggcatttaaaactcaatttttattggatacaagagtctattaagccaaaccattagtgttcaagaatggctgcttcacttttattttttataaatgtgaccagccaagatatgctgtggttggtcagtgtcggggtcacagaagcacatggaacctccagtggcatcccagggtacattcctttccgcggttgttgtttgacatttgagataggaagaatgtgttcctatcatcatttgttgtctaatccgtttagattcttaccgtacctaagaatcctaaaactaagctatgaagcattttgacttttgaccaagtatgaaaattattgattctttaaaataaaacaataagaatttgctattttctgagccacctgactcgtgggatacatttataacaacaactagcatttatatagtgcttcaaggcgctttgcgcatagtgggtgagaagtggtctactcgtgcagtggctgggcagcacgttgcagacctcagagcttgtctgcacctctaatgatggggcaggcagagagcagcagcgtcctggagaaacttggtccctagtgcttcctttaattttccttatctgatataccagtctagtttggaggttggcacattgacctctttttttcagagcattttctggtgtgccaggcataatagcaaagattttagatgagaaatacacagtatagtaaaatctgtttttgagcccacctgtgttgaaagaatacctgtcgataaaaggctactattcaatgtgtgtatggaggtctctgttgaatgcaaagctatattcaacagccatgtgtcctcctcagtgg

SEQ ID NO: 72577 - DNA, 1042 bp, Homo sapiens
gaaatcttgcagtcatctcctatcaactccctaatgcactctcctcagcaaacactctaactctgcattttcaataatccccttcgctccccttactgttttccctttcagaagatgatctttaagaagaaacaggtattctccagaaataactagcatgggacaagatattttattagagggcaagttgagatgaggggaggaggatggtaagagttctacaatcccggagttgatgttaataccggcctggaccattttcatcatacaaaggtgataataattgaagcttaaaaacggataacttctaggagagagaggaaatattcatgaacaagaaaaaatgtctcctgtcaacccaagcgcagggactcctctctctccttggatttgtggttcggtccttcaccatgacctgttgatatctaccccctacttccattttcctgccacttcttgagtctaggacttctcttcttcatatctaatttagtagaataccccatcatatacttctgcctcccaactctcctcccttaaatctgaaacaatcactgccaggttaatacatcagtaaccctgcttgccttgcaaaggttcaactaggaggtcaagtccagactgattaatctaatagtcagggtcctccacggtctcttctacaacctgtcttgttaatctcaattcttcatttcaggcacaccagctcattcatttctcacaacattctaggcactatactagttgctggtggtacatttcagagcaaaatactgacctgtcctcgtggaatatacaatctagtggaagagccagacatagcagtcttcttccttccctgcaaacaccttattcccacattgcagcctgtcctcatctcatgagccagtttgttcaccttcatccttaaagcttttgttcagccattctcccccatactgattcctcctacattagttattattggcattcatcacttttctcttcatcacttggcacgtgatgagttacagagaattgtttgaacattttacgtatgtag

SEQ ID NO: 72578 - DNA, 1005 bp, Homo sapiens
ccaggatacgtgtgtagaacgtgcaggtttgttacattaggtatacatgtgccatggtggtttgctgcacccatcaacccatcatctacattaggtgttactcctaatgctatccctcccctagccccccatcccctgacaggccctggtgtgtgatgttcccctccctgtgtccatttcttctcattgttcaactcccacttatgagtgagaacatgtggtgtttggttttctgttcctgtgttagttgattctgaattatccttgagactacatttcaaagacgcaatctttgatattgtactgtaaatgtgtaaaatcaatcagaagcaaagaagcatgtctaagatgacatgcaaatgtattatatacctcaaacagcattactattagcacaattaattggctttaaaactaccattgaacagtgacatatttggggatttcagtcagtaaaacaaatcgattgtttcttatgtcacactatataatctatggtgtctttacctttcatcaaaagttgtttttttatcaagaacttgacagtgggagccaggcacggtggctcacacctgtaatcctagcactttgggagggctgattgcttgagtccaggagttcaagaccaccctgggctttccaccatggaaaccctgtctctacaaaaaaatacaaaaaaattaacaggacatggtggcgtgcacctgtagtaccagctactcgggaggctgagatgggagagtcacttgagcctggaaggcagaggttgcagtgagctgagattgcaccactgcactccagcctgggtgacagagcaagaccctgactcaaaaagcaaataaataaaaaaatcaaaagagacaattaaaacttataataaaaaagaacttggcagtgtaagtccttcttagccaactagaaaattaatttctttttttatgactaatttattacctgattcaacctttaattttttactaaaaaaagctaaccagtaatattaca

SEQ ID NO: 72579 - DNA, 1035 bp, Homo sapiens
aacgacttactcctgatatgcatgcttttcgtccccattggaatatctgtacccatgttgtccagtacaagacactagccttttgttggcattgggtttgaaatgtggctagtcccaactgaaatgtgatgtaagtataaaatgtacactgtttttgacatgtaaaatttcaaaaacataatatgacaaaagaatgtgaaatttctcgatcattttgtgtcattggctagtaaatgtctttgtgctagactgagctctgtgagctctccagagtaaccctatcctctggtgcagtgcctggcatgcagcagataaccaacacatatttgttgaatgagtcatgaattttctggtacataactgatgtgcctgttagttatgtgccatgctggctaactgataggggaaaacaagataaagtggttttaaaaaatgtattattctttactcttaggttttcttcatctaggctgtttccatggaaacagcaaccaaaagattttcaggattggcgtaatgctctttgggtgatatttgctgccattgttaaccaagacccacaagtttaaatatttagatgtgtgtttcttgagtttgagatccaaagtgtaaaagtttgatttgagagaaagttgctaaatatttgcctctttggggtgcctttgaaattcttcccttccattaacataatctgcaggaaagtaagagttgccaaagtacaggtgctattctattcctacaagatacctttgttattgttttactttatattgtctattcctaacttacttcctaattatagctttgtaaatatggattactaattgacctttacctggttagaacataagtatattgtctgtaacgtaaatgaatttcttttacgggaatcgtaagttcagattgcaatgaggatgctagtagataaggatagaggaagttatatcccaaattgttcaaacacctagagccattggcaggaaaaaccaagtgggattccagatcttgaggcactaatttacaaagtagtggtga

SEQ ID NO: 72580 - DNA, 1749 bp, Homo sapiens
gaagccgtagttgggcctgcacattgatcatctgtatcctctatttttatactagagcaatcgggatttctatgcctttcaaccctctcttcatcctctagcaggaccagtcctattctaatcctatcccttgcttgtgactctaccaaaaaatatttttgcaaacacttaagtttgtgtttttctaagaaaactccccttgtggccagtgtggatggtcaaatggagcagggaaaaactggaggcaataaattaaatatttattgatagagtttgtggaggcaggaaaatgagaggcgaataattctgtgtagctggagtagattaataataatgtgttgcaatgtgatatagtaaatgagaaaaagctagttacaaaacaatattcagtatgatctcatttttataaaaaatatgtgtgtagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaactagtttgactggtttctgttccatgcaaccaaatggtccttgaggatgactttttttctaattaagccagcattgaaaatgaggaaactgagaatatcagaggcctagacaagaactgtgatcatgggaattaaaagaagtatatatccatgtctgtagttggagtggtgggggtaagggaagagacaaaaaccatgaccccagttagattgttgtttaaaaacagaaggaaagaagattggggtggggacttggcttcttgctaaactttttggcttttaaagaattgcatcatttgctgtgattggtagacttggcaagggtgggaataatttggaagaagtgtgagaattctggttttacatgagagttttagggagtaaggctccatctttgaggcatttacaggaaagataccagtttactgcttgaattttgggatatacttagtcatgatctaagtaaggtaagatgttttgattatattacagaaggagaaaattgggatgactagaaaacattttcagtccttaagtaggtatagcctagggtaatgtagaagaagccctatttgagagaaggtaaagccaaggagaaggaaaattccatataggggaaatgactgttttggaaaacacatatcccacccgccagtgctctgtgctttgggcccttgtttatctatcccctcttcctgggccagtcttactcctgccgtactcttaagtcaaagcttatgtgtcaggcct

SEQ ID NO: 72581 - DNA, 1072 bp, Homo sapiens
gtttgagacaagcctgggcaacatggggagtccctgtctctacaaaaaaataaaaaaggtagccaggcatggtgacacatgcctgtagtcccagctgcttgggaagctgaggcgagaggatatcttgaacctaggaggttgaggctgcaatgagccatgatcacaccattgcactccagcctgggtgacagagggagaccttgtctcaaaaaaatatataaaattaaaaacttgtaattctgtaaaagcagcaaatgtagggtcaagatagaaaacataagaaaggaatctactttaggcacggaagttaggaaaggtgttctagagattacaggaagggagagagctggctgtgcaaagaggagagaaaatgcattctgggggtatagcatgtgcaaaggtcctaaagcagaaaactggtggcatgaggaactgaagatattgaacaaagatttgcatgtttttgtagcacagtagacaaggagaagggcctgtcctctggagtccatgggaggaagagttggggtagtagggattttggattttaggttcagtgggaatgacgtcttctttactttgattacagagtggggggagatgaattatagggaggctggagtagaagcagagagagacactataaagagttgaagtggcctggaagggtagaagctagtgatggagaagagaaggtaggtttgaggtatattttagaattgaattggcacagaattggtacacttcaggaactgtggaagatgaagaatcaaagatgactactgcctagctttggggccaattactgaaattgggaagcttaaaatggaaaatagattgggaggtggaaaagatgataggagtcaaaagtttcatttgtgaacattgtaagcagtggctatgtgagttggagatcgtggaagagatctaagctggagacaaattttatgagtccttgccataaagatgacataaattgattaaaaaaaaaaaaatagagggtgacaaagaagtgggcccagaacaaagccctaggcaacttcagtatttaaagtttgggtcaaagaagagttaa

SEQ ID NO: 72582 - DNA, 1062 bp, Homo sapiens
atacaaaacacctgcagaaggcagttgggtggagggaagaaactgagaagggggcaggcaggttaaccaagagtcttgtatatgtgaaaggaatctgcataaagtctgtagggacctgagggaaagctgagttggtccaaaaaggactagggagatgaatgtgaatcttatacatcctgtgaaaagttaatccgcatctgatttgcactccaatagcatttcattctaaataaactcatgccagtgattcaagatcagaaattctcttcagctgtaaagtactgtgacttttaaaaagctgattattaaatatataccaaaggcttttaacatgtagtaattctgagtacttgctggtactttctattttcaaagtactttacaagctaattatttacaaattgcatatagctgtaacatctaagtactctaattagttggcataatgcacaggttcacacagaatctcgagagatggaaaggtgtctacaaagtggtctcttcagtactgacccaaagagtgtcttgcatctcaagagataggaaagcatatcaagttccgtggcctaccactccccactcttcttttagtttcccttaaacacgttattcagattttagatggtctccagatcactagacaaaagtcttctttttggttagcgtaatttagagtcattctttgtaacaacctttaaactggtctcttaggaagtttacccaaatctacccatctgctttcaagtacttattaagacccccaaacccagccttttcttgctcaaattcttaatgttgctattttcttttcctgctttataaactatcctggtacagttactgcgtgggtctggtttttttttttttctcatgatgaaattcttctcaaacttggattattagatctctaattatttaactatacagtaagtatgtacctaatagtagcacagtcctgagaaatggtggaaataagagactatgagtctgtcctgaaaacccttctgtggttttggagaaggcagacaagagctgtacacatgaaaaagaaaaccaattgta

SEQ ID NO: 72583 - DNA, 1183 bp, Homo sapiens
cactcctaccttgtattttttctatagcacttatcttctaacatatgagatatataatttacctttttattatattcattatatattgcctttccctctacccctcaaacacacacactgtaacataagctctgtgagagcagagatttttgttttaatgttcactgatgtatccacaacccctggaacaatgcctggctcatagcaggtgttcaaaaaatgtttatcaaatgaatgaatagcagattgactctgtattgtttttacattaaataccccaagagctgaacttgaatttaaaaagggaaataactattctataagcttcgaattgagaaccacaaatttgtggttgtgtgtcttcaactccatagtttgtcacatgtagttggcaagagactgggcctgtccaggaggagtcagacctagaggttcatttaggcaaagggtgaccagagcaggcaaagatagagtgccagaggagtagcctatgcagtaggaaccaagcagatctgatagatattgccaggtagatgattccagaggggtcacctgagctaagaagaattgggcatgttgtttatacacacataagaaggcagggctttgtatctgcaaggccaaatttgactgcaacgcatctcacattaatgagaactgacccccgccaaggccgacaatgttggttttgtgagcacctgttctacccatatacctactgtgtgattttggatttggggaattcccagaccgataatatttcaaaaaaatctaatggggtgaaaggatgtaggattgcttaagttttattttgcccttactttgtgaaatggactttccttcacttccatggaaaattgccagaaatcctagtctttatttaggtgacctgaagcacttgaaggacaaaacaaagacttaaagcattcaataatttgatgtctgttgtgccatttttatcatgtttgctccacaataaattgaacagactcttgcacttttcccttgggtcctcatgagcatttgtctacaactgttaataagttacatgggatctaagaataaattttcattggaattcagatttcaagtgaaggatcacccaacattgcgatccctcatctaacattatttcagatcctgagttgctgctttgttctgcatacttaaacataagtcccgg

SEQ ID NO: 72584 - DNA, 1032 bp, Homo sapiens
atctatgattactattaaaattataactataaaatgattatttttttaaaaattcttaatagatttgttcagtgctctatagttacaaagtaactatatatatatatatatatatatatatatacatacacacatatatatatataaattgtatttaatccccctaagaattctgaaaggatagtagaaatatcttcattttaatcgcatagctttgtgaccttgaatatcacaggatcacagagctagtaggtgcggaactgggactcattttctcaccactatattgtggctgctttcttattctcttaaggttacttgatggtgtcctagatttaaaactgtaaaggaagaactgcataatttgtcttctaaaagcactgagaggtgttttagggactatataaagatagaacagttactgagtaagtctattcagtctggatttttcgggtaagaaattctgctctgaagcttgtgtattgcagatcacaataatcatagacacatcacatagcattgggatagtgttagtgttggtacttaaagtgttgtcctctaaaggtaatgatcctgggctaaaatattataattataatctgtctcctcatcgtttctccctagggtgaccatacatgccatctaggcttaaatattggtaattttgagttaaattttcaaaaaccagatattatttagtgttaggcaagttgttaacttctctaaaccataatttcctcggttttatatgacaaagttaaaccagatggcctctaactctaacatttgagaaacttttcccttacattttttaataatatagattgtatttaatggatctttacccaaacattttggttcaggtaattaaaatgaaagttatagtgaaaagatccttgaaacttttctaaaaacactgggcgttcaggaattaatatagtgtatgtcccgatttctatcaagcaaacgctaagagagaattgtaaatttaggggtctaatatttcaaatgagatgtgaaagtatggtccca

SEQ ID NO: 72585 - DNA, 1787 bp, Homo sapiens
gtaagcgtaagagtgtattagactttgggaggaagccaaattatgctgtttggataatcagcatgatctatctctcagaattttcccctgcggtctcaattgggtacctattctatttttaacttagttctaaactctttgttagcattgctccatccaattaagctgcagctgctgttccatccctaaggattgtttatgtttcagtggatgagatggtcctaatatgtacggctacttaaagtatagttttaattcagggacaagaaaagattgtgtttaagtttgtgatattttttaaaacaatgcatagttaaacattggctctagaacatgctttcacatttcccttcttagttatatcatcacatataatttataagtctctgaatgataaagtgtggtttgctgggttttggttgtcttgcagctggtttctgatgccagaatcatcgattgtattactctctgtggtttctttcttttggcagctgatgtgttgttggtatgatatgtgttatgatataaaggtaaaggttggattaatcgtaatagaattttccatgccttgggtttttctccatactatagagattagtctccatgagctgcttccttccttcctttcagttaatctctgcagcctttctagtggttcctcctgtgctgttgaattcagcatctgtaagaatgtgtttgcattgtaccagagctctacaactttggccagctaagaaggaagcatctctgggagctttgaatgtcaatataaaaccttatttgcacagttgtgcacttttggctgacttgttcagtggaccatctaagttcatcactttgaacttttataaacattttccttaaagggatgctgctctcaaagttaggtttatgtgtatgtttaagcgcttaactctattaactactcctttatataaatatggaattttcccaaaacacttgtatatatattaactaagtttttaaaattgtaaaatgggatttaaaattaccttgtcctacttaatttcattgccgtataaattggcaccagaaaaacaacttgaaacttgacggtgtagggtttaaagagttaagaatttactgatgggttttaatacattaaaaaaaattttttttttttagagatagggtcttgctgtgttgcccaggctggcctcaaacttttgagatcaagccatcctcccccatcagcctcctgagtagctgggactacaagcatgtgccaccacactggcataaattttttttttgtatagtatatttttgtagttaattattgatgtagaaaatattgtctacgtatatatgtactattttttcaaaatctctccctgccagtgtgtagaggaaactaccatatgcctcaaagccatgtttgatgcctagagtgtgaaagacagaaaatgcctggtgatcaagatgaggcctggtctggcagtccccacagcaggagggaagcacagttgctctagagtgggctacaccctctatttcactggcccttcatcatctcttgcctctaaggcaggactgtgccttgcacttaacggtcacaggactgtcactgaacctgtgatgttgtctgtggagtgcaggctttctcttcttcccatctcattgtgtattgctagatttctaagaattagaagtatacacatgttttcttcctggggttaaaaatggctttattcagatgatgacaggtaaattatttatcttgaaatagcattttcaagagactaatttctatgtgtatttttaaa

SEQ ID NO: 72586 - DNA, 1063 bp, Homo sapiens
aaacagggagatcgggaaaggcttggtggagaggtaatgtgagagctgagtgtctggtgtaaaggttgtgagtggagagtgatttggacagagggcataacctgggcaaagctcccccgtgcatgtaacagcaaatgtagtgttggcagttggtgggagtgtctaagccatgttatgtctctggactgtcagagccaaggccctagatgtggttatcccacagagcatctgtgtggcaaggccttgcagagacaggccagtggccccactgtgacatctcaccctctctgtagtggcaccctccactccaacactaggcgctgtcatctcaaaacacaattagcatctccactaagaaatggagttcagaggatgttaacaggtatatatatacaatgaagcaaaagaataatattggaagctaaacaaaggccatttatctctgatcagtagctcactgaagggaaaagtgttttccagatctgaaaccttgctgagattttcagacagccctagtagatcaaagtcctcaatcctgacaggaaatattccagctctgcctcattctgtgtccttggtcagtgtctgtggtttcccagtctgccctaatgtttgatgacactaaggatacgtgttgctgttgtgcccctgtttgtttggccactacaggggattgctccctcaggaacctgtagctcttcatttttttcattacatttatttacccagtgacatactatatttttttcttttatcttcttctcacctcctttgtctttcctcttcttccatctcacccatcatcatctattctgtctacagatgcagtatttttatttttaaaaccttgcatttgtatcatgtcccacacatacccagaacccatttattccccagatcttaacttaaccatgtatgtgccaggcatagagaaaactaggttgaaaaagacaagttccgagacctttaggagtgtaaaaaaatagctatcatatttcttctgcttcctataaaatacagaacacttggatccaaatcaaatattttattttatcctcataac

SEQ ID NO: 72587 - DNA, 1011 bp, Homo sapiens
tactcagagtttacactaggtggcatgcaaggaaagctaacaaattcagaaactcgattctgtgggagcaggattctttggtactaatcacgatagtgggtccagctttggagttaaccatttgatttgtgatggtttttcttttctcctccccaccccaggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaa

SEQ ID NO: 72588 - DNA, 1150 bp, Homo sapiens
ctcagtcctcaaactacatgttttagtattggctaattaaatatggtagtcatgttttaggtgtttaaggtgtttaagcagtaccttatttccaggcaccaaactctgttcctactatccattattatttaacaaaccacctcaaatcacaactattttaataccttcatggcttaaaatgacaaggtttattctcttacagttctggaggccaggagtctaaaatcaaggtgttggcagggctggttccttctggaggtttctgggagagaatccatttccttgccttgcactttccaaccttttttttttttttttttaacagtgaaccatatttcaatttattgacattgtcaatttatgaacaagacaggatttttttttcccatgaaatgagatccttttcaatctgccataacatgtgcccatacatcttcaccttggaaatgcagcatttcaagctttagtcagggtagattattccttctttactttcacaatttttacgctgttgccagaagtctttttggcatttgctttgaattctgtcttcagtgcatctctcactacttttgcacagatctgggagtatcggatgtagctgagtccagcctgtctccagtaggccaccatgctgtagcgaaagcggagcgcgtcgggccaaatcgccaagactctggcaatgtccttttttttctttttttttagacggagttttactcttgttgcccaggctgaagtgcagtgatgtgatcttggctcactgcaccctccacctcccgggttcaagcaattctcttgcctcagtctcccaagtagctgggattacagacatgtgccaccacacccagataattttttttgtatttttagaagagacagggtttcaccatgttggcctggctagtcttgaacttctgacctcaggtgatccacccacctcggcctcccaaagtgctgggattataggggtgagccaccacgcccggccaccctttccaacttctaaaggctgcctgcacaccctggctcatggccttccctcccatccatcaccgcagtctcttgctcccatcgtcatcacatagccacattctggggtcaaatctccctgtgtcattttaagccacggcatttgtggtaatttgac

SEQ ID NO: 72589 - DNA, 1633 bp, Homo sapiens
gctagtctcaaactcctggtctcaagtgatcctcctgccgtggcctcccaaaggaggtattacacgttgggattacaggcatgagccaccactcctggcctagtgtttatacttcaagttggactgattttaagggtttgtatgaaaccaatgcttttttgaattattttaacttatttcgtgtagatatgcactctaagggttgtttataaagaaacatgcacagccatatatagaaatggttatgttttatgaacaatataactagtttaatgcatagttataccttattttaactgcctgtgagccacaatttcaggtactttttaatatatatttttgtattaaaattacctcaggagcttagcttttttcttctcttttaaaattatgcagacattaaataagaagttgagtaaacagattcaggactctagaattaaagccagagctagaaattcttaacttataatttttaaggcattgagttagaagttacatatgagacaaggatttgtgggcatgggatgaagggccttacaggatggagagaccatacaggctatggagtgagtctagaaagcatagaacgtgtttagagaacagaaaatacctaattttataagctctataaggtgtatgaatggtagtacaaatggagaaagggtattagagcatttactcattttattcatagtcaacgggtaccctcttcagtggatattggaatttatgttttacagacaaggaaacttagttatgtgttttgcccaggctaataagttatggaagcacaattcaaaataggtctgtagctttggctttgaatacctgggtagtgagtaaaattttcatttcatgtggtggtttttacatagttgtaatccaagcagtaacacttacaggaagattagattgtcagtaatgtgaacagtagattggaggggaagaagcaaagagagccagtcttaattggttggatacttttatttctgtattcctcagtgatgttataaataaatattttgtttttcagagaatgactaatagtagcagctccccaagccttctaaatgacagtgccaagccatattcagcccatggtaagacctgatcccttttgcttatgtgtgtctgtgtatatatttcttactctaaaagtaatatacaaccattgtagaaattttgaaaattgtaaacgggcataaagaagaaaataaaaattattatcttcccactcagatctaactattgagatttagattccaggccaggtgtggtggctcatgcctgtaatcccagcactttgggaggctcaggtgggaggaatgattgagcccaggagtttgaaaccaacttgggcaatataacaagaccatgtctctattattaaaaaaaaaaagaaaagtgtataagttatatacaaaaatttcaacatgctattttattaacatcttgctctttgcactattagttatttaatattaaattcatgttaattttaatgaaggtaagtctgaaaaaccaggaagaagaaggcagagaaatgaagcagcagtctatatgtactacattgtgaagagatttaaggttcctttacgtaagggcatttaatatattttttaggatttag

SEQ ID NO: 72590 - DNA, 1118 bp, Homo sapiens
tgtgttgaaatccaagacaggatctctcagagtctatggttgacactgcccccacccctcaccctcctttttatccttcccaagatatggtctcaagattataaacctttatttactttaggtcaacttactgccttcataaacacactcacaatagtatggttaagaggtttttttctcttatttgatttttcttttggttctagtcaaatagatctatcctgatccatatagcttttgaatatttgagcaaattggttcaccagtttgtgttttatttgctcagaaaatatttgaacataactgtgtgttaggtactaagtttaattattgtgtcatttgatttttataggcattgtcaaattaaacagttattagatttgcgggttacccaagttttatgtgtggaaacttacgtaacttacctttcagatcctctaacatcacctgcttcatccttgtttaatgactttggtgccctcaacatctctcagagacgaaaggtaggtgaaattgaaacttgaattaaactaaatggaatttagaagtgatgttggcattgttacctatgtagtgtcaatgtttttgtaagtggagggagagctttttatgggctttagtgtttttcctgccttttgtttatcctttttctttatctttttatatgtggaaatttatttgatctctgcatggaatagagattttgtgtgaagggatgaaatcctgcttatttttgttcagtttatttatctcaatgtattctgttcttaagataacatctaatttaatgttaagttgctgttaatgtgacccattgtaagcatgttaatcatgtttaaactttattttttgatggctttatctaaatttcaaaaattcttccctaatttactcctgattacaaggcaaacttaaaattttcaacatttcataatgggcccaacaatttaaaaagttgaaaatctcttcacattagaaatttaattttatttggaatttagattgatagaccatgtatggatttttgaagtattttataaggactgatgttgtgacaagttgaataatttgatgcctttgagtcttaatgagaatcttgttaatactaataatcatct

SEQ ID NO: 72591 - DNA, 1578 bp, Homo sapiens
tactcataatgtgtcatgggaccagtgctagtctgtgaattgtctgttaggagataaacactgaaaataaatgtctagagacttctataacaatttgataatactgtgacattcgaatatggaatcatttttctaattatctttattttacaaaattataggaccatgatttataggagattttttaaaaagtgatcttttttgatgtttgagaagcactgattttcttttatttgtcacattaggaatgcctaattttatagagagaaaaagtaaccattatttgaggtttgttaaaaataggagttaatatacaagagattattacatgagtaaaccttaatagcaagatagataaaattaaatttgaccactgttatgaaaagaagtagttttgagagtcactgaatcacaaatgtgatctagacaagcattaaaatttccaatgagaaattatttgggaacaaaatatctttacaacagagttagatattggaatacagatattcataaatgaagtgattcagtgctatgatatcttgctgatgattcttgctaagatagaagtgtttatgtagggcaaccatgtatgattgaggcaaatcccaggcaaaatgagaaatctttcaaatttgtgtcagcttggctttctccttttatatctttctgggctattgcccttcttcatcttctttttttattcacctagtcacatttttattcagcttccccctacttcttccatttctttggtttatacccatcgtttatatttctttggtttactttagtatgttgtttcagtcaatatgcggttttatgtggatatttgtattatatttttaatacggagataacagattttcacttctgtaaatttttttaagttttaataacaagttaaattctttggggttaggaggcaaagacttttgaagtatcatgtttatctcttctgttcttgcttttaaagctttttgttaggactagggaagtgggaccaaagggagctggctggttcgtctgctgatagcttatttttgaggagatgtggttgctagaggtacagttctggattattctgcttgagagaaaaattcaccagcagtacttttctccgctttcttctttgtttgaacctagcttgggtctcccttttgcactgttgtttatcttaagagcacccatctctctctgttacaaaacttactgatgataaatattttatgttttctgattaacttgacatttaaaagttttcttatagcatttttattctaaagtcttcctttgaaaaatgatttttacattatttctattctaggcaagcaaatatggaataacaaagactagagcatatttacggtagagttcttctatggaaaaagataaagtaaatttggagaaattaatctgagtatagcatagacaatttggaatgtaaatcttaatccttctgatggttaagctaggccttttttgcatattgaatcaagtattgatgtcagaaaaaataaaggagaaaatggagaagacattgaaaaataactaaaattttaaaggagattgtaatctaaa

SEQ ID NO: 72592 - DNA, 1031 bp, Homo sapiens
caaccatgtacttcctgtactttattttaattggcactttgtgtgcagcgaccatttgtttttgtttaatccagaaaacttcctccaaattcatgattgtaggagaattttgttctgttgattgatttttaaaaagagctctcatgagtttgttttggaagcctttttttttaaaggtgtgtgtggtagtatggtgtttgatgctttatcatatttaaacgtgaactgaaatttttttatgccttttatatacagtttgtaatactgttggctgtactcatcatctaattttatagctttgaagattttgagttcttatacacagtaatggtagtttaagtaaaaccatggtgcatttatctcttgaacctacaaactagtagatcattctaaggttagctggttggcttctttacactctggtcattctatttgcgaagtgtagtagctgatatttaggggcctagcattattgatagctcatccctattttcctaggaggtaggtatggggaatgaattagtaaaggtgaacttaaaattctcatccacaaacatgctagcctaagctccaaattaaatgtaaccaaaaccgtgtggttttccccaactctgttttattcccaagatttgttgtccttgtattttgaaaacggggaaggagaacttttaaattctagttatttgaatgaagtctttatcagttctcattgattccatccatgctaattaaatacaaaaatatttcttcatttgggtatatgtattttgttatcttaggtttagctagaatgacattaagattgtaatgtgttaaggagtattacagaatgtggaattgatttctttgagttggatatgagatgttatagttaagagtacaattgttggaacctgaccctatgttaattttgagataataggcaagttattttaaccttctctcagacttacttttatcatctgtaaagttggtataaaataggcgctatgtcccagaattatgtgaattaaatacattaatggatatag

SEQ ID NO: 72593 - DNA, 1653 bp, Homo sapiens
gcgggggtgggggtagagattggggggttctcactatgttgcccaggttggtccttgaactcctggccttaagcagtcctcctgccttggccttccagagtgctaggattacaggtgtgagctgctgtgcctggcctctgctggatgttttaccacgggaaaaggggtgtattagtccattttgacactgctataaagaaatacccgagactgggtaatttataaaggtaagaggtttaattgactcacagttacacatggctgagaggcctcaggaaacttagaatcatggtaagtgataaaaccatcagatctcgtgagaattcactcactatcacgagaatagcacgggggaaaccactcccatgattcagtcactcccttaacacatgggcattattaatataatttgagatgagatttgggtggggacacacagccaaactatatcaaggggattgggaattttgttatacaatgttaacttacacgtgtggagcacaaaagctggttatcaataggatgtggcattttcaaatgcttttatttcataataaccagcaagatgggactggtcaggctatcaagaatagaggatcaataagggaatttaccttttttgggggaccactgtgttcataaggttggtctaggtaaggatttctagaagctcggaagggaagaggagttggtgcttttgtttgctctgaaggaggggcttggatcttaaagaactgaaaaaactttagtaaataaatatttcccttaaaattgtgtttgccctgtttattttctgatcttctctttaacctcttcctttcccttagcacctgcttccagttaatcaccaatagtggtttttaacctaccagatgttgccacaagtaagctttcactagttctctatttctgttattattgcctcaagttcatatccttctttctcgactagtgattcgtagccagggcagttgtgtctttttacccccagagaacatttggtaatatctggagacatttttggttgttacaactgggtacttggtgcttagtggtatttagtgggaggatagagatgctgctaaacatcctacaatgcacaagacagccccccacaagaaagaattatccaaagtcagtagtactgaagttgagaaaccctaacctagactactgccagagtccactaatttgtcgacctatttccacttttactccctcttccccaattcttcctccacactgccacagaccttcctttctaaaatacaaatctgattttgtcatttattctttaccatggaatgatcctcagattccttagcttaggaaacaatatgtttatatttacttatttattttaatttttttttgagagatgagacatgtcactgcagccttgacctcctgggctcaagcgatgctcccacctcaggctccagagtaggtgggactataggcatgggccaccatacccggctccttttttcattttttgtaaagatggggtcccactgtgttgcccaggctgatcttgaagtcggctcaaacagtgctctcatctctgcctcccaaagtgctgggattacaggcatgagccactgtgcttggcactaaaacaatactttttttttttttttttttgagactgag

SEQ ID NO: 72594 - DNA, 1509 bp, Homo sapiens
gggattaattagtaatttggaaattagcttatagatgagatattgttataatttacattctatgcaataaaacttttctatgtaatctttcgcctcaccatcatgttttacattgctaccatctcttttcagatgttattttgtattttgtcgcttataatggtaccttaaatagtattgataccttagggcaggagtgtccaattttttggcttccttgggccacattggaagaattgtcttgggtcacacataaaatacaccaacactaatgatagctgatgagctttaaaaaaatggcaaaataatctcaatgttttaagaagtttacgaattcttgttgggccacattcagagtcatcctgggcctctggttggagaagcttgctttaggatattttcatttagttacacagagaagattttacttttggattagagtttaatctctggctatttattgaaaaaatttagggtttataatggcacatgtttagagatctcttctacctattgaggagaggctttaggctagttaagggttttagggcatggagtggaaggagaggaatgatgaattccctttttgaaatgaagaaacgtaatttaatgagtgcagttaaagagggaggatgatacgttggatgtatttaaaaccatttttggggacgggcacgtggttcacgcctgtaatcccagcactttgggaggccaagacaggcagatcactggagcccaggagtttgagaccagcttgggcaacatggagagactcccatctccacaaaaagtatagaaattagctgggcgtggtggtacacacctgtagtcccagctcctacggaggctgaggtgggaggatctcttgagcctgggaggcagagattgcagtgagctgagattgcaccactgcactccagcctgggagtgagaccctgacttaaaaaaaaaaaaaaaaaaaacccaagaaacaaaaactaaccaaagagcaacaaccttttttttcaatgttgtttactgtactactacatagaaagtgaattgtattgactgtaataactgtgtcaaaagtacatttgaggcccagtgcggtggctcatgcctgtaatcccagcactttgggaggccgaggcaggtggatcacctgaggtcaggagtttgagaccagcctggccaaaatgatgaaaccccgtctctaataaaaatagaaaaattagccaggtgtggtggcaggcgtctgtaatcccagctacttgggagactgaggcaggagaatcacctgaactagggaggcggaggttgcagtgagctgagatgataccactgcgctccagcctgggcgatggagtctcaaaaaaaaaaataaaaagagacactgtctcaaaaaaaaaaaagtacatctgaatttgtgaaggatctgaattacggaagaccttttaaaataattttcatgcattcagatatatgacctggaatttaggtgtccatgtataaatcatttgacaacct

SEQ ID NO: 72595 - DNA, 1842 bp, Homo sapiens
tttttgaagaaacttaattttaactctttgtttcagcagtcttatacctcatgacagaacaatgagtaaacatatattttcttatttcagagtttaaattaattaccttcctaagcatgaattagtgttttctgaagggaaaaaatacatacaagttttccttaagatgcagtctagtgcaaatttgctgtaattaagagaagtgagatagtggaaacaagcactaattttcatgaataaaagtcctgctaaccactattaagatagcttattaattttcttataatgttaggcaaataatttatgattttattgaataatttattcattatcaatctgttcatattattgagatttaaaagaccaatttgtgttactgttttgttgttgttttttagtctgaggtttttttttttcattgaatactttagggtgaatgcctatttaagatagagtgagttgtactcaagtctaacgtgcatagaattaaaattttttaaaaatcaatttattaggaaacaactgcgtttttaaaagtgggttagttctcagtaggaaataaagtaacaagatggtgagctgaaaaagttgtagtttggcgaactttataaaaaagaaaaatctgtattctgtgtccttgaaaccatttcttcatattgcagtgagaataggtaagtgacagtagaaaaaattttgcaaagcatttttctttgctgataagttaaatttctattcattaagtaaagtcgtataaaatcagattaaatgtatttttctaaaaacatctgttgctttatataatattctttagcccattaggagtgtgggttattttggaggtgtgggtttggtgcaggggtgggaggtggtgggtggtggtaaggatattagaaggagtgttttagaaacttgtttcctatcccaccgttcccagtatcctgtatatgttagttatgttagtttagattagtgtgggggatgttaggagtggcctggtttctttccttctttttcctagccaaggaagtatcgcctggggatgctggaggagaggctagttccgatgggatcaaaggcacgaaaagcaaagaaccctattggctgccttgctgacaggtgtaaatcaggagtacccatcaatatggtttggtggaacagagtcacagaaaacaatttacaggtaaaaataatttttattagacatttcttgaaagtgaatgtcttggctgctttctgtgtctgtttggggtggtggttgtgaaaggattggatgacttagctggtatacttaggtaattaaaaaaatttttaatcagaataaagttagtgacccttaaccaactaaatgattttttcttggtggctttttgagcttttcctctttgtagaatattttacttttgtttgtttgttttttgttttttcagacagagtctcactctgtcccccaggctggagtgcagtggcaccatcttacctcactgtaacctccacctcccagattcaagataccatgcctcagcctctcaagtagctgggactgcaggtgcacaccaccatgcctggctaattttttgtatttttagtagagatggggtctcgccatgttggccaggctggtctcgaactcctacctcaggtgatctctgccttggcctcacaaaatgctgggattgcaggcatgagccacctctcctggccgaatattttactatatttagttaaatttagtttttctgttttcaattttgttaatacttgagttcaattatttttactacccaagagttattcaggataggactacattgaagagtcatataaggccgggcatggtggtgc

SEQ ID NO: 72596 - DNA, 1003 bp, Homo sapiens
cactttagagtaatgaccttgtgttcttcatggaagggagaaaaaaggtcattaagaattcattgtggttctgtctactgtgacaaagtttaaaaattttagaaagaataaagtgtgggctgggtgtgataactcattcttgtaatcccagcactttgggaggctgaggcgggaggattcacttgagcccaggagttcgagaccagcctgggcaacatagtgagacccctgtctctacaaaagaaaaaataataattagctgggtgtggtgacatgtgcttgtagtctcagctattcaggaggcagaggcaagagaatcccatgagttcgaggctgcagtgagctgtgattgcactgttgcactccagtctgcgtgacagagcaagaccctcttaaaaaacgaaaacaaaaaaactgtttcttaaaaaaaaaaaaaaaagaaaagaaatgcctcatgtatcagctttctacctatctatattttcattaatattcttatttttcctcctgtctcagacaaataggtgtttgttatatactgaaggccatcttgatttttttccagcaacttattccttcatgtgtctcttcaatattactcttatttctctatgttggttacatcctcttaacttataagcattccatgtttaaatcttttctgatactttatgaaccccacaacaaagcatgctacatgaggaaaaggttctttggtcagtacatttggaaaactctgcgatacaatttgggaaatggttcctacttattatggtgactactttttcaccttttgttcatcccttaattcccaatattttccctttccttttcaccattctattgaaactgtttttgataagatcgtctaactgacttttttttttttttttttttttttgagacagagtttcgcactgattcacccaggctggagtgcagtggtgcgatctcggcttactatagtgtctgcctcccaggttcaagcaattctcctatctca

SEQ ID NO: 72597 - DNA, 2019 bp, Homo sapiens
ttagctcttagattgttattagtgggttttttttttttgtaagacttcttggcctttgtactgccctcaagaactctgccaagctctgtcattgactgttttttctttcactctttcttcatagtgctcttctgtaatctcacatgtcttcaatacttcagctccttcctagtcacatttgactcctggatacttttttcccctcctagtcctctgcactcattctattatatttctggtttcttctgaacatcttcatctccatgacataggacttaaaactcaacctgtctaaaatgaacaccaagttagggatcctccccctctcacagaggcagggcgggttcctgtaaaaaataaaaataaatgaataaaaaataaaatgaacgctgtatatttttcttcaaacctgtttttcatttacacacatctgtagacacttattcacaactatatgccaccatatatcttggttattgatatcatttggtgtctaacttgtgagctctttttgacccctcacttccttacctgccatatccttcagcaactaagatctgttgctggtttgaaattatttttactctgttagttataatgtagatccacctttaattcttgcttggattattatattgtggtgtcttagctggtttcctgcttctagtcttctttttcaaacaactacctgattgtctgatcttgcctctcatctttgtcattgggggaaaaaaggtcaaaatcccttatgaaggcatccaagctgctccttgctcttgttcctattgaactatttgtggtaccatgtagctaccatgaagagttccatgttcttgcttctcctttggctattctttttgaacattcaccttggttgatgtacccttccttctgtcttgatttagcaaacttgtcttttaagattgaattcatacatacggtcttatggcctaattaaacagcattagatgtttgctcacattgtcctagcacttaccagattctaattattcatttatagaacttatcacataaactaatatcaatatactgatcatggcacattgtagataatatatgtcttttgatacatggatgttctgagttcttgagagtgtggaattgggttcaggatacattgtatacctgtgaaatgtcagcctgtgaacttgtagaacacagtgtctatgttttatgtctttcttcctcacagcgcctagtacactgccttgcacagtgtcttttatatattaggtattcaaataattaaatggatggacctggattattgattagctggatgaatatttgacctaatgtgttcctgaaatttaatgctttacatatttttgtaaattttcccttggtacagtttcattaaataaaatatcaacgtggaaaatatttgaaaatcttaatatatgttaaaatttatgattaatatggtaggattctttgttagaaagaatacatctaagtattataaattactgtggaatatgacaaataggttttactgttatatggctatggatagaagatatgcataagtagcaataatcgtagctgtgtaaagtagttcttgcctctttggaatgttgtgatagtctcactttcctgtactacttattcactgacctaagtaaacatttttcctccttttagggacagtgatagaataaactaggtggtatgccctgtgattatgaattattactgttattggagcacttttacatgtaaataacttcagattcttttaagtacaggttcagtataccttatccaagatacttgagactataagtgtttcagattttttttttggggggtatgtttgaatccatttagtggttgagcatcttaaacctgagaagacctggcccgaaatactgcattgaacattgactttgagcatcatgtttgagctcaaaaagtttcagattttggagcatttcagatttcagattttctgattagggatacctagtttgtagcagatgcacacatccggtttta

SEQ ID NO: 72598 - DNA, 1756 bp, Homo sapiens
gcattttggactattttatcaagatatcaatggcttttatcttgaccctcaacttctaagatttaggtttaactgggacataccggccctgacatacttttcattctgttggtagccatttgttcccttataactaggaaggtactacgttagtaaaatgcagtggctggttttcttctccagaaatcaaggaattggccatctgtttagagaacatgccactgttttcgggaatgttatagttggaaattttttaaaaacacatttaagtcacaaaagaggatttttttcccctttggaaaatatagcctcagacctgattatactttttcagaaattcatgccttagatgtggcagtaaaagattgattctgtagttctagtgtattttaattaagcccagatttagcatttgttctatattttatcactttttatttaactttagctggcacataactgataatactcgttttggagtttacatttgggttagcctggtgacttgttaccttccagatctagtattttgaactcttaactcattcaaattaaatagggaagttgttctttctgcctcctgtggaaatttaatgtgggcaatattatatagactttttatgaatcttatgtatagtctcatatgttctagtatttcttaaagctaaaaatagcatgccacttgaatatataaagagttgtagcatagtaccactgtgaaaaaggtgttttccgtgtaatctcatagccaaatatttttcagtgtaacaagtcacgcatggtactgcatgggcattaggatcgctttagtttttcttatatcttgattcctcccatatttgccgtgtttttaaatgtttctctaacctttactttgttacttaaatacatgataccatattattagggaaatgtttgaagtacctacaaaaaagaaagtgattaattttggaagaaaggcagttttgacctttatcttggtagaagtggtttaaagatactaaacttgaaatttgttgctcagttttgaggtaatctcaacctcccagttctctaaaacttagtagtttggtaatgatgcatgcttgataataaagacaaattttacacattactgaggttaaaattctgcaaatgaaatgattaaagtcttcaaatttgatgatcagatttcctttaagaaatataattatgacacaccaaaatatggaaccgaaaacacttgttaatcctttcaataatatattttacttagtaaataaagcactgtggaatatgcctagtagattcaatgtcttttttcggcttaaagtgtgttaacttactatatttgatttttaaatagacaccaaatcctactgcaagcgagtttattcctaaaggaggatcaacctccaggctgagtaacgtgtcccagtcaaatatgtctgccttctctcaagttttctctcacccatccatgggaagccctgctactgctggattagcgccaggtaagttgagtaactatttccagtgagttccagataccatgtctgtaagcaccatttactattaatttatcagaactgaaattgtatacttgaatgattcacatttgaacattaagagctttatgttctagtttttggtaccataggccaaatgtgtagttgagaattttaaagcaaaatttaaatatgaatgaaattacatataagaatttttatatataaaactcacaaaaaaatttaaaggggaaatggttatttaggaa

SEQ ID NO: 72599 - DNA, 1036 bp, Homo sapiens
ttatatgtctctttccaaagcatccgcaataatgggatccatatagcaatcagaaaactttggccttaattacatgccagtttattttgccctaacaatacttccttcctcgtatcagaaataaacattttgttaacttatttcatgaaactaatttagacatgccattcaaaaaaaattagccttttcaattggaggagttaaaaatattaaagggaattttaaatttaaaaacattcagtttaagaaaatccattaatgcttatggtataggtataagcttatttggaggtaggtatattcattggtcccaattggacctcacaatagaaacttagggtgaaattaattaatttaaaaattaaattagctgaaaatctattcttctacatagccctagcattaaatggttattctagctcctcttaacaatgaaagtgatcactctctggaaccattggaaataggtcattatatcatatgaaatgtattcttgaattctaatgactattattttaaaagtgctcttcattcagatgacaactcagttaaaatatttttcaacaatgatgaattattttgcattaattattttttctgtttggttattggtttaacactctggagatgagcaaagaaaaaatatttaagtctgcctttcggaaaaaccattgtactctcagtgtcttccatcatttcttacctacaaatgttgttttgtttaaggaagggttcttgacatttgccgtgtaaggttatagaataaataaagagtttatttacctacggtagtggtgatttagtttatttttaattcttactgtctattataggtgtaactcattgattttagttacaagtttttaatttaaagtttctatccccaaaactattgccctcgaaagtatcaaattactataaaatatgaaaccttaaatactttgacacttatgtaaactagggtaacatcattttcattacgtatgggaaagtacatatctaaatatatttttgaccaaatatatttgtcaaaatt

SEQ ID NO: 72600 - DNA, 1579 bp, Homo sapiens
tttttcaggtatattcagcagattcattcaaatctttccaagttatttagtttggagattgctttcttcattaaaaaacaagtaaattaacaactattttatgattaagatgagggatctcaaggtttttgtgaagtggaccttttaattgccctgtaatgaggagctcatcctagaaggaagctcctctgtgtatgcatgtgtaaggacacagattgtgatgcccctgggaaatttactaacagtagaactgtagaatcataacagggttgggagtgcctgctggctatattcccttctcagttgggaatttcaggaaactgaggcgagacgtttatggcgcagagagggatgtggctgctgcagctggcttggagacctgtcaggtaaggcttaaatagctaccagtagataatattctactggttgtggaatccctggttaatgggtcctcataggtataagagttcctcttgtgaacttcctgtttaaatctcattgaattggctattttgtcccataattagggggtaggggctggatgggagtgggtagggatttcctttaactacgagttaccgatccagtgatctacagctgcagcaaagtctcttgctgctcttggactgctttcagtgtattatgactcgattgcctttagaacatggtaccagttctactgaagcagctatgtgattttcagcataccgcttggtttctgtgttttagagtcttcagttctataagaaggtaatagtagatgattttaagtctttctaatctaaaattctgtgtttttgagacatggaaatctgtagaagcatagaggacagtaaagagacagaaatgaagacagtggtgcgaagtagtaaaaagggaaggataacatttgtactagacttaagaaagattttagaaggcatatggacttcttgacttattctgtgtaaatagaaaatcttcccatggctccctttgtttcataggtggagatgaggggagttttgtttcagcaaatgtaagattagagtctggggtgaatcagagtattgtatttgttctggatgaactgagaagcagagagaacaggtgtaaatgaatgcccgagaatgtttccgatctgtttcatagctgaacgtggagagttagatgtcgatcttccttccaccttcttctttagtcaagtaggttgagagcaccagggatcattttttcttcaaccttttagctcagtgatacccagagcaatgtgcctactcagtggagaagatagtatttgtgtgaataaatttactgttctgtgtgttacatgtctagttaggagtggtcctctaattctgtaggaatgaatcagatggttgtagccccttctgtttcttgaattatcctttgattcttctcagcttgaccatgaaattcatctttttcttattcttactgcctttcagatgtagttactctagagtagggcatgtaggtagggtcttagtaaaaggagaggaattatagatgtggcctttttcaaacccccaatgcatataggcatgtaaatcctactcataaatgcctgcaacaacct

SEQ ID NO: 72601 - DNA, 1515 bp, Homo sapiens
ctatggttctggaactagtaatcagatatcttttatttacatgttacactttaatatgtatgtttttaaattgttacaaaaaaatcaactaaattgttcacatgagaacatgtcctggcaaaaaaagaaagagaaaataagagaaaacaactaaattgttgttaatgttagataaataagaggcacttattgattcaaccacagttttctggagatcaactttaatttttgtttgtactttggtggtagcttttttcattggaaagaaatccaaaattaaaattacattgttaactaaatcttacttttttgtgtgaatttttgtaattaattttcataagacactcttgtctttaagtttcttgtttgtaaacaacacaacacaatttatcactatgaatgaaggacaccatttactcaaacagtcactaccactcaagaagaaaaaaatggttcttttcaaccaaaacagttatatttagtagctaacacctttcttccctctgttttgatgcttcgtttaagtaagtgttattatttaaaagattgccaccattgtagagtctagggagatcccatcattttagatcatttggccaagtttggggacaagcaggtaggttactgttttgtttcttcaaacatagagaccgaagtaagtaacctactattataggccagtgggtaagattcctactagtatagttaaaaccctgatgctggttttttaaaatatgttgaattattcatgtttttgggatttaggcactgcactttatacaatcaatagtctaatgatatttgttaaattaattaatgacagttcatctagaaatgacaccattaatacaggcaagactgaagttatgtcaaagggaagattactatgtgtagaccaggaaaacaaagtagttgtgcaggctgtgatctctatcaaatattgaggactgtgtgtttgataaagctcaggttaaattcatcatataaattgacattatgtgcctgagtttggtcaataagattaaatacattttatgagaaagctttaaggtacttaattattttgttaatgcttacagtatttctaataccagatagtcttaagtatctatcatagatagatattcagccaaaatgaagtaggattatataaattagttgatgaaattctgtagttattaaggggaaaatcagagatggaaattaagttgcaattatttgggttagatccacatggcctctattaaaggtgatttacatgtaaaaataagtctaggcaacacagcatgacctggtctcaaaacaaataaacaacaaccataggcaggtatggtggcacacacctgtagtcccagctacttgggagcttgaggcgggaggattgattgagctcaggagttcaaggctggagtgagctatgatcacacaattgatctccagcctgggcagcacagtgagaccctgtctctgaaaatgaaaataaataaataaataaatctttttagagtactttga

SEQ ID NO: 72602 - DNA, 3384 bp, Homo sapiens
gcccagcctggtcttgaactcctggactcaagcgatcctcctgccttggcttcccaaagcgttttgttttgttttgtttgtttttcttaaaagcaaacagtaccttggtatcagtgcatattggttaaatatcagctctctaaaagtgatgattttgcatgactatttagaatattgaaatcatatggattcttttgttttacagagctctgtcttaggctcttagtccctgcttttgttatgtggagtttctttttatcttttcaaatatttatatccaaagagtagaattttgttttaaaattagcattgttaggccagtgaaaacattagattgggctggaacatggaaaaattaatggaaaatggcctagaggtagacagattttttttttttacatgttaagtacctgatgctcctcttttaaaatctttttaacagttttatttgccatcagcttcacagagtttggcacattgtttcttgagggttgtcagaatgtggggagaagagactagtaggtaataagactggaaaagatgggttggaacctaactatatcactggaactcagaaatgaacaggcaaccaaaccttaagacttaattatcatttctgcccctagagaacctgtgaaccagaagcaccaaaacttaattagagcttagaacattagttttcatacatttttaaaaaatagcagcagtactcttgtgaagtcctgtgtgaacccccaaacctaaagttacataaagcagataaagctggaatttaccggttcgggtttattacattaactcataaagttattcagtgagaataacaaggctatgtagtattttattgaatataatagcttgaaattggtgggtgaagaataataattaactttgtatccctcaagtctccttttttatatttttaatcatatagtaacatgaaaatcatgaattccatgggtaagttgtgtactcatgtgttcaagtttctctgagtacatgtgcatttaaacaaagattattgcagagtcactaccttcctaataaaaaacatctgtatgtatgcacaatggtgacaagagagaggctttaccttgaggtctgcatgaaaatatcctaacccaacacaaaattaagtatattggtgttggtatgttaaaacatgaatgcatgttaatttgacctgcatttgtgtgtttttatttatttaataaacagtggaaaaacagataaaaagaaattcaaatcaggcatttacaaaaccccgaggcactgctggaagcctaaggtgtagttaaaactgttttaaaaccactgccataggtggcctgtttctcagtaggagggaatttaccagtacataggttaaggaggctggaaggctgcagcacttttcttagctgagattcctcatttgaaccaaagagtacagaaaagtgatataagcgattattttgtcattctgcaaagggtaatgtctatcaggtggcattatacaatgggtgtttagctcattggtgcttaatccccctgaaaccccttttgaaaggttgggaaagtgaggaatcaataaggcattaaaaaccaaggaaccaaacaaaaaagacacttaaccaaaatgtcagatgcctatattcaaatgagtacaattttcaagacaatgcatggtcactactatattgtatttcacaagtctgagctcttaggcactgagtttatggctgagaatcaagatttgttcatgttaaaacttggaaatgagaaagatatattttaattaggatagattttcatttgattaattaatagcattgatactttttttaatgaaaagttgtattggccaccttcatgattctgtctggatgcaggcttgagtaacgtttgtaaacaaaaaaactttcagtctaattcatacaaaaggaaaaatgatgtttcagtgttatgaaattagcttgagctctttagttccttttcttattttttccccttttttttcataatagtgtattatagataaaaccactaactcataaaatgggaatgttcccttgttttgttatggcatatcttgaagctcaaaggctatgcatgttgatttttttttgggtttagacataataaggaaggcaagccactatttgaggtcttgaaacagaacatgttactcttttcaatcttttgattcagaatattttatttaacaagtgaatcagaaccttgaatttaaggaattatgtaacatttcactagttcattatgtatggcgttaagcagagttactctagatatccaaactgcttttctggtggagacttttaatcccaccccccccaccccccacccccgccaacacacacacacacacacacacacacgcatgcacacacgcacacacacacacacacacacggaaagtaaccaacttgtcaaagaaaaaatacaacaaaatgaaaatagctttggcccttataatactttccatttatgttcccttcatattttttcccagtgagaaaccatatggtttgtgctatagcttctcttgaaaactttgttagctatttaacaatctcactgtaactgagtgaaagctttaatcaagaactgcccatgacatatagatgcctttggttcattggctacttctgtagttgaaaggaagttgaactatttttttggacccagtaagtttgtcctttccacttgggtgttgaaagagcttatgagcagtagctgttctgatttttgttggttgttttctctagggaacaagctaccctctgagtcagcactggacttgaagataaatcctacaattcatgaaactgactgattcgactaaaggatggatagtttgggcagcgttggacagctctatgaggggtctgtttgtttaactgaagggattgttgagttcagcaacttttaattcccctaatcataaggggttgctgttgtgaaaacagggtttgtgaaggaatcagttctggcaattaacatcagtattcttactgacttcgtttttattttattgtcaaacttctttaaagtggataaattttactgctttttttgccagcaagaatttgtatgcactgagaggtcagcatagaagctttgcagtctacttatgaatccaagtttctttttttaaaatatatgaggttataaacatttctctcaagtaaactttttgacacttggattatttcatctttacaaaggtagtatgcatttgtggcttagaatttttaagatttaatggaacttaatttgagtagtaaatattttgctagtttagtgagtatattttggcttatggctaacatgctttttagataacttttattaataagatataatgaatttttaccctaaaac

SEQ ID NO: 72603 - DNA, 1295 bp, Homo sapiens
gtcttcttgatcccttttgattcctcttccctacccccaagcagtgatttgaatattaattttttcattgagatataattcacataccataaaatcaatccttttaaagtatgtaattcagtaggttttaatatatcaaaagatcatggaaccattaccattcaaattccacagcattttcatcaccccaaaaggaaactgtatctgttaaccaacacttcccgtttttctctctctccattccctgaaaaccactaatctattttctgactttttatagatttgcctgtgctgcacatttcatataaatagaatcatataatatgtggcttttttatgtctagcctctttcagctaatgttttcaaggttcatccgtgttgtagtgtatgtcagtatttccttccttttatgggtgaataatattccattatgtggatatatcatattttgtttacctgcttatcagttgatagacatttggattatttccactttttggtaattatgcataatgctactatgagcattcatgtacatgtttttgtgcgaacctatgtttttagtgctcttcggtaatatgcctagtagtggaatcacaattccactgttagggtcatagcaattgattatagccatcctagtgtgtatgaaacagtatattattgtggttttgatttctgtgtccctaatgactaaagattttgaggagttttccatgtgcttattggccatttgtatgtgttctttggaaaaaaatgtccattcaaatcctttgcccagttttaaatttacttgtttgatttttttaaatcattgtgtggtttttatattcttattcatactagacctgttttttttaaattgatacataataactgtacataatttgctggtatgtgtgttgttttgatacatgcatacaatgtgtaatgatcaaattagagaaattgggatagccattccctcaaacatttgtgttgggaatatttcacttcttctcttctagctattttgaattacacaataaattgttaactgtagtcacctcctatactattgaaccctaagtcttattccttctaactgtatttttgtacccgttaaccaacctcttcagtcccccacccaccaacacttctcaacttctggtaaccaccagtcttctttctatctctatgagatctactttctaagcttctgcatatgagtgagaacatgcagtgtttatttttctgttcctggccttatttcacttaacataatgaccttcagtaccatcttgtattgctgaaa

SEQ ID NO: 72604 - DNA, 1914 bp, Homo sapiens
cctgtggtgtttatagcctgatttacctcacctacctactttagttgctcagaaaaccagaaataattatgttgaggctcttcagaaagtacagagggctatccaaagaaaagaaaagtattacctcagttctctgcttatttttgttcacctacatgttttcagaaaacatgttggtatcttatgaattattagaaattgaaactcatatccctgttaatcataattttgtgactagggcatttttggtagcccttttcttatattgtgaggtggcatattatttcagtggtgaaggtttttaggcattcaccaaatagccagaaaacagttcctggataagcttatttttttcaggaagggtaactgttgctctaaatacccttttcagtctgctcagaactgatcacctccattaagcctttgattaacgctacctggttttaattaatttgcatttcatcagcatttatgcatgtagtttgtagtgtattagtttatatttgggtttttttaagttattttatgtcttttacatgtgacctggtctttttttctcagctagcttggaatctcctgaagggtaaagacaattgtcctttccctttcttcacaataaactcataatagagggcgctttgcacataatgtttcttactggttgtggttgttccactggaacatagtggttgttccactagaacataatggtatcaattggcctaattctaaatagtatgcatctgtagaaattttcagagtatgcctgtttagagttaatgacaaaaaggcatcaaaacaacagactgcttgatactaaaaatatggcacttaagctgctatgtatttcaacttttttttttttgctttttcaaacaattttgttaattatatttggctgaatgaaatctagtagctcttcattagataatttgaatttttaatactgtaatatatttggggaatgtgctatttgtattgttaatgattcttaataaaaaaggaattatgccttttataaaagaaaaacttttataaaaggcataattttataaagagccacaattctgttacttcccactcttccattaatttattaaatttttggtcactcttgctattaaatttcctgatgtaaaccttgatatggaggagactattcttgcagtaaatctgctaacatatttggaaataagtacatttgaaaaaagaaactttacatttgctttaatcagagctttttctacaacaaaacaagataaaattatttccttcatctttgcacttacgatcccaaagatgatgtttcttccaaatgaatgtttgcattttattttccagacttgttctctaaaaccaattattgctccattaagaaacatttttacatcttcttcaggaatgtcgttgtctgctgggtcttcccctcttcattcccccaagattactccacatacttctcctgctcccagaagaagaagtcacactccaaatccagcaagttacatggtgccttctagtgcctctacatctgttaataatcctgtttctcagactccgtcttctggtcaggtgatccaaaaggaaactgttggtgggacgacttacttctatacagacacaactccagcacctttgactggaatggtatgtctacattaaagaggaaattttagtactctcttgtaacaggaccttcttagttgtgaggcggtctaccccctcctgcagctttttattgtgatgcaaaaaagtatttcattttctaacttagatgagaagtctagtctcttcttctcaactcttcaaattaatctagttctgccttactaataattctagttttggactaaactggtttaatcagaaattagattatatccatgctcttattttagtctttatggcatgttt

SEQ ID NO: 72605 - DNA, 1196 bp, Homo sapiens
tttaaaatgtattaaaatttattgctatcatgtaaagattaaaattttatcaaaacaataataaagcttattgattatgaaaaattagtcaggctgggtgtggtggctcacacctgtaatcccagcactttgggaggccgaggcaggtggatcacctgaggtcaggagttcaagaccagcctggccaacatggtgaaaccctgtctctacaaaaatacaaaaattagctgggcatgatggtgggtacctgtaatcccagctacgtgaggctgaggcaggagaatcacttgaacccgggaggcagagcttgtagtgagccgagattgcgccactgaactccagcctgggcaacagagcaagactccatctgaaaaaaagaaagaaaaatgagtgattacatttacccccttcctacctttttaggtgtttccaaactatcatatttatcctccaactgcacctcacgttgcttatatgcaaccgaaagcaaacgcaccttccttcttcatggctgatgaactccgacaggtatgctttcagaattcatagtaggaatacttaatgtctcctgtgctttagtgaacaggggaaagaacagagctcttttcaaatcatattatttaatcaaatatgctctagtaaagcacatcgaatttagaagttttaattggtattttttttaaggaaacctgtcttttaaaaaaatttcaaataaattatgtggcaggatataaaacatagaatagctatttaaatggttcactgttctgtacttcattttatttctatgaaaaggctctttgaagtatataaataatttaaatggtttctaacagtatttttctaatagatgtaggttaaaaataagtagtttggctcaggaaataactttaagagagctcaatatttttttaaaagaatgttttttaaaagtttttttgttttgtttaatttttggtaaacagctagttatttggtatgtagaatttcactttacactcagattctcagaaatatttttgtttcatagaagtgagttctaccagtatagtgttttttaaattaattattaccagtttactagtagaccttgaattttcagccacagcgttagtcacgtgttttgggtagcccagctacccgtgtttaaggggcacatctacttaaacccaatcttaattatggcatgtctaagt

SEQ ID NO: 72606 - DNA, 1045 bp, Homo sapiens
tcaaaccttcttgaatatattatttaatatatgaattaaaaatttttatttggaaattagtacctcatgagcaatgtataaatatggcaatttttttccatttctgatggaatatgaaggagacgtcaattagagtttactggagtagaaaaattgtcttccaggttttcgtcttgttaacacaaagtgcatggtgttggtcgacatgtggaagaaaattcaacactcaaatatcgtaactttgcgtgaagtatttaccactaaagcatttgctgagccctgtgagtaacttgtaatttgtctttctgctggtgagcttcattatttgaagccagctttcagtaatgagtgtttgtgttttattttaagctcttgtgtttgcatatgatttccatgctggaggagaaactatgatgagcagacactttaatgaccctaatgctgatgcctacttcaccaagagaaagtggggtaagaaaaagatgcaggcaaactatattttgactaatgcttttgctctgtggaagagtagttttctattttaaaatacgtataatttttccctgtaatcatttagtttaaagactctattacattttgtactagttgttttcatgttcctgataaagacatacccgagactgggcaatttacaaaagagagaggtttaatgaacttacagttccatgtggcttgggaggtctcacaatcatggcagaaggtgaaaggcatgtctcacatggcggcagacaagagaagtgaatgagagccaagtaaaaggggtttccccctgtaaaactgtcagatctcatgagacctattcactaccacgagaacagtatgggggaaattacccccatgattcagttatctcccaccagctccctcccacaacactgtgggaattatgggagttacaattcaaaatgagatttgggtggggacgcagccaaaccatatcacattttaaaaagaaatatgtcaaagaaatggagatgatggtcaagaagttaggaaataatgtcttttgcatatttactaagat

SEQ ID NO: 72607 - DNA, 1272 bp, Homo sapiens
tgttctttatgtaattatttccctaaacaaatgcttttgtttgaaggttggattccatgttacttaatctaaggtttcaaaatagaattttaagtaacttttccttaaacatgaaatattttcttctttgtccctttctaatatatacttaaagaattgttttatcattgagattttgcaaacaaccagaatacttgaattctaacaaatgtgtgttaaagggtaaatgatttcagagaaaagtaaatccattttgagatgtctattcattaatttatgtatttagggaaggtctcagtctatgggggcaagaaagcagcatcacgttattatgctttttaatcttaagattttcttgacttgaaaattaaagaggaggggagaaagatttgagtccatattctagtatctttcagattacaactcctttcaagactctaattatagacaaaaatatattacttctgtttacttgttacttctttttttttgcatcctgacagttgaaaaaagaaagttgtggttacatggctgtttcacatttaaaatctggtcatagaatgtggtcatttttttccttttgctatgtcatctgtagacacatgcataattttgtggaaggggatgtggtacaactattcttatagatgactatagttgttgctcaaatttattttggtagtaacacctgtgaaatgactgttggctttaatttataactgtgtttctcaactgcttaagtttttgtgggggctgtcttatgcatttcagaatgtttatagtggcctcttctgactgaagggcctggcttctgcctactgaatgccagtagcaatccccctctacccctattgtaatgccagaaatatctccagatgttgccaaatgctggagtggtttcttttgagaaccactcttttatagcattcttttccagtaattttttaatcataattattctgtttttggtgttcactgattaatatattaatgtttatattttcataggaagtagtccttttttctaatagtttaaaatattgtttgagtagtcgtaacttccctaaccataccatacatgcataaaagcctaccattttcttacactatgtaatttattatcttagcacaagtgaaaaaaaaaagcaaagtataagaaatatattgatttagaaaatgagaagaatagcataccatgtggagttgatacgagattcagaatgagtctatatcagtaaaacaactagaacagagtctggcacacagtaagca

SEQ ID NO: 72608 - DNA, 1033 bp, Homo sapiens
tgaacaagttacttcttcaaattgtgttttgacaaccttattagacaagtgtactactaactccattctgcttatttatgaggtacccctcataaagttattgagggatttgaatgagtcatgtaaaatgcttagaacagtgtctggtacatcttttgcaagtgttagaaagctaactagttctcttttatgaatgactaataaacagcttggaatggtgaaaaggacactgacctgttagtcaagagatgtgagttatagttctggctttctcagtttctgacttttacagctgtaggtatatcacttgatatctctgagccttaattttaccatttctaaaatggtggttggtggaggtggtgtggggtaggatggaagttaaactcaattctgagatccttcctaatattttgggaaatgttacttttccatgagtatgcaattttttaaaaacttattttaattattttctttaaattatctggtccttaaaggttgcgagtaaattgtgttggagtttttgatgttttaacatttgataacagtcaaaataataatccattggcattaatggcccagtaccaggtgagtaagaattaacatggatatttacttgttttcctttattaaagacaaattttgttcattttaaagtatttcagtgttttaagcctagattttaatttattttggggtggtgtctatgcagactttgaacatgtatctccccctcccctccctctcttttcttcctttcctttcccctctctatttctttctctctcttttcctttctattcttttgcttctgtcttgctctgtcacctgggctagagtgcagtggtgctgtcagctcactgcagcttttgaactgggcccaagcaatcgtctcgcctcagcctcccatgtagctgggactacagatgtgcactactgtgtctggctaaaattttttttatttttattttttgtagagatagaggctcacgatgttgcccaggctgtatttcttaaccattatgatgtactt

SEQ ID NO: 72609 - DNA, 4054 bp, Homo sapiens
tctggactgtgtcatacatgtactttatttcaaaaagtggatgttcttaccttgagtccgctttagagaggtgatgggatgtactaaaaatcagatgttattttttaaacccatctggttcttcagctctcttggaccattttggttttctgtctcataatagagaataatggaatattctgggagggaggcttaatacagcatcagttcagggtggaaccaaactgaaaattctgctgcttgaagagttggaagactgtgtgttggtacctgctgctcaaacacgtgataaataacaacaatctttggtatgctttgctggatactttggattgaatcgcccatagaaatttatagttggcatttatatgcactgatttcttttggctgagatttctgtaatttcatgaatataacttggaatgttttacttgatctaaagtgtgattgagaggaattctttttggagttcatcacagtgtcctccagcaaacagaaatgatggcaacagtaatagttctccttcccatgccagcttccctcctgccattctgggctcctgactctatcaccagtgaagttttaaaagttttctgggatgaatctttgaatcttttctaatagattcaaagtagtttgtctacctaatcagtctgtctccttatctcatgttcagtgtcagattcacaaatgctagttttggataaattttttagtatgaacttttaaatgttattttagtaatggagtttaacgtctttttactcattatttgggtaggctgttgttaagtataaccatataatgctagaatttcactaatgattgccttaaagttacaaatattccaacaaaccagtggttctcaatcctggctgcatattaccatcatttgtggaagcttagaaaaataccaatacctagatttttatcccagactaattataccaaaattgggacgaggggatggctactgctgattttggttttgtttttaagcttctcaagtgatggtaatatacagctatgcttgaaaattccttataataaacgaatgttcagtaaatgaacgtgtgtctaataatttagatgagttctcagattttaaagatctgcaaatgtctgttgtagaaattgcttcaggtggtttcatgttaactctgaagtactccattcttgaaggcatgtggttgttaatagcttcctaccaatcagggccacttgggatgaccatactgtttcctggagttataataggtgataaaggacttaattcagccagctgtcttttgaaaatccttttagaaggaaagcctcagaatggtaaatcttgagtgggagaggttttaggaaagcaggtggtggttccagagctcaaagatctgttagagtgtgaggaaaaatagtctatttggaaacaaagatagatgggatgtcattcattgaggtttgcagcatttttgatgttctagagaatttgctctaaaatctggttaatgctaatgtttgtaataggataacttttcttcagataatccttcacattcccactatattctgggagttacagaaaatgagcaaagtatgtatgttaagttatagtggtcatagcaaagcaaatgtatagtaaccttaaatttgttgtaatagagaagaatattacctctatttaaataagaaaaaattagaaaaactttttaaaagtggcaatttgtagttggcatgggaattgcttaaagtctcttaaggcgtggacctagaactaccttcatcagaattacctgggtgctttaaaaatgttgagccattttctggacccacccaatgagaatctctggtagagaggctcgaagtcgtctttttaataagctccaggttattctgagaatcaccagtatttgaggaccctgcctgcagcttatttataatgatgctttttccatttaggcagtagtgtcagtgtattaaatgagtacctgtgaaatgaaaattaaaagttatatttattctttcatgtcagcaagcagatctgatatcattaggaaaagttgtgttggctttggcttgcaactctttggcaggaattcagcgagagaatttacagaaagccatggaactggtgacaatcaactattcctctgacctgaagaatctgattttgtaagttttaatatatgataaattgtacagaatgattatttgcgataagacagagctttttttgttttaagtgattgttttggttcccactatttaaaatcaagcaaaacagaaactttatgtctttatttttattgcaaagtaaatatttcttagataaattgataaaccagtgtgtttaaattagttattgatgttttaaacatttggttaaagggcacccagtagaagtttgttggtatccactagctacatgtgaccttttacattgatattaattgaaatttaaagcttacttcttcaattacactagtcacatttcaagagctcagcagccacatgtaattactggctaatataattggacagcacagacatagaatatttccctcatcttggagttctgttggatagtgctgctctagagagtgtgaaagccatcatgagtaagcctcaggtgcaatccagtcatgtactctggccaaaatacccattctggaaagcatttgtgtggagacccccatgcttacactccagtatcttaacgctccagagaatccttgagtatcgatttgagatgaatttggcttaagagaaacccattgtgtggactactgtcacaacagaaggacttctccgtaagatatagctactattgggagatcccagagggtgggcaaccacgacctttattacagttatgagctatattagagaagaggtgctaatcaacagtctcttttagcttacagctgcccattctgatctttctgtgtagccctggatgatccagtttctttttggaccagccctggggtatgaattgggggatggagggtgggattgcccacctgttctttgttacactggcataaatgtcctacttgtgacagcactagaagccagtggttgtctggatcctattcataatcaaattcaaataagatgatttatcttctgaataaaaatacttgttttatatatgatcacaacagtgattcctagccttagtttgcaaatacctaggatgcctcaaataatttcaggttataatctctaaattttcctttttaaaaaagtggggatagaggacaaaaataatcagccatatgttaataattattgaaactgggtgatgatacatggggattcattatattactattctattataaatgtttgaaattttctttattaaaaaaatgaataaacaaaaaagccatactttaataataaacacaaactaaagtttatggagtaattaaaccatgtatcgggccctttcaaactgcttgatgtgaattaatttttttaattctcccaataactctataaattagataccattattagtcccattttagagttacaaaactgagccacagagataaaataacttgccaaagtcacatagcctgtaataacattaaatatgattagcagggtacacatatgtccatacttacggatgaattgctaagatatagtttattcacatgggtatagctattcatttatccacaaaaatgatgactactatatgccaaatgcaggatactttgaatgaggtgaacaaaattcccatcttctggagcttacaccctaatgggaagaaagagtaaataaacataaaaaccagtgagatattttcaggtagtgataagacctatgaagaaaataagagaattacaagcagaagagtgaaggagtgagtaggaggctgctttcatgagaaagggcagagaatggctttacgtatagaataagcggcagtagatgattgagaatctttgtgttctaacaggtagcccttgaaatgtgtagtattttctgccactgttctaatgatagaagaaatttaactggttccttctgctgcgtgttactgcatttc

SEQ ID NO: 72610 - DNA, 1057 bp, Homo sapiens
tatcatattccttttaggagcattatgtaaatatgcagttacagctttctttgattatttgaataacgtctgtttcctactagactgtaagttcctaaggtcactgaaaactcacagtggtcatctggttcttcacagcttgttttcacatggaatggtaggaaaccgatatttacttcctttttgtttcctaaacatttttctattttatgcttattggtgaagtagaagatgtacctgacctttctctattctgtaacctacagagtgggaggaagagaagagaagatatttaaagatatttttaccttttccattttatctaatggtaggggctgaaataaggaggtaatgtaaaataggaatgcataagggatgatttccccctgacatttgctaactgaaaactggaattcatagacttactagttcagttagattattttttaaaaacactgtaccagactccctcccaattttttgtttattgggaaaaagtaaaactagtttggagtctaaaaaatagacatatggccacagaccatacagcatgagttactgaggtaaaatgttcatttcccccaggtttcagaaggatcccacttggtcagagactggagaccgttatctgttgaaactctttagggatcatctttttcatcaggtgacagaagcaggtgctccctggattgacctcagtcatataatttcttgtcttaacaaggtaatttgtatctagattttttaagatcataattctgcctataatttgtatagagttgtatcttctacaaatactaggaaacttaagaaatcaggatgtactcttaaagtagcctgtaagacgttttattaataacattttctacaatgggaggatttttacaatacttgcatgaataattttttggggcagtggaggacagagtcttgctctgttgcccaggctggagtgcagtggcctgattttggctcactgcaacctctgcctcccgggttcaagtgattctcctgcctgagcctcccgagtagctaggattacaggcacccatcacca

SEQ ID NO: 72611 - DNA, 2578 bp, Homo sapiens
ttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaatttgtccttttcttgcacgtgttcatataacaagatgatgattatcttatgattggattttaaaagattggttatttcctctgtattttggaggaatttttgtatttggatgaaatggcagcagatttattcattaatttatcaggtagtccttaagtcttatctactgtgtccttggatctgttctaggcactaa

SEQ ID NO: 72612 - DNA, 1032 bp, Homo sapiens
cactcgatgcgcaaaggtttgtctctctctaagctaagagctgattgagagcacccttgtgtctttaggctgggccaaggctggcacacagtagatacttagtgtatatttgctaaatgaatacatccctaccctctgctaattgtgcagcatttccttgcatcctgttgatgactgagccttgtttgctttttcctctttttgtttagtctagagggatgatactaaggatagtttatgggagctaatttgaagaacaggaatagacttgataggtgcaacaataagatattattgaaactgcccaaggattatcattatgccaaactattttccttattacttttaactccacttgcagagtgttcaggaggattgttattcaaaaaaaaaaaaaaaaaaagattgacaggaaaagtaaacaaagcataatcctaacataaacagatagaagtggctatttgattttctagattcttcccacaattccaactcgttttgcttagggtgtattactctcagagtggaaagttactggtgagctatggaattcctgggaagtagctgttttccacacatctgatttctcatttgactgtcattttctaagaatagaaatagagaagacttacaaatcttaaatatcttctttaccactgtgaatgtttaacacataagacagtgagatctactgaaattctatactattttgcaaatttggggtatgcatcaatatttatcgacccatccgtttagggtcttgacatatgtgccaacctaacatgcaaataaataaaaaaaaaactaaataattgaagctattagattcggataaaagtgtagagttgaatttttctggaataacagagccttttctaaatatatttaaattttgttttggcaatattaaatctaaaatttctattctatctaggattagaactagtaactatgttagaaaataacaattatggtgatagaacataatatttataaatttgggtttaagtgatgctaataaaatatggtttg

SEQ ID NO: 72613 - DNA, 1019 bp, Homo sapiens
tcactgtaatcacaatgtacataccatggaatcaaattattaataatctcaaaaccctgctactacttttaaaaatctgcattttcttgacaaataggagggtttatttgtttttttgtttcttgtttgtttccctgacatcaaagccagtgagaatgtggtccttcatgtgtggcccaggagaaagtcattagaactgctcttgacttctgtcccgttcttcatctcctttccagtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtagggacagtcagtttttttactaactttcaaatactttttgacacctggaattaagattttttaatggacgcagatgggaatctgcatgtgggatgtactgtatatttgaggcaaaggctctccctgccttggaaaaaggtgggcaacagctactcttctttcttactgaatataccctatcactggctaacaatttcataatttttctctctagtttacagttttagaagcacaagcacaaaactaaggtcctcccatgagctgtgacatgagctcaggttggaactctggtctcctgtttctcaactgaagatccctagactttggcaataccactatgtcagttgcattagcattcccatttttcattttgtattctttggttatgatccaagttcttcccaacaccagtgatcactatgtttcctacttttgggctttgctcttccatctgtctgaaatgcacctccacccattgcctgcctcctaagagggctttatttatcaaaccccatggctcagctcttacgtcaccttctctgtgaactctcctcactgcctcattcagaatcacttcttccccctcagtatgaacagcactttgttcacgcccttgttac

SEQ ID NO: 72614 - DNA, 1048 bp, Homo sapiens
cagtaacatctattttgttatttgtttcctgttagggtgatattggtctcataatcacaccttattaaagtccaaggtagctgtgatataatccattaaacaatcataacttttccgaggagtctaatattttatgtctctctctcattattttattaactctctttctgagaaaatttgatcttctgcttccattgttaccgaacacttccatgacaggtttattttagttcaggagcacaaaacttatctctgatgactcagagcattgtctctggcattaataaaactccaaccatttcctaatatacagctgtgattactcgctagatattaacttggttatcatgtatttattattgttgaatatttactttagaatatgtttgggggatttcagccccaataagcatctgcagattattgggatttcattttatttttctctaaggatgagtaaccctatgtaaacacatcttttgaaaaggtagatttgtagtctaatagggttttaagaaaaagaatcaggagtatagctctgtctacatgtcacaaaacccagcatgtaaattatgaacaaactcttacttaggcattattgattgcctgctgtgtaacaggcgctgttcccacctgagcactgattaggatgtaacatctgatatgtaatgtacagaaaaatcaatatcagcactttatcattccagcttgtataaatccaccaaacctctagcataatgtattaaatcaatttaagtacccaagtaattatatttaactactttacttaattaccgaattatctagtaaatttaaatttccgctaatataataatttcttacatttgtttcttttcacttaaacaaatggtttcatttacttgatgccatttaatcctcacaaccatccaatgaagcatcgttctcttcattttacaagcaaaggaccaagaattcacttcacattagggctctgtggggagtcatgggaaagtgctcgcactggaataaggtggtcaggttttcccttcacattctcagtggcagg

SEQ ID NO: 72615 - DNA, 1006 bp, Homo sapiens
tattatacaaaaatgtgaaggcactatttgggaatcaaaatagaaactggaacaatatgcattttatggtagtttaacagcatcacattacagctccatgacatattcatttttttccagaaggaactgtgtgtggatctgaagattatgtcacatgacaggttataagacgtagttgaataaaatttaaaagttccaattcccgcttttatacttaaactgttacatggcaagctcctatacggaattgatcaaatatctcccagatcttttctgtgagactttccttctaagggaacccacagggatccacataaatgacaaatccataacattgaaacatgctgtcatcatctctatagatgcctggaactttgacactgaacagtaatgaaagcagagtatttggtaaaatatctggacatagaccaaactgtaatcctgatgctatgtaaaacagaaaactttccattttagattgcgagtcacatgcattccatgctatgcttccaaactggtaattgtttatttaaagagaacacggaggatgcctttggcagaactgaaatttgcaatcctaaataatttagagattagaaatctaaagttaaggcagttcaagcatgttattagtactactagtcttaataatacaactctatgcaaatgctcttgcagctaaaagcattttgtcactgatcagacactatgattctaaagaggatgcacaaattgataaaaaattaacaaactaatttaaaaactcagttactttcactaagccacctgtatatttagtctcacatacattgagtgtgtttattgaaatggcatctccactgagcaatcagttgtcatgtctcttccaggtgttcacaatctgaaaatgtgtatatttcagcctgaaacaacttctgagtagcataacactactggcaattatgatccattctataagacgtgacgtcagagctcagtttcctctcagacctctaaacagtgacat

SEQ ID NO: 72616 - DNA, 1057 bp, Homo sapiens
aaacaaattcaatcatgccataacctttcagaggctttcagttttggaataaaacccatatttctttgcacataagatgtttcacttttgtatttcatcagcctttacttctgcctcactggaaacatatttagccagttatctcaaactacctgaagcttgttcatttatattttcttgcctttattcatgttattttttcctggaatgcctttcaaactgacagcattcagagatcacctcaggaatccttcccacatctaaatttggtattttcattgtaccatgtgtgtctctatcatatcataatgtttaaggcttgctgtaattgtctagtctggactttttgagggcctcttatttttctgtctcctacttaaacaatatttttgacacagctgcctgggtgtgtgtttaaattttttttctatttaataatgttttttatttgtgttgtagaatgccagaggacttggatctgagctaaaggacagtattccagttactgaactttcagcaagtggaccttttgaaagtcatgatcttcttcggaaagggtatatgggggagttatgactttgattttgttatgtttctgtgaattttcacaatattctttaagtattttgataggctatacatgtgtatttagttggcagatggcaagtaatataccttacatggggtgcagaggggaagaggcttagatattttctgtagtggaagaggtgtctcatcaaagtagtaggttcccaattagagcatcctcctaggcagtggtgcccattagcatgatttggtaggattctttttatttatttttttgctactgataacttagccatttgccttcttgtcttaactattagggtaattcacttttctttgggaggcactagaacatagcagttgagagattaaactctggattcagtcggcctgggtttggatcgtggctctgctctttactagatgtgtgcctttggacaaatcacataattaatgtctcagtgtccttatggatagaataggcctaataatagtctgtatcttcttt

SEQ ID NO: 72617 - DNA, 1048 bp, Homo sapiens
gtggcctggttctagttgtgccttacctaacatactttatacatagtaggtgttcagtaaatgttaaacctattgttcaacatgtttattaaagatatattaaatattgaaagtgttagacctgaagggaataggcttagtttatatagtgcaagaagtacctcatcagagtaatagcaataaacatacattcattaaatttcttctagatgtggcaccagattttggcaagttttccctagtgattgaagtcttgaccaccaatgtctataatggatacattcttacattattatatatacctttttttttccttttggtgtgtaggtctatgaatttttagcacatgtatcaattcctatgactgtcaccacagtcaagatacagaacagttttgtcaccccaaaaaactctctcatgccatccctttatagatatgattttgagctctgggtattgagtgatatttaatctcctctaaatgttttttttttaatgtcctttcagtttttcttgtgtgaaaaatgaacttttgcctagtcatccccttgaattatcagaaaaaaatgtaagtatattattatgtccttatttttatcttctaatagataaatacttttactaatattggtttcattttattaaaacaattttggtactgaggatttgcccatgaagaatatgaggcgttattttcaaaccccttgtaggatagacttaaaaattacactgctcctctaaagctccctttctatgcgttcttacctgcctttttaatgtacgtctccaaagggtgatccacttctccattcctctcacaggaattttctctttcaataatgctgtttcttttatatttttcctgccatttttgctgttgacttccaagttcatatctctagttttgacctctttaagtcctgcatctccgagttactgtaggacacagccactaggcacagtaggtacttcgatgaatatgacatcatccccatccttaaataacttaaaatttaatgaggaagacaagcagtgggtaggagaaggc

SEQ ID NO: 72618 - DNA, 1001 bp, Homo sapiens
tatttggctaagtcattctggaagctactcgttttccaaagataaagctcttaaaaaacatggttttgagtaacctagggttgaatcttggcttagccatctactagtcttaagaacttgagtaagctggagagctttctgaaccttagattttttaatttaatgtgaaataaggagaacagtaagagtagcataggattattctgaagattaaatgaaatcacatgtttggcacaaaattgttagcttccctttttattttcctcttactcagatttcaactacagattgctcaaattctggatttaagtttttaatactatttgatccaaatatctttgcccagaattctctgtcttttttttttttttcttatctctatacttttgcagttttgggttgtcaagatgtataacagctgcctgctcctccctgcttttgatgcattcttaggactgtactctgatctaactaccagaccccttgctgtctggtttaatttacaggttcctatttttgtttcttcctcttcctcccacttcctttttttttttaggtttgacaatctagagaaatttttccacactataaagattttaaatatctctatggaacattagtaattgaaaataatatatttagtctggatacattttgttgggggtggggggaatgtgagaaactgccctcttagattctaacggtgtgattatctttaaaatactactatcatttagtcaaagaccacctattttggtagtctgtgggaatatcaaaaattatctgcattagctgggcttggtgacatggacctgtaatcccagttttagtgggaggatcactagagcccaggagtttgagaccagcctaagcaacctattgagttggactttcttcaggaatttgatcatcctacatgtatcaggaatgaggcgtgatgttaagctctgggattttgcatttcattacatggtatatgccgtagttttcctgagcagaag

SEQ ID NO: 72619 - DNA, 1311 bp, Homo sapiens
agtgatgatttttaaaggttttctttcttaagaattcttacgtttgtgtggatacaacaggtcagaagacaatacagataaaacatttttgtgaattaagagattgtttcccgtcctgtgggaagccactagaaaacttaagaactttgaaaaaaaaacttttgtcaatctgttttttctttttaaatccactattttgagatattattgacatacaataaagtacacctatttttaagtgtacagttctgtgggttttaattaacatggaacctggtctcctaaacagaggagtagaatgttttcattgcctcacaaagttcccttggtcccttttcagtcagtcaccccaccccagccccaggcaatcactggtttgttttctataactttaggttagttttgactcttctggattcttatgtaagcagaatcattgaatgtatctcttttttgagagtcttttaaaatgtttgtttttgtttgctttcagatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaattta

SEQ ID NO: 72620 - DNA, 1049 bp, Homo sapiens
tcccaagtagctgggattgcaggcatgcgccaccacgcctggctaattttgtatttttagtaaagacaggatttctccatgttggtcaggctggtctcgaactcccgaactcaggtgatctgccctcctcggcctcccaaagtgctgggattacaggtgtgagccactgcgcccggccagcagatcagtcttaatcggcagattatataaatagatctagacctaaaaattacatgaactcttgttctctgtactggaataagaattctagagtaaagtaaccttaaactgacctgtccatagtctactttaattcatcaaacagagttctacaattaattaattcaatttttagatacaatgagttaggatgcttgtagaaaaggaagtatttagacagagtgaaagtgtttcctattttaaattggccattagctttcagaatcagccagtgattttgaatcctttctctcacagccagggtgccgttccttttcactattgtgccattctctgttctacggtccatgttgtcaaaagtggttcgttcgactgaacaaggtgagtttaatttgcttaagaaatatgaatctaccatctttacaaactcaaatctgtgtacaatcaatgtttaatgcttcagaatattctacagccctttttatgcacggatctccttttgaataaagtggtaagctctgtgagggaaaggcttacactcttgcaagggagcccctgcctagggccttgtactttagagagctccctcggctctgggccgtgccccgccctaagaagaaaggagctctcagggccaagtgggagatgcccactgggagctcaccacatctccttccttctagactgaactctgcccacctgggtccctgcaattcccagcccagttctgggcttatgtccagtaagggcctggatgatcctcttcctcagccaccttctcctgagggtggactgtgcccagtgtgctcacctgtagaccaaggaaggagccaaggggcgactccttctaaagggtgtggctggacttt

SEQ ID NO: 72621 - DNA, 1510 bp, Homo sapiens
aaagatttttgccgaattttcaaattgactttttcatttattgtttcttaattggattaatattcaagagaacctactactctagatcccttcccttaaagttggtgctcttagacctctgggaaccagaaaccacccctaccctcacctgccacccacgctggagtggtggcctactctctgtttgctccttaggacaaaggaacatttttgtttcccaggaggcaccaccatcgccttcagtgattcattcaatgactaaaaacggtttacatctgttttttaaatcagcttagcatttcccagtatacaaatggcacacactttttatattgactttggaaaatacagagcaatggcaagcaaaaaatgttttaagatcatgcaaaatttcttccatcaagtaactagtgtaatgattgacacatcttccaatctgtgtgtgtatgtcatctgtcattgtcattttggtccttggaagttgagtttatcttactcctcaggtcatgacatactaccacctttatttactttttatttttatttatttgagatggagtctcactgtgtcacccaggctggagtgcaatggcacaatctcagctcattgcaacctctgcctcccaggttcaagcaattcttctgcctcagcctcccaagtagcggagactacaggcgtacgccaccacgcctggctaatttttgtatttttagtagagacagggttttgccatgttggccaggctggtctcaaactcctgacctcaagtgatccgcccaccttggccccccaaagtgctaggattacaggcgtgagccaccgtgcctggcctagtttttttaaatttatttttagagacagggtctcgctatgttgcccaggctggtctcaaattcctgggcacaagtgatgctcccacctcggcctcccacagtgctgggattataagcgtaagccaccacactcagccacggtatgctaccatctgtagacagtgtaagtctcctctttcaattttatcttattttaaattcttttatttagtaaataaaggaagatgtttctcactaatctatctgtgaagacataggtaaaaaaaaaaaataagggcaacagccaagctctccctaaataaaggttttttttttttttttttgtattttttggtagagacagagttttaccatgttggccaagctggtctcaaactcctgacctcaagtgatcctcctgcctcagcctcccaaaatatgaggattacaggcatgagccaccacgcccgaccaaaatctgaaactttttgatcaccacactttaccacaagtgtaaaattccacacacaagtactcaatggcaactgttttatgcacaaatttgtttaaaatattgtataaaattaccttcaggctgtatgtatgaggtatatatgaaacataaatgaattttgtgtttaaatgtgagtcccatccacaaggtatctcattatatacatgcaaatatcccaaagtc

SEQ ID NO: 72622 - DNA, 1031 bp, Homo sapiens
tgtttattatcctggctatgcccttacattgctgttgtagtcaacctatgtcttcagtgttctgtattcatgttaatgtttatttttaaaagaactgttagtatatgtgctgttgtggaagggaaaaaacagcccacataagtaaatctgcactgttgaattgtatggatttagcctcttcccagggagaaagttattcagctgaattctgtaattgatcatttggtgtttctcaagaatattgatgaccattttcaacagcttgggatgagtaaggaagataaaattatatctttaaataaaaaatggtttctatttattgatgttaaggatatatgggtaagaattattcttactaaaaagacaacagttacttaagtgatcattttgtaggtttgctatttgtaatgttctagaatttgttttattcatgatttattttgtctattaaaacccgtttaaaattttcttttaatttaaacattgatgagacttggctgggtagcggaatgccagaaagggccaaattcctgcagctgcctgcacaccattattctgaaatgctgctatttaaatggcttagctaatagctgaaacatgactctctgaggagggtggtagctcctctaattttctgcctttgcctctgcctttcttcttttcctcttcttggaagttgtatactgagtgttagtcagtgcacaatttccttatggattcccagttggagatgagtgaataccctggtgagttgtggacacagcatcacagagagcctaatactgaatattgggttggggtctgtgttcctccctagattagagattctgaagcaaagagaccatgtataaccttcagaggttggtttcagatgtttacacagcatatccagtaaagattggttaaagaatgagatttattggcacacataaatatggacactgagcagtacggcagggttcccgcatgacatcatctggtgggtccagattcatttccatgtgactgtcctggctctcttctccacatcc

SEQ ID NO: 72623 - DNA, 1055 bp, Homo sapiens
tctagcatttacattgtgttgggtattactagtaatctagagaggatttaaagtatacaggaagatgtgctcaggttagatgcaaatactatggcattttatgtcagacacttgagcacccacagatttttgtatctggaggggggggtcctgggaccaatgccctgtggatactgggagatggctgtattcaggtaacttgccaaggccacagaggtgaatttagaactctctgattctaaactcacactctttcttgggaaccacgtcttttctctcagaagcacagatgtgcatgaaccctgcaatatgatgccaggaattggttctatttgctatggaattcaggaatgtagcattctatgttttgtgataggcatgggataggagacatgtgacaaaactgtaaggtggacctttaatgaattactagcctagacaccttgaaaaaccacatgcctggggcatggtctccgagcacagccatttttttctgaaatgaacaggtgctgcaacccgttgtgctggaattgtcagcgttggctgtgctctaacagtaataaagtaagaaaaaatgtccaagtgcttattaggcatctgaatttaacttgtgcctcctgcttaattagcatagtagtttggaatcctcagctcccagcctatctgtgatctccggctgccccggatagtgggtttgtagagccaccaggcggagggcgttttcccagctgtctgtacttggcgtgggctgcctgttttcccgcaagcctactgcttgcttgatttatctttattaacgtaaaatgaatctataagtacggtggcactgcatgctatttaagatcatttatatccaacttcagctaactgaagatggtgaggaaaatataagtaagcctaaaggatgttggagcagcctaaattgatgttgggaaatttgtatatgaagtgaagagtctgttattcttagtctgtttactattgtttaaaaatatctccaaaagatttgactgtctggtgtctcaggctgcacgctggtaaaagtagcagattaa

SEQ ID NO: 72624 - DNA, 2682 bp, Homo sapiens
taacttaggtatctttgagagtattttgtattgggaacatatttttactttatgcatggattttcatagttgatgaagctcataattatggctctcacattcttctaggacctctaaaatgttatttttattgactgtggtatacatagagataatttacataagccaaagagtagaaaaccctttgaactctaaatatattcagagataaacatcataaagactgacttagtagtctcacaagtatccagtaacctatatatctccttggatatacttaattgtttttaaagaattgggctaaaaccctacctttgaggctattcgtgagagaatttcaaagtttccaaacttagatgtctcgttttgaggaggttagatattctcattaatcacttctcagccttttggctaagatcaagtatagatattcttattaaattctagagttttatttcttgttttaatatataaaataagtaaatgttcttttaattattgaataggatttgggttctggggataattatctgaagtggaaaactgctagccttttggaaggttaatcaatgaaaatgagggttaatatgaaagctttttgcaatgttaactttagggtttacactgatgaatactataaaatacatttacatacataacacatttgattttctacgtctgacatgcattttaaataagatcagggttgacaagaaatgttattaataacttacagaaacagccattaacccatctcatgttcatcggcaatgagagagtcattttttattcatggaaaaagcagccaaaggtggcttgtgaggtcagacttcagagaagctattgcctgtttgatgttactcttaatgatgtctttgttcattctcttcagaagcactcagacaatgatgagttgcacccagagataggattagattgcaagcatgttttgttttatttttaaggatgttgaccatttctggttataagataaactgaaggtttggggaacatttttatttatagtacaaataatgtctagttgaactgcttcagtgttcttggctggcttgttttatgaagattagattatctgcttaccctttcccgattctacattctttcagcatattctatgtggtaagcataagctcagcgccagggctgccatgacctggacaagggtgagtcctcactcacacttgcagggaatggggagacaggattatgcacataaagccatgcagggaaatgttagcatggctatgattgaagaccacacagcatttggtgggcaggggagggaggaggcacaggaagggggaagtatccatgcatcctgagtgaggtgaagaaagacctcatgccctgcaggtcctctccaggctggctcagcactactgcattatgtcttcagatggaattcttccacattggttttaggtaattgacaaccttctgaatttgcttataaaatactccaccaaaggggaggaaaaacaactagaggtgggagaagataggtgaaaaaagattgacaaatatttgaaaatatttgaagctggatgatggaaccatgaagattcattgtactacttcacttgttgtgtatgtttgaacatttccatagaaggttaaaaccccaccttctctctgtattagtttttatttattttttgttttattttatttttacatttagtggtccctagaaagctcttagacaaccgttcttcttctaacctttttgaagtataacagacaaataaagattgtgtatatttacattatgatgttttgatatacatatgcattgtgaaatgattactacaatcaagttaattaacatatccatcacctcacatagttacctcttctgtgtatatgtgtgtgtgtgtatgtgtggtaagaacatttaagatctatcttctttgcaaatttcaagtatacaatatagtgttattaataatcaaccccatgctgtatattagatctccagaacttactcctcctgaatacctgaaactttgaaccctttaaccaatacctccccatactgatgagatgacacagtagtggtgaagagtacagactctggagatacattgcctgggctcacatcccacctctgcagtttgctagctttgtgactttgggcaagttgcttaatttttctctgtttcctcattgtaaaataataataatattaataatgattaaaataagttaaaccatcaatagggtcgatgggagcatcagatggaattaatatctgcaaagtacttagaaaggagatttgcccaataataatgatgtttctgtgggcatttccatccattggccatgtgtgtaaggattcagaaactcagttaaaagatgaccatgatggattaatgtatctgtgatggagtaaagaaagtgcttctgctgacatctgagtcaggcagacgacatatattctagttttgaatttttataacaacctcacacatatatggtgaataaccttctgagtgagtgttaagctaaaaacatatcgtttttgagacatgaaagtggaggttgatcatttgattttcatggcaatctctttcttttgagttgtaaacttgtggtggtttggacatttacaaaatacagacaaggaaaatcatgatttctttatttaaaaaggctatggcg

SEQ ID NO: 72625 - DNA, 1050 bp, Homo sapiens
tcaggattatttcgcattataaataccagaaaatgtgagtgcatatacattaaatgtcaataacatgattttgaaaatcttacggaaggtgaattatacacctcaatgaaaagggaaataaagaactggcaatctttacatgagcaaggatgaaaaatataatttcccaaagtcaacagtgaatatttatgaatggtggcatttggggtaattttagtttttttctttatcttctaatcattatttaaaatttttgatgctagccatgtgtcactcatgttgttaattcaaacataaaaaaaatgccaggttgccttcaactgtattcctcactctgtgcctactttcagttttgatccatgtctgggtgttttgatcaatgcctgggtgtttcatatatataaaactgaacaaagtctaaatgtattcggtgattacataaaaaataagataatgaggaaaaccttcatctttgatgcctttatattgtgcatcaaaggatgaccctagtttaaaaggaaattgtaaatgataaaacaaaggtttagttcaaaccattgccctaaatgtcgggccttgtagaacatttctttagatttctctaaatgtggtggcaagtgcatttctgtggaattgcggacactctgtgcactttctctggtttataaatatttagtactatgattactcatatattcaggtattggaatggaactgttttcccctggcagtcttttttttttttttttttccccatccggaatgacattccagattcagaaaggactggctgtcatttagctctgttatttgagagaactgtaattctgtatttctgtcattgggccagagtccagattctgtatgctggtctttttttcataattgcatttataaaacgaacatttgggctcatgatggcaacctttcccgaaggttggattccctgtgcaaaagactggagggtgatctttccacttagaatatgtttcccaagcaaatctaccttgtcttcttcatatcattgttgtttaaacaaagaggttcagc

SEQ ID NO: 72626 - DNA, 1050 bp, Homo sapiens
agtatctaatagatcatgcaaagtcctgattccccaagagaactggattattttcttcctacaaatccatcatattcagagctttactcattttgtttcaagcagtatgtacagggatttctcattgatcatttacaacatgcctgtttattatgtggggatagagaggtactaggaagaaacaagaaagataaaaagctatttcaaaatgtcaggaattcacctaatctcaaggttcatgttattttccatgggggaagaatgtgattagttagtaataataaccaactcatttatttacaaatatttactgagtgggcaatgcttgtgaagtgtattgtctaatggggaatatggacaggtgagaaggcattcaacccatagtgtagtaaagctgtggccccagagctttagaacagcaggctgaggagtgaaggatgtgttggagtagagggaggaggctgctgcagagctctccctacaggaggcatggcactggtgtgaattacgaagttgcagtgactgtggaaaaaaaaagtggactagatttaagacagacaacaagatgtatatttcaaaagatttggcattttattgagcataaagaagtgagagagggaggagatgaaggcaagatcattatttatggcttgggcaaaaaagcacatttaccaagttagggaagctaaaaatgaaaagaggttttgttaggtgacagtgagttcaattttggacatatggagtgtgatgtgcatgggagatatccgaagagaaacattcatctataggttggagattatatagagagataagatgtataataagatatatgtctacatgtatatgtgtatacacatatatggaacacaaatattaggagttccataaaaacaacagagaaatcagaggagaggtaattatgaagcaacatatcaagaaaatttcccagaactgcagaatgagagtttacagattaaaaggccccctaagtgtccagcataatggatacaaaaagatccagagcaagacacatcagcatgaaattttaca

SEQ ID NO: 72627 - DNA, 1037 bp, Homo sapiens
ttttgactggtaatgtgttctggcctccagatgaggccccagggctgtaacaataactgtatgtgagacagtcttgcagatggaaattggagctcattgcacagctgatgagtggcagcaccaggactggaaggtggctgactgtcaccctgtgctccttgtccctctgttccacactgcttctcacaccaagaaggaataacgagggtggtccagtcactcagttctcaaggcacccctgctccatggcaggcaggtagagacaccttccattggggaacactggctcagaacagccaacactgacccttatgccagacagccgtgaatctcagtgacattacagaatagtttcagactgtaaactcccttgtgctactgtgaattttgttatttgaagcaacatatgtaaacacttgcttcatctttaaagacaaatagtttgaagtggggagttcccaagaagaagaggattcctctgccctactcatttctctgggggtttgacttggcataaccagtgagtcgtgatgtgttgattgtctcactaacttccattcctaatagattgaattgttcagctagaagaaggaacacacgagaggagatgggttcatgggtcagtccctttatcagtgaagataaaagacatcagctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagtggagcttgcagtgagccgagattgcgccactgcagtccgcagtctggcctgggcgacagagcgagactccgtctcaaaaaaaaaaaaaaaaaaaaaaaaaagacatcagctttggctgctgactctcatgctggagggcagctgtgactgtcagcttgtgcatgccc

SEQ ID NO: 72628 - DNA, 1056 bp, Homo sapiens
ggagcccagtgaaacagccagccagggggcaccagctcctggactggcatctgtctctaaaatggtagaattaggatatgaacagtactcatgtagtggtgtggaagattaggagcatgatacacaaaaggaagaagtagttttaacagatatggtgatgatgatgatgcccttgtttcctgtatgtgacaaagaccctgcactttctccctgagacccccccaaaattgtcctgagcacaggcctgtctttgagcgtgcccaaggcgagaagaaccatgagggggtcctgcaggggccggagccatggaacggggaagaaaacagcccgcggacggggtcggcttgtccagggcacgcctgctcggcacacgtgttgccaacgtgaaggcagacatggtccctggccctaggatgagtccacgctgggcttccgggcctcaggtgcatctccagccaacctccaagggtcttgctccttctggggacgtacacagtaaatccacatggaaacaccaccatttctctttgctttagtggctctgcatgatactgtgatattgagttgggcattccattagagtagatcttgccacattgactaaatacacaagtatttattctagtagcaggcacaacctgcaaacacaaattcagttacagcttagctgtccgaattaggaaccgcttacatagccgcacctgctaaatgcagttacacagcaatactgacttccgtgtgatgctagaacgtggtacagtgtattaggctgctgtggtcagagttgtagcatcgttagcactaagtaattcctcattaggtggacttcggtgagagctttgccctaacctgccctgaccttgggtacttgagctaatttccacgtggccctggcttcgtggtttgtttgttttttttcttttgttacggacacccatcatgtatggctcctcatctgagccatcaccgctcccgaaacacatggggcggcagctgctgtgcctccttctcaattcttccacccccccacaccatcagaattcggatttctctcca

SEQ ID NO: 72629 - DNA, 1947 bp, Homo sapiens
tcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtggggggcacgtggacatgccccataggggccccacccagacttaacaggcaaggtcctgggcattgcgcgacgcaggactcaatgctaaagcaagcctgcctggctctgtgccagggcccctcttctgattcacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgattactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcactcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgt

SEQ ID NO: 72630 - DNA, 1199 bp, Homo sapiens
catccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggatgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgagcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagcct

SEQ ID NO: 72631 - DNA, 1050 bp, Homo sapiens
gggagtgggggtgggcactccctctctcttccccacactcgcccgacggtccctgtcactctcagttgtgctgcctttactagacagttttactgaactattggaaccggcgccactgccatggattgaagccacctcctgtctcttcaggttcccttcctgccagtgctccccatcctgagcatcttcgtgaacgtctatctcatgatgcagctggaccagggcacctgggtccggtttgctgtgtggatgctgataggtatgtgatgctgctgccagcacgtccaagatcctggcttcccctgggggtctcccttgtttcagatttcataacagaatgacgcacatccagtcagcagctttctcgaagataatgctgaatccctggtaggctgtgagtcctctcctccctgttagatactttttgtttccattgcttcttgtccaaactatttattcttttgggcaagaccttgatattaacaggaacaaggtgatgagtctgctgcagataaggtaccagttattttcaccccagacaggaaagtctggcctgtgcctcctggccccctggcctgcccagcaccaaattggtacgggcactaggcccaggcagggtggatgtcatgggctcctctgtgattgcgtcttctctgtggagggagagtgctttggagcctatgggagatgccactagggtggggagcttccacatgagatagatcaccaggggtgggtgcagcctgtagtcccacgcctctgggcatctcaccccaggggctggaggggaggatctcatttccttcccctcagcatctgagtcatagtgctgatagccaggaaagtggccctggccattgcccctcaggaccatgtccctacagcctcgcagccctgagtttgcatgctacgggcagatggctgctgcctcatctcccagggccctcgaggggtgcttttcctccaggaaatactttgcggcccactgtctgctggcagccgggtgggtcctcattccctgcaaagtccagcctgttagacagacgtctc

SEQ ID NO: 72632 - DNA, 1811 bp, Homo sapiens
aaacacacctatttttaaattatgaaacattttcttatgtgattctatgctcttgagagtgaccacagtggtcagattgagaggcactatacatcagaatgtgaccagtatatttacaggattaaggacttggaaatagtcattgttttctcaggctttacgtggaatttgatcatattaaagactggccttaatttccttcccctgctgatagagggagatcaaatcatgctctttgaagtgactgtaaagtacatgccattcacaaaatccaggatttacccttttcatttggtgggagtggtaaataagtatttggttttctaaaatcacctcacatggaagaaattagtctcaagtttcccgtgagtaggaacatcggcatttgtggcatgcacagttgggcgctgttctgattatccaaaaggccctccctcattgctctttaattttgtgttttattctccatttaaatttgttttagttgcagtgatctagaggggcttgagagatatttgtggaaaaataatggctttgtgtttatattttagcttgtgttgattgcatgtgttttgaaaatatcccaaagcagatgtagccaagttgttttttaatgagtacttgacatacacacccatgtgaatagacacgtatactctcacaacgctcacaaaagatgttcaaataagggtgcaggttttaattcattttaaaggcaagggacacagtgaaggggctgatactatattgtttgagaacaactcttcagatttcttccacgtgaagtgacttcacatgtgaagaactctgctctcctgcccgcctgcctgggttaggacctcctgtgagtcctcccagagcaccagacttgcccttctttatcacccagcactgttgtccactaatgcctgtgtcttggtggggtacactcaggaaggctggggactgtggtctgccctgttcaatagtgagtacctagaacccaatgatgggcacactctgaccggagctggatggatggaagatgggtagatggatagatgctgaatggatggatgggtggatcggatggatgaatggatggatggatagatagatggatgagatggatgggagatgggcagatggatgagatggattgatggatggatggtgagtggatgaatggaagataggtggacagatggattgatggagaatggatggaccgataggatggatgatggatggatgcacatgagtctgtgaatcagcatggtctagaggaagacacacaggactcagagtcataagaacccagttcacatccttataccctatgcttgtgaactgtgtgaccttagatgagtctcctaacctttgtgaatgtttatatctataatgtagggatggcttacaaagttgccattaaaatcacaagaatgaagggattctctatacaaatgttaatgatgattactgtctgttgaggactgtgtctgtgatttaatcacaagcttaaagggaagcttgacttccctttaagctgtgtctttccatgggaaggccagggagggggtgggagtaaaagcagcccccttcgctgccctggatggtgggcggcagtggtggtcctggttgtcattgcatgcagatggccctccacagatcctggtgtctgtctcttcccagctgtgatggccttcctctttgacctgaaggacttggtggacctcatgtccattggcactctcctggcttactcgttggtggctgcctgtgtgttggtcttacggtatgtatggcttttgggggtctcatgacagaaatgc

SEQ ID NO: 72633 - DNA, 2246 bp, Homo sapiens
ccttagtttctctggaattgtttgttttgagattgagttactggtaaatatgggacccggggtaggactggctggcggctctgcatccttcctccgaggggccctggggagaagggtgtgggactggccgcgtggctggtttctcccccatttcctgttggacccctgcctcatagtccccacgtctccctaccctagtcattgtttagaagatgcttctggaaggggcgatactctgcacccttgtgaccctgggccacgaacagcagggaggcctgcacacacggagttagcatgcagtggctggactcagcgtctgaagcccagggcctggcagcggtaacagggagggctgactgccaggttccgctcatatcaggagatgagcacagctccttacgccagactgcgcagcgagtgacgtgacatttgtttgcggctcttttttctagtgacacaaaagaagggaagcccggtgttggtggattcatgcccttcgggttctctggtgtcctgtcgggggcagcgacttgcttctatgccttcgtgggctttgactgcatcgccaccacaggtatgtccgccagccactgcggtcccgggtcctcctgcaccctgggcaaacaagccaatgcttgccatttccctccttgctggcacggtccagtcgccgctctttcacacatgagcaacatgtagatttgtagcttcctgccaagccctcccacccccaaaccattatcacatccccaactgtcaacacctgatgaaagctggatcttgaataaggctaaggttccgctgttagaatgggatcatagctgtgtggctgtggcctgatttcatatctgagcgtcttccgggaggagtgaggctattcacaacattgtcatcctggcggactgaataggccaggcttcagtgagcctcccagattttctctgccaaaggaaacaagtctcttccttggctgcatcaccacattcaggccgagaacactgttgcagggccatgggctgtctgatgtgtcttcctgagcaccacccctctgctcccggaagcacaggaggccccagtgcccacagggctgagtgctggagggaggtttctcgtagggtcacgtgggttccggggcactgagaggccttgggtgtcatgtgggcagatacactgcctcttgctgtgtgccctcctccgctgaccccttgtgcttctaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccaggtgagaggcctttctgtggtggctgctcctaggggtggaaccaccagcaggggttaggctatagcaggccaggtacagccatgcgagacacacatcggctgccagcattctttacccttgaaatagacccagtacccaacccagctttgatcatgtggcttttcccttgttggccagtattcatcatcccaagagttgtgttattgagaagaacctgaggctggcttttcagcatcatctgcttagcaagggactggttctctgtccctaaatctggccactggaacaggcccgctgtttgaacaccatattttggccctcagtttagctgtcatgcagaagctactttgatgaagggaataagtgccttttaatgagaaacattttcaccaatcgtatttcctcttagcctgtataaacagagctatttggtaaatattgatttaccacagggaaatcttcatgaatgcagtgatgcttgtattttctgtttgattcagctagaaataattgcaggaataaatacagttttccatctgtaaagactgtactgggtctcatgctagtgtatgttagatagatgttccctattctttaccttaatccttattcacagtgtgtgctctttctgggattgatttattaaatgccaagtcttttagccacaggcctcacccagcgtggagggacggcagctcttggtgagctcagactccctctcctccgtggtaaaccgagcatggctggatgtggtgcctttatcccttatgagccaggttcactcacgcggtttgcctctccccatc

SEQ ID NO: 72634 - DNA, 1029 bp, Homo sapiens
ggtcagagctggctgtaggcacgagcatgacccagctcttccagaagggaaaagagagcgtagaggagagtgctcaggtctgttcaggacagaccagaagacacacagacattccattggcaagagtccactgggggccacatagagctgcaagggaggctgagaagcactatctcacattgggaatcttagcagtcacgtatgcccagttggtcactggttcagggccaggtgccagccatgtcgcccagtattgttaccagtgggcaggcattgatgtgtgactacttgaatggaaacaggaaactatggcattcggtgcacgaaacttcactaacactaatattttgtggttagcagttctaataaaactgctttcctaaactctgttatggagaactgaggcctttgaatatgtcatcccgagcatttcagagtcatatttatgccaaatttatgggtgtccattaatctagggtggagtgaagccaattccaaatatgtgttgaagtaacgtgtagcctttgaaaactcagagcatattcgaccggttgctagttataggtcaggaatgaaatatatagggcacctcttgttaactggttgccaatcgagatttaattttattatttttatgaagagattgtgccagccaatggtatttactttcactggtcatcctcatgctggtaccctagtaatgatgagctagctgtaccggcccccagacaaagcagcatttgttgccccaatccctgatcataggtggggcccccttagctacatctgacggcctcactgccagggcccagccccctgaccacagggacggcaggggatcggccatgttaggaggtggagttctgcaggactggagcctccttggcatgctctattatgttgttaaaatatctaagcaactttctttcttttttttttccagccgtagctttgtgtttctgacaacagccatgtagtcttgcatgacattgctggttcctctgaaatagtagggcactgcccaaccaa

SEQ ID NO: 72635 - DNA, 1109 bp, Homo sapiens
ctcccaggaaactatgcaaagtctttcttcctggaattgttcctagaggttgtttcccagcaacgcatccttttagtgagagggagcggcttggtgtgcgggtccaggctttcccctccctatgagaggggctcatgctccagatctctgcagttctcgggtgccccttgggtgggcttctcagttcccaagggtatctggaggtcacctaggagggcctgggaagcacccacaaccttggtgatttaaacccctgatccccgcccccagaaagataattaatccaccccattcccagaggctcacagaggtctgcagaggctcgatgcacttggattctttttcagtcgccttcttatccccatccaggaaggaccttcccagtttgtggttaacactcagacaaagttttgtgtctatgcactttttcaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaagtgagttgctgcttctgaccatttttcttagttgacatttaatgacatagattgtatgggggatataactggctaggatggcatgtgcttttaagaaaacattatttgaggatattttgttaattgttttgtgtttttgcagtgaagtagctgagggtattttgtatgtatcaagtttgtgtgaaggtttattcccctgaaatggaaagactattgtatgacaagaaagactgaggaaaagaaaatcatcaccctaattccaaattgtgtatcattcaggattcttgtcagactcattaaatgatccctctttccccagattctgtttgatggccaactttggaattttgtgttcagaaaagatttttctctgcagtgccgtggtgacctcacttcacctttaaataccttcctattagattaataatgtagagggaagagaaataggtgaaactatttttgaaggttttcagaatgactgaagtgtcagaatgtgagcaca

SEQ ID NO: 72636 - DNA, 1046 bp, Homo sapiens
cattcaccctgtcacttgtatcagaaatctttaaaatagaacataagagagtctttatctcaaattctgactcattgggtcattttactcctggtgttatgtagtggttactagaatagaatgcagagttagaattcctgtgggaaacgtgcttttctgaggatacccctcaggtaagtgttctttgataataaatgacagggagcaagagggatccgagacccttgggcttgcaagatttccatcaaaccctcaaataaaaggaggcatcaactgttgtataaattcctccccacctaatttccaggtgatgctctcaaagtattctggcaactttctgtgtaaaccccaacagcaggaagtctctaccaacctgactttgcttgctggggttggaatggttagctaagtctgtgcggagtagcttcgtgcagcctcactgttggttgaacaaccagctttggagtcctggcatgaatgtaagagctggtataatgtgtacaaaatgctgacagataaaaccacttggagaacaggtttttgcattacttccaaggagacaggatatttcttaaaataaacccaggacagagtaagtgtctcattttctcctaccctgggaagtaggaatgaacacctagcctgagacatttacattctccagattatcagccctgggcttctcagcagcagttggctgcatctttgttccagtgtcttccaaaggaattcagtttgccctctccctagatagcaagcaatacttaagaagtaaccaaggtaaaagtaatctcctgtaggggtcccagttgtccccaccccaccccactgagacccaagcacttccctccagcacttccctgggcttggtgtgggggaaacaggccaagaactatacccggataaaacgggccgctgcgtacctattcaggggaaatgagcgcagctgtgcacaggtgtctcaccagaaagtcccttttcacattatgttagaaaaccgttatctgtatctaagcttacagtaatttaataacctgccccttcat

SEQ ID NO: 72637 - DNA, 1074 bp, Homo sapiens
ggcggaggctacagtgagccgagatggtgcccctgcactccagcctgggctacagagcaagactccatctcagaaaacaaacaaacaatagatgtaacctgtgctctccttttctcctgattctgtgaaaatgtagagtctgactgtcacaaagccataaccaaaaaaggaacaattttgattatgcccggtttggaatatttgagttgaatgttggcatattgaggggctggctctggggtcaatttggggtggcactccagagtgacagtgtgtggtcatggtattggtctggtgccttcgatgaaagcaatgcaggtggcactgcctgtgacagatgataaaatatggaccacgtggtgtgctgaaagggccactccacccttcaccccctctggcactctcatgcggtgggaaggaatggcactggtcccgcatcctgggctgccttgttcttcgctggcttcctcctggtccacgggtacggttttctcctggtctttgatcattcaggtgagcatgcgggcaattggccatttgtttccagatacctgaaaggaatttcaggtaaattgaattgcattctcctctctgatagaggctattctcttagtgcccactagcacgtccgctccacgtaaagaggaggcctcctcattagaaaagtacaaccagtacttgttgaagactgaagacaggcaaggtggtcagccaggccaagaggctgtgacattcctttcagattagaagtcagattaaaagtgtgttccttctggagtgagtgtctgaaattctggtcaccagtgaaaaagtgtggttgtgagtagggcaggaagacctaccataaaatgtggcgtttcctggtgggaattacttatgcatgacatgaactgcgtagataatccccatggtaactacgggtgtgtgttttacgtgtgtgtcagggctctttgagaataaaacagggaccggggaacaaatagatcaatatgaaaggtcacagcatttgcttacgcaaaggtgttatattagttggattaaaatattgtgctgtaaggcaagcatattgatttc

SEQ ID NO: 72638 - DNA, 1271 bp, Homo sapiens
aatacaaaaaaattagccagtcatggtggcgcgcacctgtagtcccagctacttgggaggctgaggcaggggaatggcgtgaacccaggaggcggagcttgcagtgagccgagatcgcaccactgcactcaagcctggtgacagagcaagactccgtctcaaaaaaaaaaaaaaaaaaaagcattagctgctccagtgagtgctacgaaatgttaaggtttaccctagaccttggctttccatttttatgtaagatttcaaatttcaaaacaggctctttgagaagacagcctccattcatgtattcatgtgttccacaggtattgggtgagctcctacaggtgctggcactgactttcccaggttcttgcccttatgggccataactcccacagatgagttcgtgttcttgttcacgtgagcactaggcaacattaagcgtcagtgatatttggtgaaaattaataaaaaatgtactttcagctctgaatggggagctctgtaggcctttctggaagttgcaaggcatctcccacagctagagtgataacacaggcagttggtcaagaaccctgttttttaatgattaagtgaatgaaagagaatgtcacactcttaccatctatcttcatccctttgtaaactaagctcctactattctactaaaactgctcacaatttcaatttcctctctcttgaattagacaatatcctgattttgtctcagtcctcaccccctgtggtgtctctgaaacatttaatacgattggccattcctttctacagattctctaattttctgggtctgttgaaggaggctttctttgttttcagcatgtgagagagcttgtcaaagaatggagtcattgcttgttagtagctgggtacgcagaaatgcctgtggaagtcagggttcatggtctgcggctagaaaggtgctgggcaaaggggaggtgttcaggcctgaggcctgagctgtcagtaccaaaccagggttaccaggtttagcaataaaaatactggatgcccagttaaatttgaattataaataagcaatggatactttttttagtataacttttttatactaaaagattatttgttggcaatatttgggacatcattgtgatatatttggggcatacttacattaaccaattattggtcattcacatgaaatttagatttaactgggcagtcctgtatttgatctgacagctctttgctaagttaccatccagtcacattgtcttttgtggctcctggtgcac

SEQ ID NO: 72639 - DNA, 2105 bp, Homo sapiens
ggtgtgtgcctgtagtaccagctactcgggaggctgaggcaagagaatcgcttgaactcaggaggcggaggttgcagtgaaccaagattgcaacactgcattccagtctgggcaacagagtgagactccatctcaaaaaaaaaaaaaaattgctagtggatgcttatccattcatgacaggggcagccgtttcctggtgtcagatccctggccgtggtgtcctgttgtgcggggcgcctcaggtggagtttggaatgtcgggataggccatgagaagtttcagttccatactatctcaccagggaggaagcctgagagaagttatttttcaaaaggattagtgagccatacacatcaaaatatatacaggcttcatcaaaggaaagagacccagcttgaattgaggatgaagcatttccacagcagagtctggccgaagctctgtgttgagatatctagagagagctgtctgctgcctgaaaggtttcttgtagaaaacccttcatggtggcaccacttgtatctgtttctcttctgccctcctgagggacatacttttccccagcggaatgaagaaaaaggcaatattgaaagatgtgtgagagcgagagttcttgcctgctgccaggccccgcctgcggagagaagggcagggctgtggaaagaggccttgggtctgagaacaagaggactcattaaagtctgtggcttttgacaggctgtgacagggagccggggtattgagggatcacttttccagcattggtggatccttagtgggtttggagctctcagagtacccagtgaaaaggcaccgggcaagagctacccggggtgcccggttgaaccagtagcttgccgtgtcctctccagggagaaatagttcaggacagattgtgccagatttgcattcctctctgcagcccttccagggcttttgaaccacggctgggctctgggcagactcagctggggacagacggtggacactcggcacctttcttgggcctcacaacgtttgcccaaggtcctttaggtttgccttagcagatgtgatcctgccgatgacagggtattcttatctacacttgcagatgtgtgtgtattaaaataacacgcccttggattgaacagagcacactcagctgtgccactgagttcacgtaaggtttgcagtaggacaaaggatggcaaagagttcgatttgcaaaaaacaaaaaaaaaacttcagttgtgcagcccaagttcagatgtcttaaatatctgctctccggacagaaatctgataagggttgtgctacaggagaggggaaatctcatttgccagcccctaagaaggcttggcttttgtttggggatggcaaggacttcctaagagggttgactgaaagatcccgaaaatgagagtaagaaatgccctcagagtctcaaatgccacaggccacagcaaggagaaccacggacttagtgaccagctctagaagtcagcacgtgttccttctcagaacttgcaaatgttttagaacaaatgaaaagcaaacaggactttccacagctggtgacaaactgacccaagcagagggagtggaggaggagagggtctcgagctccagaagaacgtggttctccttggttgcccagcacgcgggggctagcggtgcttggggtgatcacaaatcttttgcaaatgctgtcatggggcatgccagcccacaaagcctgctttgtgagctcctccaaagacaggacactcggccagagacgactaaggttgaccaagatattatttcttgtgatcttggccgtccaagtacaggctatgtggcatttcagtgaggagcaggacaacttggtggccaagaggcccgtcagagctgcctggcttgcattctgcacgtcattgcaaagcaagttgcagccccagcgtggacacaactctcttggagacaaatttcagatttccctgttctctccagtgtgtgttttccacctgtccccctttacttgggacttcccagagccacacgcccagaagacactgccactcttcagttagtgtcacttctcctacactgggcatccagcttcctccacagcctcaccaa

SEQ ID NO: 72640 - DNA, 2504 bp, Homo sapiens
tacacacacagaggcacacatattgatatatagataaaatgaaaatttttatgaaacagtactcatttttactatctgtgatacgctgagataatttttattcttttctatttcattacaagaaaaattcctcgtggcaacttggagtttgcaaaacacactaggtttagacatatgagccacacctcacctgcaactccaccacattgtcctgaatttcatgttcactgctggcactaggggatgggagtcaattctccatccagaccagttagggcaaagaaagttgaagagtcaaggtttctttttgtggtgatttaggagtttctgactgaaggggacattattctctgtgatgatgcccaagaaagtgagtaggttttcagggcagacctgtgtgaattccccagtgtggtttgcttttgcatactggggtatctgtccttcgttaacctgacacagtggtgtcccaaaggtggcctggtcaggctgtatgtgagtttttagaaatgggccatacatttgttaatttcagtgctctgattttctttgagtttattttattcagcgtgatgcgacgaagaacctgtctgaaagagttaaggattttggggaagaagagtgagaaaagatactcatagaaatgttattttttgactaaatcttatgggttaatatcgaacggtattgaaactatattaacaatagcagccataccattaaatagttcttcttgaaaaggttggatggacttttgcttaagaaatgcttgaatgttttttctttttttttcttagaaaataaatgtctttaagtctgtgtatataattcacaaaacaattgtaaatcaagggaattgactctgcctaacaaaggtacaatgacataacagaactagaacaagataaatggcctcatttattgaaacaatgtgcaaatgtctgtccttgttcttgggaagtttcttttatttactatgcttctcaataaaaataaatttgttgtgagaactcagagtgcttactttacagtactcttaaaaattcatatagaagttacaaatattggccaggtgtggtggctcatacctgtaatcccagcactttgggaggccgaggcaggcagatcacctgaggtcaggagtttgagaccagcctggccaacatggtgaaaccccgtctctactaaaaatacaaaaaattagctgggcatggtggcgcagtacagctcccgagtagctgtagtcctagcagagggctgggtcccagctactagggagattgaggcaggagaatcacttaagcccaggaggtggaggttgcagtgagacgagatcgtgccattgcactccagcctgggcaacagagtgagactccgtctcaaaaaaaaaaaagaaaaaaaaagttacaaatattaccatcaccattgttggtatttgagaagaaacctcatgaacttgatctgatgctgttatatatgttaacgtttgaaataaatgatgactctgttattgcaagtgtaccacacttcccccacaaatctataacctcacagtttcagcagctaggttttttgtttgtttgtttgtttttttaacttttgttggaagacatttcttttttcagattgctttctttccagagggcaatcttgggagaaattaagcaagagcactcattagttctgtgagtaattttattgaactgggaagaatgtctgtcttgctggtctcagagtttgatacaattagaattttagaaaattatcagatctaatttgtgctgggattcaggcctaattactgaaagactctgtggtctgatgagtcaaggtgagggcattgccgtctcatgtttcttgggtgatttggagtagggcagtggccaggggaggtgaaagctctctgcacaaatccaagtcactttcctgcggctcctggttgcccatgagtggtcctgtgtggagcatctgcaagggaggtcttgctgagtcaccctgcatagagtttgagttgctggaagagttgaagtctactaagagctgctggccttgacccacagaggtcccagcaagagtctctttccagcaaagtgtcctgctgtgtgaaggaagaaagcacgattccaccctggggaggtacttgggagcagggacagagggaaagcatgggtttctcaacacggatgctttgtgggagcaagcaatactgccccatatccaaatgagcagtgactcaaacatttgagttctgggaattgcccttgttcctagacttccttgaaggaacagaactgtgggggcacacttttactgtgcatgcgggcacgggtgtgggctcctttacagttctggggtggggcctgaaggccacatcgctgccaggtctagacctaatgagggacctgcacctaaagatgcaagctgtgtaaaataaaaagttgaaaagttaaacctggggataagactaactggagcgtattgtttctggaaatgtagcacacaaa

SEQ ID NO: 72641 - DNA, 1567 bp, Homo sapiens
ggagctgacggtctttcatgctcctgcccaccccttgggcaggtgcccaccgagcaggcagacttaaccagccttggtggtgcctttgtggtgcatatcctccaggtggggaagggtggagatcgttaataaatatccagaacttgtttgagacttgaaaagaaatgttgcaggcccactcttgtctggtctataccccttgcttcctggacttggcagaggttaaggatggggcctggagcgtgattgagggaaacagcactggccccatatcagtgagctcttgggtgcttcatgtggttgttagacttgccttttaatgagcctcttggcccctaccagtgggctacggaagaaataaaatgtgaaattttaccatgtgaagtttgctgtttgccaatgactgtgcttctcaaaagttcctagggaaaggttttaaaactggtgcaggtagtgaagtttggatctcgcttccctgctttgtccgcttaggtggtccattcgccataacagctggaactgagagtggctctcccctttcctggcccagaacgggtctttgctaagcgagtctggtttctggaaggattttgttcttagaagctactacgtcattgtcctcagctccccatcatttgtacctcagtttccctgagctgtaagtctatgttatgtgtgaaaatgggcctctgaaggtcatgatcaaaagccttgagtatttttccatgtgtttgttttttctactccggccccagaccctctccttgaaggagctggccttgagagtgacttcggtgggcagccgcccagactccacacaccctgctgagtccacgtaacgcccaacctggacgggccagagctgaagggctactcttcaaagaaaccctttgaagtgcaaacatttcctttcctgaaaagaagggaaattgaaatgaaaacgtattgttctgtgcagacaatgttctcttcgatcaaagagggagtggggcttataaagggagatgcacaaattagagcttgatgtggccagtggtgtggatgtgaatattcatccctgtggaggaaaatagtggggtctctgagatttgtaagattgtattttccttttttttcttctttttccttaaggctctgaatctaggtctaacgttctatttaatgatgtctctcctttgtgtttttatcttgtggtaagcatttgggagtgtctttcagtaaatcatgataccatttccatgttagaatactatgtagccagtaagaatggcgttttcaaagaacatttgattttgtgggagaaactttaatgttaaaagtgaaaccatctgggtgcaatttcccatgttccgtgttagcttaatgagatatatgtatttgcacagaaagaaaagactggaaaaattggactttgtttttctcactgcagtgtttgtggcacctaaaatagtgctcaagaaatatttattgaatgactattcttataattagtaaaactgtatttaaaggaggaatgtctttgagctaatgttttggcaggtggatgggacaatatattattttaagt

SEQ ID NO: 72642 - DNA, 1102 bp, Homo sapiens
tcattgcaagcacttatttagtgctcaccatgtactctgcgctttatctatgtttcatttgaatcttcctaaccacccagtgggatcggcccttctggtgtgactgatggggagaggggaaggcaggtggcccacgggcacacaggtaggcagtcagtggcagagtgaagattggaacccagatgtctgcctgtacctggactccagcctgtctcgggataggcctggcctggcctgccctgtgtacactgagtgggaggcagacagatctgaagcccatctgcctgcgtccctctgtttctggctgagtccaggtggtgctggcaccggtcacccgccccaacgctggagggcaccctgcctcccctctctttgccctgatttccctctgctgtctctgaaagtgggtcttccccctcccaagtccaggcacctggcacagctggagccctggggtccttggggcagctgcgctgggacgtggccagtgtcaggagccggtgtgtgtgacggaggctgggctgcattctttctgggtcagtagtttggcatttacatcaccagcctttggctggatgcaatgcctcctgcccagaccacaatggagccttgtttgatttatcaccatccagccacgcccacactccacctccatctccacctggggagacccctttgcagggggtcttgtggaaatcagagactgttcgtaggggaaagtcagcttccttttctgtgttccatccttcttaaggccagtggccgctgtcatcctgcccttggcttggctttgctgatttctacaatatcttgcggaggtgccccctttccttagaggatgcatctttaacactctcagagaggctggggcaggagctgtccacaccagggcctgcagcaagggcccgtcttccccaaagtgacttgggagagtcttcctggcccgcagcttttccacagtgtcagggacacctcctgccctcccttgggatgaggcctggtctaggagctgggggcgttagggtgcagtttctgggacccagtgaaggcccctgggaaagactggcagttagagttaggagaactcttccctcatcccttt

SEQ ID NO: 72643 - DNA, 1063 bp, Homo sapiens
cgccgcgggaaccccaggttggggcgctgggcgcgcgaagactcagccgccccgcccaccaagggcgcgtcggtccccggccgcagcctctgggctggcagccgccgccgcgccgcgctcccattggtgcccggcggtgacgcggccgagcgggccggggctgcctggtccgggggcgggcgtggggcgcggggcgcggagcgcgaggggcgggggccgggcgcactgctgatgaaacctggcgccggaacccgccagccctcggcgcccattcagtccgcgcaggcaggtgtgagcagcgggtcaactacctggcaggcgcgcacgcggccgcgggctcccgctaaccgcagcctccactcctctccccgcgcgccgcgcccccgccccgccccgccccgcccggtctcgccggccgagcgtccgttggtccttgagcgcgtccgacagtctgtctgttcgcgatcctgccggagccccgccgccgccggcttggtgagtgcccggccccgccaacgcagggggcagctccttgggcccgggtcatcacggagggggccctggcgccgcgtggggccgcggcagggcggcgcgggagtggcgagggcccccgcgccgggaacgctgccatcctctgggaagggccaggaccagggccgggcgggccccggagtgggcgagcggggctggtgcccatgcgactgtcgcctccacggagtccattttggctccctgaaaccgcggcgtggtgcatgatgcaacaccgagtgagtaagcgtgggcgatctggcgatgcccgctccgcgcgcctgtccggggacccgcgcgccgctacgcacggggtggtcggggtgcgtaggcgggcggcgggcacgggggccagactgggaggcacacggagcccgccggcggcgaggagaccttcccttacatggcgcggtgcagagcaccccgccccgccacgaggtccggggatgtgtcatcagccgtgggtggggactctgcccggccgcccggagggtggtcccgcggcaggtggccggcccagggactctgctgccat

SEQ ID NO: 72644 - DNA, 1093 bp, Homo sapiens
gtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatacagaacaatattccatataaataagtttagcctttataaaaatgaagttgcaggctgacattacattctgtactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttt

SEQ ID NO: 72645 - DNA, 1294 bp, Homo sapiens
ccaaactctcaaggtaagccatgcactggaaaagtatctcagttgaggcacaaagacaggcattcaaaaatgctaggtttttcttggatatgctgagggaagggaagtttgcatagtttatgaatagagattgtcaagcaaataaccagacatttttgaaacatgctaaaattaaaagaacatttattacagcttcttaattttgaaaaatgcaaacatttttaaaaactcaaaactactacttcctacacttgattgcctagcccattttcccctccagttctagaatttttataaacgaggctcttcttcgttttccctaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcattaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactcct

SEQ ID NO: 72646 - DNA, 1028 bp, Homo sapiens
accagcctgtgcaacatagcaagatgtcatcactgctaaaaatttaaaaattagccaggcatggtagcacatgcctgtagtcccagctacttgggaggctgaggcaggaggatcacttgaggccaggaatttgaggctgccatgagcaattatcacaccactacattcctgcctgagcaacagagcaagaccctgtctcaaaaaaaaaaaaaaaaaaagaaagaaaagaaaaaaaagaaaaaaaaacacaaaatagtgaatatacacacaccttcatatcagtaaacctatttttaccaaaacacaaagaggaaagaacaactatttttaacagataatacattctctgtggtcttctctagatagcctatttaaaattaagtttgaaacaaagttaacttctaattcatgtcagttcttatgttctctgaactactataaggtcaagataattaatgtctgtctgtgctttccattttcaagccagtaaccataacaatcttggaaaatgtgtttggtatttcttattttctttgattttttttttatataataagaccgtcagctgggcgtggtggctcacgtctataatcccaggtctttgggaggctgagacaggcagatcacttgaggtcaaggagttcaagaccaacctggccaacatggtgaaaccccgtctctactaaaaatacaaaatttagctgggcatggtggtgcacccctgtaatccaagctactcaggaggctgaggcaggagaatctcttgaacccgagaggcagagcttgcagtgagctgacattatgcgtctgtactcccgcctgggtgacagagcaagactctgtctcaaaaaaaaaattgcctccctcaagtgaattgttggtttattttcttcctttgaacttccccagtgtcatcttgatccttatgtcatgtatcatagtgatatgatttttttcagctgatttcacttaattttattagcagtagcaatttgaacttttaaaggacaagacttattttgacaaag

SEQ ID NO: 72647 - DNA, 1041 bp, Homo sapiens
taggttttaataattttcataggaaaaaaacttgtatatagtttattttcttttaattatattttttaagaagtagaatatcaactaaattttttttctgtttagtgacgagacctgcagtgtcaacatttttattaatttttgggtaaaaatgtatattctataataatagtgataacttgcaaaagttcaattctgaacattgttggagtgattaaatttaaaagtgtaatgaattttggttttcctttgttcatttattatggcaaatatgtctgacacacacacacaccctttaaataataggaaataaaatcaaatatcaaattcccattctttttaaaaaagttttatagaatttaaataaaaaccacaatatggcattggtaataatttaggatgtgattgaaatgaaaagcctttgagtcttcttttttacttaaaaaatttttagatttatgttaaaagaatcattgtcttctttcagataaatttgcgcctcattttggtaagcggaaaaacaaaagagttcctgttttctcctaacgattctgcttctgacattgcaaagcatgtatatgacaattggccaatgggtgagtgatatttttctcttgagtatgaataatgttgattcttatgccctaccttgtctcacaaacattttgaaactgttatataacatttaaaagaacaaccgaaaattgagagtataaggctcagatttagaggatcattgtacccttccttatcttgctcttcagcagtctcattcccaaatggtaaaggagcccagaatgcaatggctctgcttctgtcttagaactgttttaacgtaagtgaaaaaaattttttttttttttttttttttttttttttttgagatggagtctcgctatgtcgccaggctggagtgcagtggcgtgatcttagctcaccgcaacctctgcctcccgggctcaagtgattcccctacctcagcctcccgagtagctgggacttcaggcacgtgccaccacacccagctaatttttgtatttt

SEQ ID NO: 72648 - DNA, 1078 bp, Homo sapiens
tcctgaagcagttttgctataagacttgataaatttttagacttatgtatttacacagttactgttgcagttgtcattttctcccccttccccacccagaagggtgattaggtttcctctgagtagaagattttaaaatcttaacctgctttttgttctcattttatacttccaaactactttcaaactctactgtgagttaacaaactcaaatgttttctggaactaggcagtttcctgagtgtctgaagcaggccagggggagtaaggagggagtagtagggtctgtgtcaaaccgaagattcatacccacctataaacattaaaataatattttttaaatttggttcaaacatatttagaggctatgagtttccaacattctgaacatctagataaatatgaactctttagaccattgatttttgaaatatgaaagtgtaatatcagtttattggcaactgtgatgtgtgttagttttaaattaggaaatgctgagaattttgtggcaggaacccagttaaatttatggagtacagtatgtgtgtcttgttttgtcttgttttggtttggtttggttttcctctcacaagcttttaagcttgtgagtggaaaaaaagagattgggaatgttcaaagataattgaacattatctagaacatctagaacaaggacatctagaacagaaggtcttaggttcaatgaatagtcttcaaaggatccatgaatatcttataactttatttttaaatgttgtatttctatatttctgtgcttaatgttttctataaaaagtaggctttgttgatttatgtttattttatttttttttttagagatggggtctcattctgtcacccaggctggagtgcaatggcatgatcattgcactgtatccccacagcctcgaactctgggtgcaagtaatcctcctgcctcagcctccagagtagctagtactataggcatgtgccaccacacctggctttttttttttttttttttttttaattttttgtagagacagggtcgcaatttgttgcctaggctggtctcaaactcctggcctcaagctgt

SEQ ID NO: 72649 - DNA, 1227 bp, Homo sapiens
gtattataggttaaaatctgttttcacagatggcttaaattacttcttcgcaaatatgattgctgccccatttcggtgggggagagaaatcctttcttgacttctccagttctattttgaaattctttttctactctttttttcaaaaaatgggtcattatttcatccaggatgattagatggccaaaggattttttaatgccattccctctcagacatctataagctagaatgtgtgaatcggggtagagggtgaggagtgcaaagcattctaggcagaaggaaaaacctgtgtaaaggccttggggcaagtaagaaattaacagttttgactgaaagacccctgtggttggagcctagtgaggggaagagtggtggagatgatgctggagaataagcaggtccatatagggaccatggtacagagttgctgagtcagttggtctttagtagagtgatatggtagctaggtgctgtgggctcagatgcacctgggctcaaatcacagcttatctgcttactagagtctctaaactctgtcccacaactctagaatgggagagtaatacctttttcagagatgggctaggtagaataaccaagtgcagtacctgaaatatactacaccactcaataaatggcaagctattatttttactttttataactcactgttccacaccctactcaggaatctcagacccactgctgcttcctttttattatttttaaaattcgtccagcaaatatttatcaagcacttacaattacatatcctaactatccctccctcctgtagttatctgtttgtatgtctctcatagcttcaaggttatgagatcctcaaggagtttcatattaaccttttgcaatccaggtaccaagcagtgtctgttttagaaaatgtttgaataaatgaataaaagaaagtttatgaaatacgtaattaccatattttagcgctgcaattgtttgaataatttttattttaaatcagtcttacataggaaaatgaatatatcgcttcctcattctttgtttcttttacagtacagttagcaaaaattcaaaatatgccctttataaattcataactctagaaaatgtttattttaaaatttacatattaaaataagtcactgataggtttatatcttctagatcaagtagctgttttaatatgatgttattttttaaaaactattcattttcaaatgtcaataagaa

SEQ ID NO: 72650 - DNA, 2076 bp, Homo sapiens
aaataaataaatagaacattgctaagtaaatagttcacgtcaaagggttgccatacctataccaatttatttggaattctatcttgtcttttataaccttagataattctttaaaaactctgagcctgtttctaaatttgcaaaaaatatgtgatattttctagctcagtgccagggatccattagttcttgaattgtgtctctaacaatgatgcattctggtcttttcatgtccatggctttggataattgtctaatctgcatataccaatctttcctatttatgaatattatttctgctgtctgttagtcgttgacttttccccaggagtttatctgttcttttccttagctgtttctttttaaaatttttcctttcaattttaatttgcgctttactattctatagttctcttctttatttcccctctttgaagccatctgctgccatttgttttgctttctgtattgtaatacgaagtgttttgatgctgctagatttatattctctaacaatgagtttatgagcattctgctttttaaaacaaacatagtgtgatgcctttacctctaataaatagcacttaatgattatgttaattagcattcttagcttagaaagtatgcacagatgcagaattttgtgctgtattttatattatgtagtgacagggatgtatttgtcacttttgcttgtcgtttttcctgcttgttatgcaaagctgccctgctgaataatttgtcataccaattctaagtaaattgataaattatgtattagcattttaaaatttaattaataactattaataaaacaccattgtattcaagtaagaattcatgagtattccagagacatctatgtataaataagaacttcaatattaagagcacgtgagatcatggctttctggggcaccactaagtgacagtgtcactagtcacaggttgatgcaaattgtctgagctgaataggactgcaaagcagaggcagtgtgaaacaatcgttttcttcatagacagacagactgtattcttttaaacaggagagcttgctatcacttttgaataataagttaactgacaacatactgtaaagaataggatgatttatttatttatttatttttatttttttccctctttagagaaattggtttttattatcactgtggtctgttccagagcttgtattccaaaatagttgtgggaaatagtctgttatcactcaactgtgtataacggtaaaaaatattagaaaacattttttcttggtaattattggtagatccacttggtggttatacacgaagtgtccagttacatgtatatctttgaaatattttagtaatgttggctatagtttggcacacatactctagtacattattcattcatcctttcaaagtattaaatacctacttttttcaagcactgtgactgaggttgactatatgaattaacttgaattatttttccttttttgatttaaaagcaggatttaatcgagaaacaaaacacaaccaatggaacctcatgtccacaattgttctgtagccacatacgcataataaatgtgcctggtgtaagagaaataagaccagtttaagttttcagattgattttctaccttcaaggaccatgatttaattgggggagttggtaggatatggacataaatggtttcttgctacaataacagatgtgatatatgtaggatgaccttataatttattgtctaaattgaggtacttttgagagtgaaagggggcatagtaatagtgagacagcaaacatgagtcagaattgtcctaggcaagcatggaccctatggtgacagtgattggatatgccagtgattggatggaaactctgaggaaggaaggagtagtgtaggtttgagtggtcacttaggcttcaaaggtgacctcagaaccgaacaagaacaatcagaaagtcattctggtgattcttgccaggataggatttataatgaatatattgctttggctgaaataggaatttggatagggaattagcagtagttggactgaagagtttggattgtaaatattt

SEQ ID NO: 72651 - DNA, 1443 bp, Homo sapiens
atacaaaaaattagctgagcatggggatgggtgcctgtaatctagctactccggaggctgaggcaggagaatcgcttgaactcaagaggcagaggttgcagcgagccaagatcgtgtcactgcactctagcctgggcacaacagagcaagactcagtctccaaaaaaaaaatatatatttaatatgccatcaaaaaaaaaaactacattgtgaaaaactgggtaatggtggaaaagaaaaagtagaaggaagcaaagacagaggaatagagggcatcatgattcatgattcctccccttgaagagtttatagtctagttgacatgatatttaagtaatcctcatggatttacagacctaaatgtttggcagatttcatgtattaatagaaggaaggaagtattaataactgagcaatgttaggaaaaggacaaaccagggacagccattttccttaattgaatcttattaacccttacatttaagcataagactaacaacagttttaagacttagaacttacatgatcatatttattttatttgatctttgcagtagtcataaaaggtaaatcaacacttacgtaatgtgcctcccaaatgcatgtaggtaatgtatgtaatgtcaaattagagatttgaaaatgaattggtaaaaatgtaatggcaaaaaaaatgtattggggaatgtcagtgcagaatttgaagggttctttctccagcactatcttggccggtgtaaatgattgtatttcgagaccttaaagaggattagggggattcaccagagaaccacatcctggtgaaaatattgtatagagacattaaattcctataattctaagattctgtctgtaccttcaaatcacattttagtcactaactaagcctgcttctttgaccatgaacatcatatctctttcacaaggaagcaaagtacctagcatttaattttctttctctttttccttttctgacctgaagaaatgtacagtttcattggggagacaaagaccaaccagccaacagaaaactgatactaaaatatgaagaataagaaaaatacattaagaatttttttctttagagcctgtttgataatgttttcaataaataacttctactaatttataaataattaatttataaatacgttaactgcttattccatgccagtataattgaaaagtcagtggttaaagagacatttagactatgttctctttatatgacccacgcttcctgcctttaagttttttcctaaaatcttcctgttatttttctaaatctagaatatgaagcccttgaggaatagcagctgagtttaaacagtacctagtgaaaggctgaaagaatcctcaaaccttctagaagaatgaccttaactgttgtgatcagaatggagaccaagtcatggtagagatccaagatgaaatcattttatc

SEQ ID NO: 72652 - DNA, 1051 bp, Homo sapiens
tttttgttacagactcataattttatagtcttagtgtatgggagcaaagaaaataatatgtgatcatgtaatttattgcatttaggtaccttttagacatttttacttaaccatataacatcttcagttagtcttattttcaaatgattttaaatatcctatttgctgagtagtttaaaatgtgtgaagttgttgtattgctctagatttctccaagaatgtgctcttgatggtttatcacagtaaaggtatgaattaagtaatacattacttagccgtgattctcaaccaaggcaattttgccccctaggagacatttggcaatgtctgcatacttttttttattgccacaactttgccgggggcagggggaaggggaaggtggcaagggtggaatgccactgatatctagtggatagaagcaagagatgatattatacctcctacaatgcacaaaacagctccccccactacccaaatgaagaatttatctggtctaaaatatcagttgtgctgaggttgagaaaccctatcttagcctaagatcttgggttcagaaacagagctgtattcagtttcccacttacctttggcaagatatttaacctcattcaagcttcagtttccttatctggaaaataaagagaataatatctaccttatataaatatcgttagcacaatttctgagaccgtggtaagcaggcaacacatactgttctcattgttatcactaccaataatatcaagcatgtgaaaaattactaaaattataacgtttgatgagtacttaaacgcatctatagttttttggggtttctcttaattttgctcatttaagaagaattcacatatcctttgtgaaatagctgtgctgttgcaagtatgactacttagaagtttttgttttccacatattttctaattacacttgattcagactactctattcatacttgtattatcaaaataataaggcttaaatgctgtgaaaaatttgtagaatgattgcacatatttagaggactcagtctttagaataaggactgtta

SEQ ID NO: 72653 - DNA, 1074 bp, Homo sapiens
gccaagaaatataatttgaaaaagctccctaggtgattttgaatctaccttgccctcaaggactgctgaaatctaggaactttaagaatttagattctaaaattgagtttgttttccagacagaattcccaagagagaattactgtggaaagctgctgtagaccatttaatccatccattgtgataaaatggcagacattcttagtttgatataggtgtatgttttacataaatcttagtatttcaaatattttaaatacctcttaattattgagtagtctctttagagagttgttttttatttaaatcattggctttgcttaattaaatggtcccaaatttctgaatcagatggctattttgatatttaataatctggctctttcaagttagtactgttacctgagatacagaattatatgtaaccaagttgtatatatatgtgcatgtgtatttcaggccacatgcacatgtgttgtgtatgttcagatcattagaaggtaggaatgatcgaatgcattataagctgtttctgtaatctctgttgtttatagctataaatcatgttcattgtggaaatttggaaaaatgtgaaaagtttaaagtagaaatctgaaataactcattatgctatcacctggaaataacatctgttctgttattcagtttcttcctggttcgatctttggaggttctgtttccaggagtttatccatttgttctaggtttttttagactgtgtgcatagaagtattaatagtagtctcccaggattttttttgtattactgtggggtcagtggtgatgctccctttgtcatttcttatttggatcttctcccttttttctagctagtagtctaatttaatcttcaaataaccaactcctggatttgttgatcttttgtatggtttttcacatctcagtttccttcatttcagctctaattttggctatttcttgtcttcggctagttttgggcttaatttgctcttatttctctaattcttctaggtgtaatgttaggttgttaatttgagatctttcagactttttgatatggttatttagtgg

SEQ ID NO: 72654 - DNA, 1524 bp, Homo sapiens
cttattcaatcctcctaccttgtcctcccaaagtgctgggattacaggcatgagccaatgtacctggctcatttacttttattttagacacatttgctattattttaggtaaacagtttaaaactgattacttcagcacatagcaagagatttgttttagatagtcaaaacagtcagcttatatggtaaaaattccttattgttacttggttctaaaagtaaattccctaaactctgtggttatattccataatttagtcagtttcttcaataccatattgctttaattgaggagaagggactctagacaaagtaatgtaataatattaatattattcaataataaaattgtaatatgtttacagagtgctttttgcttttcagttaaaatactttcattcatattgtcttatttaaaaatagattatttcttcttagtcagatcctggtgacagtggggaaaaaaatcctacaaagctaacagaattcgtagcatagcattctgaagtttagtggaaaatagccctgagcacctacctaatatgtcctaaaagcatcattgtgtgataaatgatatttatgatgactccatgcagaaactggttatttgatagatattgaaaggtgttaaacttacctacatcagaaatgtatagattattcagctgttctcaagttgaggtagctcccaaagataaagctaagatagacctgtatgagttcagttccttcattgcagtaggtaagttatccagacatctttcattgagtgcttttctatttgaattggcatcttgtttaatcactttgtgaatgacatggaaacccactcatctggtaacttttagatagatttttaggcaattcagaaagcacactgagaatttccctaaaatgtcagtaacattgcctgaagttttattttatggttctgggttggaaagacagtacatatttgggaataaagtggcattcagaagagcaacaataaaatggggttttgtttgtttagtttagctgtgggttatacatattccttggcttctagacctcacaaatttatttgttcaggaagttattaacacatttctaacttggataaaatacttttaatatctttgatctatggtaggtgggtaattcatggtcatttcccaaagtatgtatttatcatttttggtatccagactagaggatctcagaagtttgaagctgatttattatatgagatatttctcccccccacacacccatttcccactcatctaactcgttctatttgaaatctcagctgagtctttagaattctctgggatgctgtttcagacccttgtaaatctgtattggtgctcactctttgtgccccagtgacacaggatttctgttgtagtacacactggattgacatttcaattgctactgtgttttgcgcagagttaggacaattcataggggatgggaactaatagttggtgaactaacacagtaataataatcttaaatatttgcccaacatatatttaa

SEQ ID NO: 72655 - DNA, 1031 bp, Homo sapiens
gtattatgtgaagtcagaactttaaaaataaggaaacaaacacttttttgaaaggctggaaaaacttccttaacatttaaaaatagttcttaaacagagaaaaatttgtcaggtgattgattggccttaatttgagaaattattagttttcatcttccttttttattggaaggaaaaggaagaaaatagttatttgtgtacttctgatcaagtgacctaaacagttttctttttcctttgctctgtaaaagattagtagtcgtttaaataattgatgttaagtgtctctgaattcctgtgttttgaaggctttgcacatattaactttctcttcctgactgaaaaggatgtgtgtgatagtatctttttacttagttagtctaaatttagatttcttgatcatgaattagaaagcctgtgagtatatgtgaatgttagagtatgactgttttcttatttttagctacttttgctgctgaacttccttttttcactgcttggtgcagttaagggtaaatgcagagctgattctggtgtaatgcagcttctaggacagaacatttgcatataatatgttctataccaggaatttgaaatggggactaaatgcaatttgtgaatgaagcaccttaatttgctaaactaggagctatgtcagattttaaaaaataaagttttgctgtcagttcaggctagtataagttattttctgtaactcaaatgataaaagcaaaagtttaaaacattctctggatcaaatctaattttgaattcctggcttacagagaaagcacttgtttatgtctggttgccatttacccagctccctgctctcccatctgtcagaatgctgacccagtttgggattagaatagggatttaccacacgcacaagtttatacatgcatgcacacatgtacatgtgaatttgtacgtatttcacttaacaaattggattttagcattgatcttctgctaaatggaattttaaaaaaattatctatgattactttgcttttagagttggatta

SEQ ID NO: 72656 - DNA, 1046 bp, Homo sapiens
aaaaaaaaaaaaaaaaaaaaggaactctgagggcctctcagtgggattctaatttctgatacatctttcttttcagggtcactcgcatactactattaggacttcattagagaagcttctttccagaaaagaaagaaaaagccatatgttggaataagttaagaaacattgttaggcttatgggaacaccataaatcatcctataaagcttatttgtagaaccttttacgtttttgaaatggttgacattttatctttgcagttgtctatagaaaagttttgggggtagggattggggaaaaaggattattgtccttgaattatctcctgtgatagaggtctcaggtcttgaaatcagccctttgacgttaatgaatctttatcattaattcttgggggtgggggcggtggtgtggtccttggattctttctaaatcatttctctccaacttggaaatatggttctcttctaacttttaccttttttaaaaaaagtgatgtcttttctggtagaagaaattttatttttgaaaaatgctcataaaaagaaagctacatactttgcagtatcctagtattttaattcattatcataagtaagcagtaattatataggttctattacagaaagtataactgctttattgtattaaatcttctagtcctgtgattggtaggttaatttttttccagctttgtagaagtaccattgtaacaatctccttagtttatggacttggccaaatgttgtattcacaggtaactgtttcttttgaactctgagcatctttctttatcccaggatttctgatatggatagccttgatgtggttaagggtaaatgcaacaaaatcaccttacttggcctttgcctttcgttttacgcttcatagttctccttttctgtcccaaagctaaacatggggtttaactctctcagattatatttagagagtcacttaggtgggattttctaagcacttttattttaactttcatgaaaaatttcaaacatacagaagtagagagaatattataataaaact

SEQ ID NO: 72657 - DNA, 1076 bp, Homo sapiens
gtactgaatgagagcaagtttctggatcttctaattcaggtaatttaatttaacaaagagctttaggactagttgtaatcacctagcaattactcataaaattgtttttaatttcatctatgttccttgagagccactgtgttgatgattctgttttggggatttatgtgcagtcagataattcatattttgtatttctgtacgaaatcaatggaacaagacaaaagtaaacttacagaaaattagtaaaaaattttcatatggtctcgtactagagaatataaagcaaataaaagatttttattggctaaaaactaaactttgctacctgtggagtacgtatgtaatgaataaatgatacacatacaaagtgttagaaagctcaaccaaagaagttagcatgttcttttggaaatgagaatgtcttcatgttccagtgacatttagtatctggaatgcagtagtagcccgatcttactttagaggttttaaagttagatttaccaataaatgtctgcaaaaggtattacatctggcttcctgagcaatttgactagttacccaagagttgtgattactatgacatgacgcagtacagctgtaaaaaataaagacaaatttaagtttagtcctggtatgtatacacagctttgctatattacaagaagggtattttctttgtgatgagtttagtgtaataaatcaaacacatatataacctataagtaataggttaaaaaagtataaatatattgaaacactgctcagatttcatagtcttttttttaacaaagcttttttggtacttagtaagcttcttctttgtgttattttttaatagtgaaataccagttgctggcatctattgagtgcccaggtgggcactgttttatgcttcacacatgtttactcagtaaaatttccctacaatgctattaggtaggtattattattatccccattttacagataaggaagctgaaacatggagattttaaagcagttttctggtaactggtggagccaggattcaaaccctggcattctgtttccagagcctatcatgtgacagtctg

SEQ ID NO: 72658 - DNA, 1644 bp, Homo sapiens
cctgttggccccttgtatgtaccctgtgtttgagttgtaatgaacccctgcttgtccataatctttcttttaactcctgtgcttctctctcatcctttgcagagccttcactttctgcttaaagtggaccttgacttctctttatcttgctccatttgcacctgaaacttgtcctcaactgcagtgctaattccttggtaatgttttataactttgtcaggcagctagacactgtaagtatagaacatgctgggaaatccaaattaaaaatgacagttggcacaaagctgacttctgggagggaccaaggaaaagtagccagagtggcaggatagctgcttccatcacggattgccagcaatgtaaagcgtagactccagaggaacagtgctaacttaaattaactatgcaggcatcagtacttctggttctgatggcccggggatttctaagtagtagtgagtctcagcattatttgttatacagtctactgctagatgaacaaggctaagtctacagagaaggtaaattatagaaattaggccccgtctctactaaaaatacaaaaaattagccgggcgcggtggtggggtcctgtagtcccagctactcgggaggctgacgcaggagaatggcgtgaacccgggaggcggagcttgcagtgagccgagatagcgccactgcagtctggcctgggcgaaagagcgagactccgtcttaaaaaaaaaaaaaaaaagaaattaggtaaaaggattggaatcttagctaattggtctgaaattcagagctaggccacagaattagttgctctttcataaatttcattacctgtactctagcaattgtaagtgtttttatgtgtttctcccactaaacagactatgtacttactctgagggcagagaggcctcatctttctaaactgctgtgtctagcacagtgcctactaaataaggaaaactcaatgaatgttgaattagcactgcaggtgtctgatagaacttagcacaatcatggaaatgttctttattgtgtcgtctagtaaggtagccacgtgctgggctacttgtgtctattgggcactttcttcatggctagtgtttgaggaagcgaatttttacttatgtttaattttaatgaaaatatctatgtgtatctagtggctactattattggacagtgcacttgtatggtttatataatactttcagtggactaaaaagatctttgactttttttgtttttttgtttgtttgtttttgacttgtattccaagtggtcccagactgctaagctttttgttttactttttgtgattttttagtttttttcttctcttaatgtcagcgttctttttttttctatcattaagtaagctgtcatcagcctttcttttaacttttctgattttagtcaactatcatatagaaagacatataatcaagcttgtagaattatctttttttttttttttttcttttgagacggagttttgctcttgttgcccaggctggagtacaatgacgcgatcttggctcaccgcaacctccgtctccctggttcaagcgattctcctgcctcagcctcccgaatagctgggattacaggcatgcactaccaccccggctaattttgtatttttag

SEQ ID NO: 72659 - DNA, 1050 bp, Homo sapiens
aatctacataaagcttgtagagtatcttgaggtcctgagtcaatctttggcttactatcttttgtcatttgggaattagctaaaattattattattattattattattattattgagacagagtcttgctggtgtgcagtggtgcaatttcagttccctgcaacctccgcctcctgggttcaagtgattctagtgcctcagcctccctagtagctgggattacaggcgcatatcaccacgcccggctaatttttgtatttttcatagagacgtggttttgccgtattggccaggctgttctcaaactcctggcctcaagtgatccgcctgcctcagcctcccaaaatgttgggattacaagcatgattacaaagtgttgggattacaggcatgattacaggcatgattacaaagtgttgggattataggcacctggcccgggaattagctaatattctttaagtattatttctattcaattgtcttctttccttatgggactacaattacgtgtatgttaggtcatgtcactgtttccattcttttttccccttctcgtaagcctagagattttctagcaacctatcttcatgttcacttgtattttcactgtccagtatccagttatttctaattattgagtttttaattttagtttttgtattttttatcctaaaatttacatagattcaaattcttatgttttcatctgttttcttgagtatattaactactgttgcaaaattcctgtctgatgaccgtcatacctagattgtctgtgagcctgtttctgttgttttgtttttgattatttgatcctttttccttgggtgcctggcaatgttttattaacattgtgatgaaaaattatagagaatctgaattatggttatgtttctccgtataggatttaatatcctctggtgagtagttagaaaaacattgattactttgattcgtaagtgactgataagacatgagcctgaattcagggcagtcaggaaattctgatagcctcactattggtggactactggtgtatagccctta

SEQ ID NO: 72660 - DNA, 1190 bp, Homo sapiens
aaaagaaaattttaataacattgacatcaggtagctgactttgaataaaaatgtttgcgtatttggtgatagaatgaaaaagtaatatgatttagtaagttagtaagtgacatgttcttctatatagatctcatctttgtaagataagtttttcaggtatgacttatgacagctcttaaaaccaagtgcaaaatacattgaacttcacaaaagaagaaactaagatttaaaaaaatggagatatatttaataataatgctcacctaatatgttaatagtaatagcatttttagtgattgaaagattaaaacaagttaatatttaaaatagttgatagttaaaatagtaaagtaaaaacaaaattttaatcttttaatttctgtttttagtatatgttttatactatgtgtatgtttataaatgaaaacacatatactataggtatgtgcctcaagtattttatatttgggatcttcagtcaaaaaaatgtaggagccactgcactagatgactaaagatttctgagcattttaacttcttgtgtttgatagttagaagttttctgtctcctgccttgttgagcagctgttttttcctgtgatcagtgtgcctacttattcctaaccatttacagttgctggttttaatttgctatgggtgtggaaaccatatttccaaagtttattaaaaataatatgtgtttaaaatgagcaaatggtgtctgagtaggattttaggagttacctcacagtaaagtgagtatcttttgtttcatggacttgatcatatctgttttggttgcttagaattctctttttaggagggctaattttctggctgttagttatgttttgcagagatgcagtttcttgatagtgaagaactgcttaggtgataaaaaaattacacataactttactttgagctcgtagaggagagagaactaatatttgttgtgtactttctagtaccaggcagatgcttggcattttacattatagcatttaatttaatccttacagtcaccctggataaatatggttggtatatagataaagaaactcttaatacccaccaggtgaagaccaccaggaatgcatctgtggtgaaacaagttaggttgactgttttgcagctaggaagagcgtatgccagatcctgccaagtgtcagtaaaagagaatgggaggg

SEQ ID NO: 72661 - DNA, 1012 bp, Homo sapiens
gatggtgctaatagttttcacaatatagaacattaaatatgttttaggagactgaagcatatacttagtaaatgtgctctttgattttctaagtcatcttattctgggagggaaaaatgaagagtgactgtagaattcatggtaacctggaaaccttgggtaataagtcattccgaaccagtaaattttctgaatacttggaggttgagtgttaagatagcccaatctaacaatgttggattaccattgcatttgcttaaatgaaatatactatgcataatttaacttatttttgatgacttagagctatgatttgaataatattgcttgcattcaatcagtgtttattgggtacctgtctgtgtaatatggtagtagtattaacaggcataagctacaactataataccctcggcacctaatatagattgtgaagctttatgccccttcactagatcagtaatttacaaaatgaggtgaagcaagtcaattttgagaagtaaatatgagaacttctgtttgtttattttgtcccccaaaagggaaaagaattgagcttttctattcatactatgtgaattggctgtgaggttctcctaggtccacctgcattcaggtggtcactgagagtgtggtttgctgagggaagatgtgtgaattctagaatgtagatgccagcaacagcaccatgagtttctcagagtttttccagtttttctgttatatagtccctttaaaaatactttttaaaagaagaatctatgatacttcttattgagatggggaacagaggtttgctgtcaaagcatttaagagttgtagaactcaaagattaatcacacatttttattacaaaagatgagtattctatatgctgttcttatccgtgatgacaagaggctaccaaaaataaaaatctagcggatgtgtttgggaaaaaatccccaagttgtcacttcaaggcaaaatcgacattttaaacagtaagtgagaaagtacctgcttttcaaaa

SEQ ID NO: 72662 - DNA, 1064 bp, Homo sapiens
gctcttgtttaatttcccattgaatgcaaaggaaacacagtgttctgtctctgggggtggccacataacagctttacagtctccttcctgagtcctaaaactcgtgcgttgtccttttagttttcgcttctcttctggtgtgcacacatgaaatagcctcctgcctggttaagtacggctggacaagctttcctccatactgctcttgaagttgccgggagcggtctctagacagagctgggaaatgctatttcccttgtttgatgagtgatctgtgggttcatcgcctcgagcaaagatttgctctctcgaaagcctccattttatatcatcaagcacagtgcaaaataggttaaccttaagtaccgtctattctctcacagacgttggaatgaaatagatgtgttattaaaacagtgccgctacttcctttaggtccagtgaagaaaagctggaatgtgcgtggcatcagtcacagattgagatgatttgggaaatactgtttccaagtcagagagagggtttggaggctgatgttaggatcagaggactgggaagtaggagcagggttttattaatatctgcaattataaaatataacagtttatctgtttgagactggatgttaaggccttgattctgtggtgctttgagatcctttgattaaaggtgatatgcaagggcaaagcaatattatgtaataaatatataatgccctgatgatgctatttcagagtgggtactaacgtacagcacaggtttgattgttctgagtatttttttatgtcttgttttctactgttcaactggttagaggttaagattttctctttgtgaaagtcttttaaacgttcgtttattacttaactttgcatttttgcttaagaagtctatcatttgctatgtgcctagaattctcaactttttgaaatataacatgacaaatactggttagaagttgtcgattaaatgcttcatgattattaaactcttaataccatgaattgacaattgattttagtttacattcatgacaacaatttaccgctccaaaccttgaagag

SEQ ID NO: 72663 - DNA, 2379 bp, Homo sapiens
gtaattaaaatgaatgattctgcttggaggtacagcatattttagctctgtgtgcatatcgtgcataagggaatttctctatgcagaattattttctcccaacaattctcatgatcacagcactcctggtagcaggtatcacttaactcctgggcagcagcttgtccaaagcaagggaaagggagctttcctttcctcgcaactgttgctatggggggcgtggcttcggagctgggtgaggaggcgttcggcggctccctcccccccccaccctcgtagactacacttcccgtgatgctcgagggaatggtctccgtggtgacgcacttggtgtccgcggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaggaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatggtaagtgacggataagttatgacactgatttaattgtggtttccaatcttatttaatcggaaagacggcaggcgtggggcgaagatttgctggggactgtcgaaaagccactgtgctgagcgatttggagaagttggagcttctggtttcccccttttaggaagtactgcttttaatatgggttctctcatttggtcgtgttttctaaagcattgaagatagtggagaagtagggaaatgtatcatggtagcttgaggggacaaaacatctccctcttcgctagaagcctccgaacactagtattttaacgtttctgaaaacgtcagggacagtgggcagagctgaggacgggtgtccctacgagagaataggtagggaaacgggaatcttgctttatgacacagacgagatcgtcattgcagtagggacgaacttgatatttttcaagaacagggatgcacatctcttcaagaaaaagtatgttagaatttgctgtgaggtttttgaaatgtctgaatacggatggcaacagaaatataaagatattttgggattttcagaaacgtaggctgaccctgtattggtacttacaatgaatattccagggctttttaatgccagatatttattaatagtagattccatattagacataaagctaaggaaacatagtattgagcctcgatcactgagtgttgagaacttgaaacaaaaagtactgttgtttattgacgcctttctttgttttgtttataaagggtaaggttgtgagtcggttgactaacagtaaccgtgtaaccttacagtgctggggctgggcttgtgtgagtgtgaagttacattttgcagtcctaaggacaaacataa

SEQ ID NO: 72664 - DNA, 1038 bp, Homo sapiens
gttctacgctgccgccctggcctggccacctcccctccactgtgtggctggcttttctctgccttctgctgcctgatgggatctcccactcacctccacgaggatctgagaggaaagggtgctgaggagaggagcgtggagtgggcaggctcttgatgccaagccaagaatctgcatggctcatttgaaacttcgcagtgccctttatctcttgttctcttttatgtataagctcgtctttctcccatacagttgtaaaccccaaagggtagggactgtattcggttccttatttatatcctgtaagacagtgactctcaaactcatcagaatcacctggggagttttaaaaacttgattcctccagaaaccataaagaccaaagatttaaaaatatcaccatattaaaacagaatgaagcaaaatccttctgtaaagctaaacaaacaaacaaactcatgaatcagtcagaagaaattataaacaaggggaaaacagtatttggaatatagatggaagacacactaatttctttaatttgcaacaaatgtctataaataagaaatatacaaacaactcaataaatgctgggccaggaatctgaactggcagaacatggaaaagaaataccagtgaccaagaaacatatgaagagctgctcatccttcctcagaaataaagagacgcaaatcagaacaatgccagaccacttttcatgaatctgattagcaaaaattataaagtttcatgatgcccattgctgatgagagtatggaagcagatgccagtgaatgcaaacttggtggattttggcacctgtgtgacaaggtggggcggtggttctcacacctgcatgagcttctgaatcacatgatgaacttttaaaaacatagattctctgcgcccccatcccatactgccataaggcacccgcgtgtaactaagggcacaatttgtgaagttcgaaatggtaatagagaccagactagtaaatttcaactaaaggaattttgtcaacatacatcaacatttttaaaa

SEQ ID NO: 72665 - DNA, 1131 bp, Homo sapiens
ctacatattctcactcataagtgggagttgaacaatgagaagacatggatacagggaggggaacatcacacactggggcctgttggggggtgggggactaggggaaggataacatgaggagaaatacctaatgtagatgatgggttgatgggtgcagcaaatgaccatggcacgtgtatacctatggaacaaacctgcacgttctgcacatgtatcctagaacttaaagtataatttaaaaaaaagaaaaataatgagatttccaagaaattttgcactttccttgggccattgaaatcaggcaacagatgaataaattaggcaagtgagaggcagtggctttacaggaaaaagatcagctataattaagcttagacatccgtgtgactatgacccagtgatttttattactaattggccagtaatttccgatgcgtggtagcttactacctaatgagttgattcgtctgttggacagaatctattgttagaaaattctttcttttgctgatctgaaatctatctcttttgttactggcccttgctttttttttttttttttttttttttggcttaatacctagtaggcctgttggttgtattgccccattagaatttacttcttcagcttaaatgtctctagtttccttggtcttcctccatatgacatgggttttgaaccctttatcatcttgattattcttccctgggtgtaatttatcagtatttctcttaaaatgcaagacccagagctagtaactgatcatgttttacttaatctgccagtgtgagaggttgcatagtaaaatgtaagaaacatttgcattttagggcaaactatatcattaattggctctgtaatatttggttagtcactttgagcctaattttcctcaaatagaagattatccaacactaatgaaagatgagtaacaaagctttcttgatatgggaaattttgatgttagtaaaaagaagctaaaatattttgctttcatgagaaaaaaagtatatcaaccttcatgctaaaaatcaaattcttgctaatgttgaccttagtcaactcatatgaaaatctaaggaaagaattctaagatcatttcagtgacattgcagttagtagtatttatg

SEQ ID NO: 72666 - DNA, 1867 bp, Homo sapiens
gcctggctaattttttctattttttagtagagatggggtttcaccgtgttagccaggatggtctcgatctcctgacctcgtgatccgcctgcctcggcctcccaaagtgctgggattacaagcatgagccaccacgccaggcctctttctttctttctttcttttttttttttttaaagagacagggttttgctctgtcacccaggctagagtgcagtggtgccatcacagctcactgcagcctcaaactcctgggctcaagcgatcttcccatctcagcttcccaagtagctagggggacaggttcacaccaccatgtccagcaaatttttaaattttttgtaaggactgagtcttgctatgttgcccagggtggtctcaaactcctggcttccagtgatcctcctgccttggcctctcaaagcactggtattacatgtgtgagccactgtgctggacctgaaataaagtattcatacttgcccttttccctttcatatttacatgttgttttgacccattttgcaaaactcttttgaaagactccttaaaaatacaaatgagtcagtaatctaataaaaaacattactatatttgctgtcttttgactatataatttgattatttaataagacagttaaaaacttgaattttaatttgcctacttaccgttttttaaatttaatgttttaattgatcagtaccttttagcatagttcttgctttgctgttctaattccaaattaattgtaacttttaaaaaagaattttttttttttttacaaataatacttataagcaatatatctttaaggaaataaaagcatcttcaatgatgtttaaacaaaattggcttttgttttataaggacttattatttaagctcgtgtttttcacctgttatactaaaacaacgtaacatcctttttagaaaacgttaagtaaaaaaaatacagaacactccaggagtttgtgtgcatctcgtgcagggaacatgctggtcttctctgtgttattccaattttagtgtatgtgctgccaatgcagacactccccacttagtgttaaaatttaaaatcttctaaaaattaaaagtacaaagtcaagtgtttctttgaagtttccattttatgtactaatgcctttcaagtgtttcttctaatttttccattagtcagaaattgatgttttcctaagttttgagggtaaatttgacttattttccaacttaaatgttaccaagttatattgattgagaacaatatacttgctccaactcaggctcaaatttttagttgttttcttctatccttcctattagccacaggcagggtattttattaatctattatggaaatgttttttatatattctgaattgtgtgtgttaaatagtgaccatttctactcagacatttctactatgtttctttccactgggttctgaaattacatttcttccactatagcatattctgtaattgcatgtattagctgttgaattttacctagctttttctttggatctgtaactccttcatatgttccttttaatatatcattcaatataaagatgagggaaaatttcttatactctgctttacagtgtgacgtgctttctggttaaaaaaaaaagaattgttaaaatgaatttataattgtaattttcttttcttttctttttttttttttttgacatggattcttgctctgttgcccaggctggagtgcaggagcgtgattgtagcctcgaactcctgggctcaagtgatccttctgcctcagcctcctgagtagctaggactatagactcgcactaggactacagactcatgctgtcatgcctggactaatttttttgtttcccc

SEQ ID NO: 72667 - DNA, 1017 bp, Homo sapiens
ttactacataatcctagttgataaagcagcagcagggtttggagaggattgactccaattgtgaaagaattgctactgtgggtaaaatgctatcaaacagtataattgcatgctatggagaaatttttcacaaaaggaagagtcaatacgtccaccaaactttgttgttattttaagaattgccctgggccaggcacattgggtcatgccagtaatcccaacactttgggaggccaaggcaggagtatcacttgaggctagaagttcaagaccagcctgggcaacatagcaagatgccaattctaaaaaaaaaaaaaaaaaaattttaattagtcacatgggcactgagaacgcgggtccacgcacgtgatcgtccgtgcatctagcctttgcccacacagcttgttcagtcatggcctcaggtaatgcgtgcatgggaaagcctgcccctaacttcaaggccacatccatggtggatggcgccttcaaagaggtgaagctgtcagactacaaagggaagtacgtggtcctctttttctaccctctggacttcacttttgtgtgccccacggagatcactgcagtcagcagccatgccgaggacttccgcaagctgggctgcgaagtgctgggcatcttggtggactctcagttcacccacctggcttggattaacatcccccggaaggagggaggcttgggccccctgaacatccccctgcttgctaatgtggcaatctgaggattacggtgagctgaaaacagatgagtgcattgcctactggggcctctttatcattgatggcaagggtgtcctttgccagatcactgttaatgatttgcctgtgggacgctcattggatgaggctctgcagctggtccagaccatccagtacacggacgagcacagggaagtttgtcctgctggctggaagcttggcagtgacacaattaagctcaacgtggatgacggcgaggaatatttctccaaacaaaattaggctggccaatggatag

SEQ ID NO: 72668 - DNA, 1057 bp, Homo sapiens
gacatatgcttcaacatggatgaatctttaagacattatgttaagtgaaataagtcagtcacataaggacaaatactatgtgactctagttatatgagtgtctagagacaacagcagaatggtggttaccagcgggtaggggaatggaaaatggagagttaatgtttaattggtcctaggcttagtacctgcatgacgaaataatctgtacaacaaacccctgtgacatgagtttgccggtgtaacaaacctgcacatgtacccctgaacctaaaataaaagttaaaaaaaaaaaaaaaagaaagaaagaaaagtgccctttgcggttccacacagaggcgccagccttgggctgagagaactcactggtttgatggttattggatcgctcattagagataaccaaagctattgttcctccctgatcttgcctctgtagttgagtcatcacccttagaggcagaagaaagcaaattatagcagggcttcttcagcattggggtggggaaagtattaaaacatgcatggtaaagatgtcaccttcttggtcgtggaaaagccctcctggggtaaatctgcatatatttgcatatatatatgcacgcatacatcctaacctgaagggaacatccagctcttctcacctacaaaaagatgaatccttctgatgtctcttttacagggtatgtggacaataaaaatttaactattaatgttgtagaaatctaagggaaaaaaatcgcaaaatgaacgtgccatttaaattttaaatttaaaaacgtcatttttagtgtaaattctttataggtagataagagcatatcttgaagactttttaggaagggagaaggggaaatagtaaaaggtaacgtcaatcctaaatctttatttgaaaaggagactggatctgtttttttctctaacatcaatcctaaatctttatttgaaaaggagactggatctgtttttttctctaacatcaatcctaaatctttatttgaaaaggagactggatctgtttttttctctaacatcaatcctaaatctttatttgaaa

SEQ ID NO: 72669 - DNA, 1024 bp, Homo sapiens
atattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttg

SEQ ID NO: 72670 - DNA, 1144 bp, Homo sapiens
caggctagacaaagtaatataggctatatttttcttagtcatatcctgaaacatttatgttcttttcctttagatactcaaaaaaccacagcatcactaagttaaattacaagtctgctgctctgtccagtaaattaataagattaaggaaatctataactcttatagttcagtaaattgaaatattaaatacttaattttcagctttagtcattctgaaaagtgtttatttctagatgtttcttaacctaattgcatgtttattgacaaattaccttttttttttaagaccacatttcctactaaggattaaggtctgacagtgtaaacctgtagagtgcttttttgcattcagaaggtggcagtgtctaccctttaatcaaagtctctacattctggttttaatagagttaggatgtggtacataattgcacctcaatgaggcataactttgcaaatattagactatgccatttcatgagttatagattgttataatgatcttgtatttttatgttcatttattgaagttctagttatttctggagttgctgtggatctacagatacgtgatattttggtataactagaatcttgatttctttcataaagttctgccatgttctatttctttccttaatgtttttttcttccctactgttttatcctccctttgctttggaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcaca

SEQ ID NO: 72671 - DNA, 2326 bp, Homo sapiens
gagccagcccccatttcgagcggggcttctccctgcgccgagcctgacaaaatgggggcggcggcggcgcgggcctgcagggcctgccgggcgcacgtggcggcctcgggcctgggagccgggccgcgtcctctctcctcggccgcgcggccaccggcgaagttctaggggcggggggctcgccccgcgcaggagtcaccccaactttcacggctccaaaaaatacttcccgagttgggggagggggccaccgagccacgagcaggagtggcttttgtccctcatccttgtttactcggagaaacttcagaccggacgtgtttagtcagaacagaaatacatctcagggccaaaccgataggaaacgaggctgcctcgcggtggcaccgccaccccccaaccgggttccgagcaccggagctggctgctgctccctctttggagcaaagttttatgcaaagagggtgttttttgaaactttcggtgcacggtgattttttttttttaaggtcccataattaggaagagtcgactcgcttaggcccttgtttattccctatctagtgcaaagccacgaattggcagcatgttttctgacctttggtttggttggtttaaaatggtgttctagattttaaaatcgtttaagtgaccagttagatactcattcagagcagactcgggcggatagatagggaatactgtatgggtatatctttgtgtctagactttttgagatcgccctgaaggactgtttttgttttgttttgtttgcttggcatagccccttcaaggaatttaatctctcggccatattcttgtctgattttacggaggttgatgtcgctactgtgttaaataaccagtactttggttttcattcccttactaagtactttaaggtcttatatgtcataattttattgctaacatcaaatatttattttattttttagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaaggtaagagggcttaaaacatgctaacaaggtaattaaaagacagtttccaattgaggatgcaaaaaaaagcctagttggcattctcgtagtgggacgctattacatagcaaaagacattggttttgaggataatttacttaaatgttacaacttaaacttacaaataattattttgtagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccgtgagtatcttgcctgtttttacttcccagacacgttttacagtagaatctgagagaaatttagcaagctactttgtcagtttagagtgtaaatgtacaatcaaagtttcttagctaatacttgttcatattggttatatttaaatagtataaaattcctgttgggtgggagtgttcccagagcatttgaattagacatttggtctcctttgcccagtgtatctccttttgatctttttatttcttgaaaaatactatccctttgaaatagtgtaattgtagaatgttcatctagggttctagctagtataaattaaatagttgtaaattaagctttggttgtgaaggatatttagtatattatagtatttgcaccctgtccaatgcatcacagaaattcacaggcagctttaaatagcaatgcagtgtacacttgatagtatttgtttttgtgatctgttaacttaaaatcctaaaattaattttttttttagttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggtaagaagtgtgggtttgcttggtaaaatgatgacaagtacgccagatgtatgattgtacttagtttgaggtgtaataagtttttagggtaacagctacattaagtatggtgttgatataagtcctcatccttcaaagaatgcagaggaccaaataaattagggtttttttgactaaaatgtaatcagactcagacaaaggctgtgtacattt

SEQ ID NO: 72672 - DNA, 1886 bp, Homo sapiens
gtcagcgtaatccctccgcagaaagccgcgcactagttttaatcacgccccaccccctggccgctggcgccacctccgccactcgggcgctttccagcagcttccagaaacgtcgcctccccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcaggtaagggagaagagggaggggtttctttccgctctcgaaattgggaaaagagacagagctgggatgacctatggggtagtcggcgcgctgaaaggatgggctgggctgggacggggttcaagtgggaaaggttgatgattaaggtatagagttggacttacagatccgtttgggcgcagagaggtgaacgctgaagagaaaccagagtttgttttcgttttccaaggagcgtggagatgggcagggttaacggaccctgcgcctccttcggcttcttagtttgggtgttgaaactcacctcctttggtcctgttcgtctctgattcaagacagttgggtttggtacctgacagggctgggtgcagaaagctgaccctgttcctcggcttccaggtcggttgtggcctcgcttttgacagttcacgtgccgagcctactcgctctcggagggcgagctcaaatgggtgggtttaaggccccctcttcgaacagctgtttccctgggtttctccattttgcacacaggagtgtgaattaagtttaattgaatactttttgcgattcccagggccaccttgacacgttcattgtgctatctaactgggttcatgctgggctaataattcacattaaggcttctggagtataagtggttcacagaagtatgaaaaggggatgttagaagaaagatgctgggggtgaagtagagttgaggaagacagaactggaaagctaggttggtttcacagtacaatgagctttaggtcataatactacctttaggttatattgggctgtttggacggagtttgctgtaatcaggctagagtaaatagagaattttaaactaagcattgacaggctcagacttgtagaggcatcattttgacagtgatatggaagggaaagaggtagagatttgagacctttccaaagaactgtccacagaatttggtgacttactgtgcgaagagggaaataaagaatagggaacaactcaagactttctagtctgtgtgtttggaaggatggagacgcccacatttaagtgagatatgggaaggaggagcagattgtttttgaagggaggaagagcagttacttagggtcaaattaagttgtaaaatcccccccgggattttgtatgtaagtcaaagtgaattgtatttggaagaagaactggggagcccacctctggtattttttttatgtccctcatatggacaaataaacctctggtattaaatgaattttcttttgggggattctatatattcgggatttcaaccaccaacctatctggtttttcccgctgaaatgttgggtgatggaatcaggagagcagatttggagactctttatattttataattgagagagacaaagagaaaaccgtttgattt

SEQ ID NO: 72673 - DNA, 2453 bp, Homo sapiens
ggatctagagggtaaaggtcagtgacgctgctaaacatcgtcagtgcatagaacagccttcacaaacaattatttggtcaaagatatttgtagtgctgcagttgagaaatttctgtcttatggttatttcttcaggaataggaaattaagattcgccgatactttctttaaaaagcagttttatttttgaaattattccttggcttgaaaggtttgtgaagtttatatagccgaaccagaatagcgtaattagattttaaagtgaattgtgagccatcgattcccaggagatgggtgtcatagaatcatggattcttggatttgggaaagacttatgcctagaattattttacaacatttctgctaagtggtaattctcctctgccctaaaggtctcctgtatttgattttcctatcattgtgaacccacaattaaaatgctcttaattattttttgcttacactgagctccggtctcttgtaatttttactctgttaaatgtggttctgcaccataggactgcactcaaaacaagcttgccacatatgtaatttgtactaggacagtgtttatatttttgttcagataacaaaataagttaaatgtggtgtaaattagatcatttacaaataataatttgttagcagcttttaataagtagtatttttcccaactggtgaagtattaatgttggtagttgaaaacaataggaatgtatggaatatatggttcactggttcttttgttcctgtcaaatagtggcacaatggatctggggtttttctcagtataatgctggcatatttgtttcaaattgtacatagactctaaaaagttaggctttcaaattctggtcaatatagtttgctttaaatagtagctgcctctactacaagttttatttaatttgttgacaaatgagtctgctatgaaaaccggtcctgttgccagtcactaccctctgttcacaaatttgctgggtttataaatataggtatcattttcacttcaagattataattttagaatatgtttattctaggacatatagccctcaaaatctgcttactatatacgtcttataaaatagcatggttcttttttatagtaaatagaatttttatttaattgtctattgactttttttttccagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaagttagtgaacttattttttgcctgagtgcaaagttttttttttttctctatttttgagacttaaattcaattttgatgttaccagttaacttctaaaaaattgtgtcttccacggaaatcttacagtaatggcgaaagattgttttaatgtgtttacctttctgtgttttattgatacatgaaagtggaaataaaacatagaccttatgatttactgttctttgaaaatatggtacataaattctcccgggtaattgatgttacttttttccttgcaaataaaattgatactattcttaacacataaaatttaatatttaaaactataacataattctttttggaataatagctgtatttaaaggcttatatgcatttcttttgtttgccatgtttaaaataccttgtcaggatacttgtaattgaaaattataattttttctggttacctttccatttaacttttaatattttgatatattctaggaatgtctatattttaatttgctttatttctcttttagaattttgattcagctaaagttccatcagatgagtattgccctgcttgtagagagaagggaaagttaaaagccttaaagacttaccgaattagttttcaagaatctatctttttgtgtgaggatctgcaggtaaagtattaatcttatatagtatatataagatttttcttttttcttttgcttttttattaattgttttaaaagtttactcattttttgttttttagactagatttttaatatgtaatctcagtttgtaagtctgtctggtatacaatgttatttttccacctacctttacttggttgcgtaaagatgttcgtttttattgccatttgatttgcgagaggagaaaatacatttcaaggtttttttctttttttttaaccttttggaggtccttgttagctattagcatatagtagttactctctcatctctttggtttatctttgcaactgatgggaaaagttatgaatttctaatgtacctggaagagtattttggaaattggttagtccaaaaccagtatatatactctgaactaaagagagtatagaatcttgtaaattctaaaagatccttttagaagctctaaatcgctttta

SEQ ID NO: 72674 - DNA, 1562 bp, Homo sapiens
acagaaattactctgtgcacttttaatttgaaaatacttttaaaatgtgtagtataatgtagtgtctgtcccaaaagagtaacattcattatagtgtttctttacgttgttgaaaattttaaattcacttaacattagatttttattaaagcaaaaatatgttttccttattagcttacccttttgtaactcagattaaacccttgattgttcaaattaacctgaaaaaaattattcttttggaggccaaacttttgattaagtagttgtttgtctctaattttttcaaatttatgtgtataaatataacctgtcatcaaatcaatgctaacattctatacatgtttttcatgatatgaaaactataaaacatgaagttatttgaatttgtgtagtttttatcattttatttttactttccagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaaggttggtactaatattttatttttatttacttatttattcatctggagtcagggtctcattctgtcacccaggctggagtgcagtggcatgatcatgtctccttgcagccttgacttccctggctcaggtgggcctcccacctcagtctcccaagtagctggaactacagtcgtgcaccaccatagccagctaagatagtgagatggtggccccactgtcttgcccaggctggactcgatttcctgggtgcaagcacccttcccgcctcagcctcccaaagtgctgggattacaggcatgagtcaccattccagcctacttgtctttaattcttaaaaatattaatgttgagttttgtctcccagcatgtgggaaagatgtcatccattgcttctgtttcctggaggcctgggagcaaggagcccaggaacagtatcacgaagcttgagataataccagttacattatcctgactgcccaaaaggcagtttttttgtttt

SEQ ID NO: 72675 - DNA, 1018 bp, Homo sapiens
ttccgcttaatattttcagaccacggttgagttcaggtaactgaaaccataggaagcaaaacacggatgaagagggaccacttcgtattgcctaatttagtttgttttgatcttctgggacctttttttcttgttgtaaaaatttatggggctgtttatagttgtggctcattgatttttcattgctacataatacttccattttgtaaatataacagaatattcatctacctgtcagtggacagtggggtttttttgccattataaatgctgctgctgtgaccatttggggggcaagtctcctggggcacagtatgagtttcccttctgtataacaaaggaatggaaaattatagactttcgtgtccaaatttacaagataatgacaattgttttccaaagtggttgtaccaagcaattctcccattaatagtgtatataagaggtcttcctgatccatatattcttcttggtttattttcacacttttgagatttttgctatttgagtggtataaaatggtctgtgatcttgatttgccgtttccacattttgaagaggttgtcggctctatgtgtatatattgctcatatttgttccctcttctgtgaaatgccttttgtatcttatccctatttgttctgttctgttgattgtcacgttttaattgatttgtatgagtttgttccttgtatcattgttgctagagttacatcagatgtgttgctgaatctgctcccagtttgcagcttgtgtttttactttttaaaaactgtcttgatttatagggaagtctttatcttttcatttggagctagtaatgtttgtggctttttaaagaaattattactattcccaaggtcagaaaatcattcacctatattttaactgaaaagttataaagttttgcttttgacattgaaatttctcattcagttggaattcatattgatgtgtggtatgaggtaaggatccatttttttcccatttgcatagccagtttttgtagctccacttt

SEQ ID NO: 72676 - DNA, 1052 bp, Homo sapiens
ttgtgaattaacaccaggacaaatatccatatatcttttgaattaattactgactagtttcctaggaaagatattagaatatgaatattaaaggtcttgctgaatacagttttcagaatggttgtaccaatatataattccattttcattatgtagaaaaaatacctcagtgttttctaaccacctttggttagaacattcaagacgttatggttttgttaggtaagaaatattttgtttcagtgtaggttttctttgagactgaacttttttgtgtgtgtcagtcatttacagttttttgcaatttttaaaattcagtttctcacaagcattttgcctttgacttttcttctatttctgctttctctaattacagaaaccccagtgttaagtaggtgacagttcagttgtttgctgcagaagagcagcagttcaatattggaattaactttaattttatgtttttaatctgttactaattttttacagaataattgtagtttttataatctggttaattatatgtttgagctgcattactttgcaatgtaagtttttttttttggcatggtcaaataacaaaaattctggttaatgcttatttcatattacaggagaatccagatatttcattagggaaacatataagcagagtgtgatcaggctgtatgaattatttataagagatgtgagtgaaaagatctatttgtagcttaagagtaagtagagtcagatgcatgtagagtcttttattcaaaataattttcttattaatcttggatagtttcttgtcacagtaattccattttgaagataataaatattaccataaagaagtgatcaaaaacatagatatgtgtgcccaaaggtatttatcacaatagtatttataatagtgaaaaaagaaacaactaaaatgtctggcaataggagaatgattaataaagcgatgtttcagctgaatatagtggcatgcgcctgtaagcccagctactcaggaggttgaggctgcaagatggcttgagcccaggagttaatgaccagcccaggca

SEQ ID NO: 72677 - DNA, 1608 bp, Homo sapiens
ccaggctagggggagaactggaccatggaagtgaggctctgtccagggtaggggaagggatggaaggtgactgttcctggccatgttccaggcaactgtagttccaggctagggggagaactggaccatggaagtgaggctctgtgcagggtaggggaagggatggaaggactcagtctcttgggccaaatcggtaaggcagcatctaagctcctctgagaataggaaggagagcaaccaattggaaaaagaatgggaaacatgtagattctcctgcttaccttactttccagtctcaaagctggaagccagcattcactgttcagttattttcaatgacaacaagattcaaatcttcagttgtaaagttgttaaaggaaaggattagactgaaaagttaagaagaacggtagatgaagagtccaaagagttgaggctggtcatttaaccattgtgtggccacgccctctccacaggtggaacaagatgatcagaatagaaatggccaattctgatgtgtttctacagtgtttcactgattacattttttaacatctgtagcaaaccatttccataatttttttttttttttttagagacgaggtctcgctctgtcacccaggctggtatgcagcggcatgatcatagctcactgcagcctcaaattcctgggctcaaatgagcctcctgccttagcctcctaagtagcttggactacaggtgtgtagcaccactctcagctaatttatttcattttattttttgtagagataatgcctcgctatattggccaggatggtctcaaacgttcatagaaactggttttaggttcctagaggctggcagcaattctcagaggtaacgcaagcagtcttcctgccttggcctcccagtgtgctgggattacaaggtgtgagccaccacacctcatcaatttttgttttaatatactctaaggcttatcatagttccgagatctttttttttttcctgagaaatctagaaagatggaagacagtatgggtcttttgtggattttttgtcctaagaaattttcataaatgtctgccaaggaaaaggaaagagatcaaagtggtaattaaatctttaggatggacatttttagaaaaatgctttataaacttcccctctcccaactctgagtgacttattgtgtcatactgtattaacacatattcatgctgtaaatatagtaagaaaagacaatagttcacaattttggtttagtttttgccattattgattatgagcagtaattcttccttttctttttgaaggtgatatggaaagccctgtgtttgcatttcccctgctcttaaaactagaaacccacattgaaaagctcttcctatattctttttcttgggactttgaatgttcgcagtgtggacaccaatatcaaaacaggttagtttcttttgttttttaaaatgggttcttctagtttctccaccactaaggttaagagaacaatttgagcaccagacactacagtttgcttgcttctttaaactggaagggtcaaaacctcatcgtttgatagactgctagtaggatatttcctaaggagttcttcagtgggaaata

SEQ ID NO: 72678 - DNA, 1052 bp, Homo sapiens
taatagtccccaaaactcccactagaacagggtgagaattaacgttttattcatacctaggacttaaataatttagtgtaagcaagtgagtatgagaacacatctgtttccagtcttctatcattgctttatataaattctctggttttctcctcacagtaactcagtgaggaagatcctagtgtcctcatttggcacgtatggatatgacagcttgaaaggggttagattgattcccaagatgacacactgtaagtggcagagtcaggagacacacttaggctcttctggcctctaagactttcttgctcactgtggtatactccttaatcactacctgggttttaaataatataaataaccttgctgattaaaatcagcttaattgtagcttctctggaatccatatcttagttgtttgacagttttcggttgagtgtcttctgtgtgttaggaactcaggcactggaaatagtgtatctttgccaaatttactaattaggtagagagataatacacgaacacataatagaggtccagtgacttcgtaattaatctgatctttgggctgcttaacgttagctttgaatgcaagatgttaaatgcgttttagagatatatagcacaaactgtgagagctcaagggagggaagccactagccgcttttgtttgcttttttgttttttaaaaataatcttactttgttctaaaaataaaagtagttatagagggaaagctaaaatgaagtgacgttttcttaaatatgttttaatatgtcataacttaaaacttatttccacttaatctgaaggagaactgtccagcaaattcctttgtttttgtgaagctgtttttagtgccagcataagggctttttactcaacttggaaagtgtaacccagagtcagttaaaaacatagtcttcagaggcagatctcaggtctgttatttatcactgtactctatgtgtcactttccccatctgtaaaatggggataagaatagcacctgcctctgagagttgtttggaagatgagtgtccagtgccatg

SEQ ID NO: 72679 - DNA, 1111 bp, Homo sapiens
attttttcccccttgggacatttggcaacatctacagacaactggatgccgttactggcatctggtgaggagaggccagggatgatgcttaacatcctacagtgcacaggacagtgcttcacagcaaagactctctggtgaaaaatgcagtgataccattgaggaaccctgtctttttttcttgcttcatctcatagttgaaagatatgggaaattaacatggagcatcttcacagagcttctttactagaggtagggaggaacattgccatattaacatgatttggggaaataagaaagtatgaatcacgaaaaaggggaggaatacttttagacattggtttaaattaatgtaaatgcatttaacgttaatgaatttgttatgtcatttttttataggcatatgaagagtctggtcacctttacaaatgtcatccctgagtggcacccacttaatgctgcccattttggtccatgtaacaattgcaacagtaaatcacaaataagaaaaatggtattagaaaagtgagttaaaattgtcttataatttttagtacaaaatgaaggtggatttacatttttcttaatgtgtaggattgaaaatggtgacaacaacttacctttctgaaatttgagttaacatatatttctgggttgccagctgcctcgctctatctggccagtgagcccactgtcacggtgaagccactgaaaagccaacttaggctgactctctggccccactctcctagtgtctttccttctttttgccttttttctccctttaaggatatcaagcttcagtttttctctcctctgccaagtgtatggagtttctagaattctgggatttccttaatcagatttcaagaactaagatgattcaaagataagccacaggctcatctctctgaatttccatcttctcctagatctcagcatgctaattcctcatcatcttgaaagctatctagtggccttgagcagatatattttcattgtattttgccagcttttctgtttgtcctcagttggggaggttggtcagcattaccttttccagtattaccagagaaccatctgtttaaactcacaggtcagttccatctca

SEQ ID NO: 72680 - DNA, 1009 bp, Homo sapiens
taactcagtactcggtgtttgcattgttattaatatacatgtgttattccctcttcagccaagcagtatatatagttaggtttcacttttacaattcttatttttccgggaattgttatttgccttgttttcatttgttttattatgtactgtgagtttttgccaaatactttaaagacttattaataaattttcaatactcagatgcttcacagttttttactctgttcctctcccctttttttcctggaactctttcctgccacctttcactctttgctgcagtctgcgctggttcctctctgggcctgcagcatagggtgctctttattatgtacacacttccagtcactatcgtagtttttagcccaaggcctcatccccacattctatcacatctgttgcccataaatatccagtcctttaggggttctctgggaaaaataagctcttctttgtcatcaacatatgcactccgtagtactcatgtcttcactttgcccgttctgctgggtaaggtgccacttctctgtttgctttctgtcctctaaatatttgacttcttatttgcttattttcctttctttgtccttttggactcatatcttttttgcccctcactattatttgatagcatttgtgtaggagggcgaagtgggaaggaagaggaggtgtctgtatctgtctgaagattacagaagtctgtaatctgtcttggctgccaggtgtcagttttgagatgtaaatgttgatgatgaggtgaggagaagagcagcagagcatggggtctgccatcctgccttggaccatggcctgctttaggctgcttggtgtatatgatttcatctagctgttcatacctgctttttcctgtgccccagcactgaacatagactcgtaccattgttttgtgtaatctgttaattggttgcactgcagcatatatattttttaactatacaaataagttgcttcccttaaagattcatgctctgatctggaaatggat

SEQ ID NO: 72681 - DNA, 1046 bp, Homo sapiens
gtaggtacttaaattttgaggacttaattattctctaataaagtgattgacaaggattaatgtataaattataccttgtcagtctgaacaatctgcagtttggacattgattcaaattcatttaggctgaataaattttgataaactaagtaagttttgacagctatttaaatattgggaaaggggatattcaacatttttcttacatcctgagagctttgttaaatttagttatttgagacccattgggttctattttctggttcagcatgttgctgtaatggtaaaatacaattttgaaattatagttgtcttgaagttaataataaattgaccaatatgttgtatttttttctctacttagttacaaattgaacttttcctaagtagaacttttaatttgacaggccccctttgcttcctgaggtaactgaaataggccaaattaatgcttttttgaatatcttaggtttgttgctttctttcacatgttacctaccccacttaacaaaagcaattaatctcagcacttgatgccaaagaaaattctaaaaggtctggattttttccttggattttacaaagtagctacaatgggacttttaagacaaagctgcattgctgcttacagagcaatttttgtttaatggtctgtgttagagtcatactgcatgatgacttccaactgtctgggataccattctgaaaagggtttagtgttacatacttcttagagagagttctccatttctaattaaggcacacatctggaggtgctcaagaaaaattagtgcagttagccttggaagtgttatgtgtgactagttcacttcagacatcttttgtataatcagacacatggcattaaatttatttaacttctcttgcttttctctcccacagagtatctcccatattcatgttgcactttgtagaaggcttaccacagaatgacttgcagcactatgcatttcattttgaaggctgtctttatcagataacttctgtaattcagtatcgagcaaataatcattttataacatgga

SEQ ID NO: 72682 - DNA, 1017 bp, Homo sapiens
agacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgttctcctttttggtttcattttgttcttgtgagagtatgaggatttcaaaatgttaaagatgaaaagtggcgtctagtttctgacagtttgtacagttggatgcattacatttttagatttgaagttttggttatgttagtgttatgagtgatctttgtggtggttttcttcccctgga

SEQ ID NO: 72683 - DNA, 1050 bp, Homo sapiens
atgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggttttgaggtctaggctctcttcacttgggtttgaaataagttcaatgactagtaatagctgagacacttctacccttcaaatgaagtaaatgggaaaatggagcattgttgagtccagggagctataatttaaaccccatatatctaaaaggggtaacatttttgtgtgtgtgaaattggtgtcattcgcactgcatctacagttttctttttccttctcttccagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagctgatagttgaggggttttgttaatggcttttgggggatttatctctatacccacaaacgactagtttgttttcctcaaact

SEQ ID NO: 72684 - DNA, 1048 bp, Homo sapiens
tctcttgctccctctttcaccatgtgacatgcctgctccccctttgccttctgctatgattgcaagcttcctgaggcctcaccagaagcagatgccagcaccacacttctcatacaggctgcagaactgtgagccaaataaacctcttttctctataaattacccagtctcaggtatttctttatagcaacacagagtgagctaacacagcatggcaagcaccagtgtctgcctgcacagtcttctggtgttcctcctatctctccagctgctcccctgtcaacccctttgcttagtcctcctctgcctctcctctaaatatcctcctgggccctcttctctatgagtgctctctgcttagaaaatctcacccgggctctagtcctgtggttttaaatggcatccacatgctggcaaccctccaaattgatagcctcagctctgacctctcctctgagctccatatctggacacctaactgtccatttgacatctcaacgttcatgtctcagaagcatctcaaacatgatatattccaaacagaaatttttatatttcccaaatcagcaactccccaagtgtttccagcttagaaaatggcatctccatctgcccagttgttcaggacagatgcccaggagtcagtcttgactcttaccttccctaatgacacaactccaccactttttttctgttcaatctgttatctagcatggtgctccaagggcccagccaacatcaggtgctcaataaatatttgttgaaaattgattgaatgtacttgtataatatgaaccttgacggaagggtggaaatgtggaagttagaaggagcatgaggttggcattctggtaaaggtgttcattctaagattaattgaaggcagtgtttacaatgcattctgggaggtataatgccattattcctcctcgattcaaatgtaatcccacccatatttgaacaagactttcatgggcactaaagcagtggtggagacagagtcttataatttacttggagcttctcagatgcactggcctccagaatg

SEQ ID NO: 72685 - DNA, 1929 bp, Homo sapiens
tcatgtaccagtccttgttctcaggattaaacaagtgtgcaaagtgtagtctctgcccttatggaactcatcttgtaatgggagggagaccaacagtaaacaagcctgtgtcatctatcagagatgttaagtgctatagggaaacaaagtaaggaaaaaggggttaggaaattctaggtcttgttgtatgtgaggctggaaggaaactgggaaaagtgttcttctggagtaatgttcaaacacagtgaaggtcaaggaaaagtgacccttttaagcactgtcagtttcaagctgtaaacttgaattctagctctttcctcactagttttcctgatcttgaagttacttaacctctttgaaccattgtcttccatgaagtggagattataatttctgtcttttaacactgttgtgaggattgaaggaatatatgtaagtacatagtcctaacacatcctggaagaatattaatactctattttggtcagaatgtaaactgtggtttggggcaagtgtaatgagaaaatgtaattattttatgtgtaattggagttggtagaaaaatagtgggttgagtatgtggagaagcagttgaaaatgaactggatggatctgagttaatctgataactagtttttgttttctttaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcat

SEQ ID NO: 72686 - DNA, 1053 bp, Homo sapiens
agacctggttttattttttggagagcaggaagatactcttctagaaaccacatttcattgtacagattgggcttctaagataaaatattttaagtcaatgagagccattttcaaggtctctgtgtaacaaggcagagaagccaaatcagagtgccttcctagataagattagctacctagtgtgagaatacctctttgttttgttgtgaaaaattctgaagtacgagtgccactaatattgtcatattttgtgttaaggatcatcaaaattttttgagactcctcacagaaactgaagactggctgtatgaagaaggagaggaccaagctaaacaagcatatgttgacaagttggaagaattaatggtaggtcgttttctcccccaaaaggtggtacttgtgttttaaactatagactttaaaataaaattatgataactattaatttattacattttattttagaaaattggcactccagttaaagttcggtttcaggaagctgaagaacggccaaaaatgtttgaagaactaggacagaggctgcagcattatgccaagatagcagctgacttcagaaataaggtgagtcagtctttttgtacatagggaggaagttaacctagattttaataagctaacacttaagctgggaatcatcatgaatagtcttaactttgaaattttggtatttgaggttagaggtagatttgaacttgagcttcctggaaagttgagtcaaatgagatactattgttcaataaattctacagaatgaccgtgttatttttgttcaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggtgagtgttactgtctcgtgtttactgctgggttcacttacggactcaagttgcaatcatttgaaccttcaacatagccatttttcctgtaaat

SEQ ID NO: 72687 - DNA, 1264 bp, Homo sapiens
aaaaaaatctttctgcttgatataacatgattggctgagttcttgtgaaaaaattggatggcaataaatcataacagagcacagtacagttggaatttcacggcacactaaatatttctattagaatacattgtatttttttagtagtctgaaattctagaataatatgtgaaataattgagatttggtttttccatactgaggtgggaacatcgtatttaggagtttatttaacaataaactgtagtccatttatttatctttgatttaaaaatgtggcagagtggtgtgactgttatacattggccagtattaatctgaatatggataaccatttgtatacaagaaaacaaaattacatttaagcagtagcttgattttttttttttttttttagcattaaatatgaagtctgtgtaatcggttacaatgttaaaaaaatcaaacttcagcctgagtatttagaaaatggaaatgtctgtttggtttgtaggaagagtttgacaaggtataagttggaactgtgttaacactaaaatttgttttgtatcattttttttaaaccccagagtctacatatttagaatttagcttgagttaactagaagactggaattaacctttcctgtttcctgacagggtaagatgataatgcaagataaattggaaaaagaaaggaatgatgctaaaaatgcagttgaggaatatgtgtatgagttcagagacaagctgtgtggaccatatgaaaaatttatatgtgagcaggtatgtcttagagctctgtttttgttcagatagtctcatatgaagtgtttaatatcaaaattgacagttgaggcttaagcttttactcaattatgtaacttaaactttttagaaacagaaaacaaagttatggagaaaggcttgttgctgatgagcagttttattttgtactagcctacccccaaaactcttcatttttaccatctagaagagagaacctatcaaatatttatgtagagtctatggcattactgtcatagggtctaggataaatacgagaaaaatcttcgcttttaaaaacgtcaaatgcggtgacactgctgccttggtagcgttcctgtcattgtttcatctcataagatgtgttcatccagtaattccagagcttactaagccccgttattccccttatcccttttcttgactcccagttagtatggctgtgagtaaatcccagaagcacaactgtgaaagataggacttggaaaaaaagaaactg

SEQ ID NO: 72688 - DNA, 1054 bp, Homo sapiens
tcaaactcttgggctcaagtgacccaccacggcctcccaaagtgctgggattacagacatgaaccacccacctggcctcctctacagagatttagacttaattctaaataaattgtgattttgtgatttttgttgttgttgttctaggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgtaagtttgtggataaacctttgtgtttgaatagagttgacttagttctaagctataggagaattgggtagggaagggttaaaatgaatgttttccttcatgaataattttgatcagaattttaggtaatgataatagcgcttgccggttagtggtaatacacagcttgaaatttggtgaattgtgactaaattctgtgtaacttaatttgaagtaactagtatatgacagagtagatgatgttttattgagttgggagttttttggttttttgaagacatagaccacacattgagaagtcgaatgttgactgacgtttaagaaacttaaaaaacagactgctacaaaaactgtttgaaatagctaccaaatattaaagttttttaaattgtatggcaaaattggctttgatattttagaacttgtttttatttttacatggttttctgtatggtgggaggaaggaagagaagtgtctgtgtagcgtatagtaagagttgttattcatcattagcatgagtgctagttctgtgtggtcaacagaagaattttaggaagctaaagtattacaataattacagtttatttctagggaataactagaaatagcttaagagggaggcagtgtggtgttttagttaagatgtgagaaagtgcgttatctagtgatcactgttacctttctagaacatctaagcaac

SEQ ID NO: 72689 - DNA, 1046 bp, Homo sapiens
actaactttttctctagattaagtgtaatttgcagtctgttacttctaatttaaaacctgagtcagcgaccattgtgaatctacttctcaagtgtacctttgtgttatcttttctaaagataagttttttttggtacatattttggggggacacttgacaccatccatctacttttacccatagtaactctctttcccagaccataggtgaaatttgccaatattgctaggtcttttcaggacgtacccttgcctcacaccttttcataaataaattgtttgaaggagtccaacctgatcagttgtgttttctttcttactactttaaaggctaaaatgttctgacccagagttgtggtgtattgttaaaaacagttttcatgaatttatttttaggaaaagaaatcattgcatgtagacttgtaagattttgataaattggaatctgtgcattaactcgttactgtgtggaagataaaatcccagctctttggcatggcatctaatttttcatgtttgattgaaactgaaaacgtcgtacatgcttgagccatcttacatcccactttccagagtaaatgctgtttctttagatagatggatcttttggcaaatatttcctgaactactgatttgacaattaatcaaggtgtattccttcatctttcagtgacattgtaattaaatctatagttctgtgtgtttatatagacagcactttaaatactaggcagttaaattccatttagagctttgcacataataggttcaaaatacttatttttgactcagtggtctctggagtaacagtacttacttgtggctataacttacacctagcacttggttctgtagtaagtgctcactgtacttaatcctcagaggtatagaaaggtaacttttgtaacaggtcacacagccaggattcaagcccagacagtctggattaaagtctacacttttaaccattagtaatgttctggaaccccactgtattgtacataataatttcaggctttcatacagattttggctcacctccctta

SEQ ID NO: 72690 - DNA, 1025 bp, Homo sapiens
ctttgtatacttataaaaggaagaatatgtagatactaaatattaataataatccattgtattatccatcctgttctatggggtttttgtttttgcttttttcttcataatggaatatgcctccttaattaactgattccttcaaatgatggaagtttatattttcttcagaagtagagctaattttggcctctcttttgaaggatcctatagtaaatgatgaattgacttttttggtctatttagcttaatcatctatttagttatttttatatgtcctgtctaaatagggaattgtccacctatctgttgggtgttgcctttcccaaatttgaatttaccattgcttgcttcatttacaaaattacttaaaaatatgaacattatggccctttggggggtttctcagacatttggaaagcagtgtagacagaactgttcatgtatgtatgtattatacatattcaaaagtgatacaatttgaaattgctatcagcaaggcatttctagaaagaccaggcttttttcctaatcccctgtgaaacctgttattgattaattgtcgttatcctaagatatattatttgtctttgtacctagtaattggcatagtatttagatggtaaaataaattctttgtttagatgaaatatactggaaacaattctggaatgtgagttgttttttttttttttttttgaaaaccctgtccatccattggaattgagttttatattaaaagatgactgggaagtgttcatgtgctcatgatttttttttttttttttaagtgtgcaatactttccccggcatttaaagttagagaattttccgtcacagatgcagttccttttccaatatctctgatctggaaccatgattcagaagatactgaagggtatgtagcagaaaataacattcagatactataatgtaaagaagaaaaattaacaaatgacttctctagtagagtcattaacaaatgacttctctagtagtcattaatttacctggaatctttgaac

SEQ ID NO: 72691 - DNA, 2067 bp, Homo sapiens
cattcagcttttcaagtgtctgcttgtgcttttaacaagggaaaattgaaggtaaagtcatacattggaactcagtgtccaaaacacgttaagtgttgtgactttaagctactgagcctctttactaggctttttcttcttggtaatgaagagttttattttaggtaaagatgttaacaggaaacggttgctaaggttgagctccataaagatgatgtaattgtcttagcatactcttaagtgttcttgtttaggaaagaaaaggctttttacagttattttctatgtagtcatttaaaagtcaaaaatatcttagagatttattcctgactgatttggatttcatgttataatttaaatatagtcttgagtctcttagtctttcattgtttgagtagtaatatttaagattctagttacaaatgtgattgaaaataaccagactatttgttgtttcaaccaaattaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtgtgtcttgaattctacagattaaatagatggaacttcttttgaaactgtagcccaggtgtcagttctagtgggtgttgtgagtcttggcctacatttcagaattgtgtgttacatgcctgtggctggagatgctgttgtttatcaccactagctctaggggcacttatgtgaagagggcttttaaaaatacctttgctaagtactctcatgggtctaagtactaccctcaagtcttcgtggtattttcactttttagtatttctgggccagtaattgaaaactcgtttcacagagatactgtgcagggactggaaataaccattgaaagtaatggaatcagatcaaaacatttagaagggctgcatggtggtacatgcctatggtcacaacttttcaggaggctgaggtgggaggatcccttgagcccaggaatttgaggctccagtgagctatgattgtgccactgcactcagcaagactctgtgtcagggggaaaaattttagaaggtaaaatggcagtcataagcatgtaaaatgatttgtttgagtaataccaggagaactgtcttccgcatcatctttctgcacctgtttggtgtatttatcaaaaacaaaagagctataaactacaatacagctaaacttggcccatgtgggatccaaggtgtctgagggggaaaataatgaaattcattgggttgtcaaaagtaggacaggatattggtcttaacttttctaaaaacaagtttttatttgctaaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacaggtactttctcaactctgcttttgcttggtgtacagtctttaaacagtttccactggatgtcgtcatggtgggataataaacagagacctgtgtctaggtagcagaaggacattttaaacaaacccgtaaagctgtagggagataaggctactcaaatctaaaagatccagtaaatttcaattgaaagaactaccaagctggtgtttctcaagctggaaatcaaaaacaggcatgattctgaggatatcacagaaaacacagctgaaacactaattagctgtgtagtagtggcagttgttacttaaaaagcacacagggaattacagtggtaatctgatataataaggaattgatttagggg

SEQ ID NO: 72692 - DNA, 1442 bp, Homo sapiens
tttaaacaaaattataatttggctatagtgctactagatctattcattcattgggtataaaacctcacaagtttagcagggaaaaaaaggaatgaaacagtgataaaattctagtgtgtttgttcagagctttagtgatagttttcactgtctttgagtttatcttgcagattttgaaatctttaaagtctgtcgtcacactattttgcctcttgttccctcttgctgcttactttctggcattttctataggagaaggaaaaagtataaataaaatctgttcatagatgggaaattcagtgaaattggtgggcctcagggcaacttatgtgcactcataggattggtttgagttgtaaagtgaataaataaaattactaaaattactggtaggtggtgaaattaaagaaaaaaattaaaatctcaaacttctttttgcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatataattgagcaaccttagaaaaataccaacttattaatacttaaaaatacgaacttatttgagttattacttaaatttcttaattacaccaggtggtctttttgttctttttttattcagctccttttaaagtatagtagatagacgctaaattgtctttgaatattattcaaatggtaatatatatgctataacttaatttgtgtttcttctgactttttggcaattgtaaaatttaggtttatttgatgttggaaaaaaaatcgacattgtgttcatgtatcaaacaaaagtctgttctgagacagcccagttgcagttgtttggagagcaatagtgtagtaacaccaggaatctttttttaaacttgcagaggtattcctgtcttgtgatcaacacacaataatatttatcctagtgattcatctcttcagttagagtggaaatttactaccttctttaatgttttgacttagattttgggtggggtatatctgccctagctttcttccgctcctcttcatctttaggtagaagttctttcttcctttttctttttttctcttttcctttctctcccccttccctccttccccttccctttttcctccttttcttccttcttcccaaaacaactacaacaataaaataaagattttgtggaagggaatgtgtgctaatttttggaagttaaatattggcatgtagcttaaagtactacaatgtttaaaacattttttcccttcaatataggtaatgtacatgggtgaagaacatctatttagtgtggagcagataacagccatgttgttgactaagctgaaggaaactgctgaaaacagcctcaagaaacca

SEQ ID NO: 72693 - DNA, 1386 bp, Homo sapiens
ggtatggccctgaaaaatgtgaactgagggcagtattggagttccccttaatatgtttgttaaactataattgtggtggattctattgtatcagctactaattgttatttagtacaattaatttgattctcccctaggaaaatgagtagatccattctgcaagtgtatggttattcagagcttacagtgatgctctgattttgacggtttcttgtctagcttctgcttggacacttctctggcttttaggatgctattttatttaacacttgctcagataatatagtttgaggatgtttctattatagcaaatttaaacttaagggtggtacttaatgccctcagtattttcccgttttgctcatctcgtttaccattactcatacctaagcaggtaggagtaactcacccaaaattagattatatttgaattagtaatccagaattagataactcctctaatccaaaacctaattcacttaccttcttctcacaagactttttaagctagtctctgctctgttattgtgcggttccatttccatggtggctgagaaggttgtttcacagttgtaagtcactttccatctcttcaaaacagatttgatgtaactgattagtcactcctttccctcgacatttatattctgttttgccatggtacttgttgtgcatcatttttttctttctccggcagaatctcccagatgggaacctctttgtgctctttaaacttcagaggtgtaacttgggttcatttgcttgcgtttgcataaaaacttttgattcctaaagaagccggtggtatatcagaacaaaagtcggtatgacaatgacatttagatttgtacagagttggtgactgaaaggtagagtcacatcctattttttgttagtcgtgtgtagggtcaaattaataataccgttaacatatttaaaacattttcaaagttaatgttcggttcataataactggaacctggagaattcctgagccacgagcagaggtttttggggtagtagaactgccacctaggttggatctcagagcagcaattaagtggaagccccctttgagtatctgatgaaagctatagaccttaaaattgtgctatgcttgttccctatcccctaatgggtaggacatttatgttagtatttttctcttatcagtttaaaatatcaacctttatgctttttaattttttggaatatatttttttctaggtcagtcatatcatttggatcaaaaaatagaacaatcggagttgcagccaaaaatcaggtatgttctttaagagaattcggatcactttttaaggggggagtttttaaaaggaaaatctcaagagacatataagagggtaaagtgtgcctaagtttatg

SEQ ID NO: 72694 - DNA, 1008 bp, Homo sapiens
ggaccggctgcccattgggtagaatctttccagaaggctcgagaagaaggaagcggaagtggcacgtggaggggccggtggaggcgccggtgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtaagtgggagtctgcgagggtggatgggaggaggttctgggcccttagtgtggggacccaagatcgcgggctggctgtacggatcaccgcggcaaacggaggcgtttgggcagcggcgcacccctccgtggaactagggaccagcgacccggccagaggagggatggggggcttgccatcacaaattggagaagggattgtctcagggattcacgggggtgagaggagtcccagagtcgagactctaagggtcgtcaccttgtgcgggcttcctattgggggttttcaaaacctactgggggtcgggctgcggcaaagcccgcaacttcgctcccttttcttggcaggctgcagcctgcgccttccgcggccgcccccgtatccccacccggcctctctgagctggctgagc

SEQ ID NO: 72695 - DNA, 1040 bp, Homo sapiens
tgctcaggcacactggccccctaccccacatcaaggtgttcctttattcccctgcctagaaaattcttcctcaggctcctggctaggccagttcctcatccttcaaggctctattgaattcttcaccatctgtagagaaggtttctgaatgcccacccagtaagcacattacccttccccaaagtacacccagttcttgtccagttaaggagaagctggtgccagcccgaatgcggagggtggtcactgtttggcttaggccaatcagcacatcctattccccttggccacagtcgttggttccaggatggtcaggtgacctaggcagcccaatcagggtgactttcagggctatggtttagaatgcctgggtatgagggtatttctctgcccctttccatccctttccttccactccctccatcttcttcttcctccaggcgctgttgtgtgaggttatgaggcccagaaccattacaacaaccttactatcatcctgaaaaggaaatgacacatggaagtggatagaactaagaaaattaagttggagcctagggctgaagtcagtcttgagacccaccctacctctagatttaagttatgccagccatacatttcctcaccacttaagccaacttgaattggggtttctgttacttgctacccaaagcaagtaacctcctcaggaaggtctttcatgaccatattacctaaagcacctcctggttcactctctgttgttatccactgatttccttcacaacatgtaccacactctatactacaacatatagctgcagtgatcttggggtgtgtgtgtgtgtgtgtgtgtgtgtgtgtgttaggtacttcccttctttgattgtctgacccagagggcagtgattgtttttcttctttatagtgcattatagatgctcaatcaatatttgttgaatagttgaatgaaaaaacaaacttattgggaaatgcttttctctaatgcagagtttctcagccttggcactgttgacattttgggctggatagtcatcgtgtgg

SEQ ID NO: 72696 - DNA, 2391 bp, Homo sapiens
tatttaagctctctgaataaggattaatttgctgcatttgtgtacttctggcatttctataggcgctcagtaagtgtgggaaaagagcaagattagttggtaattgtttacatgcatgattaattaggcagcagtgtaattaaaaatattagggcacctccggcagagaaggctgtagttggtcttggggagcgactgaatttggctggaatcggcttcagtggaagaagggcattgctgggtggcagccctgggagaaagggaggttggaggtttgggaaagcgactgggtgactcctggctgcatcagttggcttgttgcctggatgttttgcaactaaccaaatgggtgggtggtagctgaaattggtattctatttatagcactgcactttataatgctgtactgggggtataatatttgtatataatatatacaacatatgggctgaaatgcacatttgtattgctgtgtctattttttattacccccaggggaatatttgcactgtccaaatttgataatacactgaaggacattcagaatgcactaagatgtcaacacatttttagagatgtctattagccttgtgaagttgtcagataagcacaataaataagacataaaatgcattaaaaggtccctgtgagacatttggcctttgggaactggctttcatgggttggcacagacgggaggctgtattcttcgaggtctgaagtgaatcatgaataccttttatggagctctgcttcgatttaggggaagggcaccgacacgtataaagatgtccccacttacgatgttcttggaatcttgctgaaacagaatgtgacaggcgttctgtcacatgtgaacaatcttgatagtttataaataccttaaatattcccatataagattggcctgactatatagtttagtttccccacaaactagagcatatttgtttatatttttagagaaaagtcaatatagaaaatttcttttaaacccacatgcatatacagacacggttcactgcaactttggttctaaagtctggcaccagtttcagaatgagaagattgagtcaggcctccaggttaccatttgttagctgtgtggcttttagtggctttgagcttcagttttctcatatgaacagggcgaatggactggatagaatactagcactttgccacctcttacagttttaacatactgatcccgttgtagcagagattgacagccacctgcgaagtaaccctttagcccttgttttcctaacaaaactaatataatctgggttggggggaaggatggtggggtggtggtggcagcggtggcagcagcactgtgagacatttctcagtggcctttgcatataggggcagctagtgctctacagagatatctttagagattgtttggtggggctcctggtaaagctcattcaaggtggctgactcagctgggatgcaggcctttttgctctgtgttatcctccttcccattgcctattaagtggatctgagggatggagccatggtggccatcttgtgaccatgaggtgaccttgaagatggaagccagtagtaaggatggtagaagagaaagatagaagaagcctggatgccagatggatgtggagcatcatgtcagctctgcatttcctgtttgcagacttgtattgcatgagattatatgcagccaaacctaatcctattgccaaacctaatcctaattgatagaagaagcttattcgaaccaatgatattgataaaataataggtattagcttttatttttcacatgcctgtctgtcacttccctgtgtgagccaactttgtatttcttagcacctgccaaaattggggatggtttttcattctgagccaggtcttgcccagattcctttcattgcaatgagtcagaaattttaggacaccaagagtcagacctaattccaggttgttttgtgttttttgattcttaaaaccttctctttatttcttaagcagtatgcagatattactggcacagattttaatcttctggatggattctttgtcatccaggtagtccaggacctccgagttggcatggctccccaggtcatggacttgacccaggggagtttgccagtagccaacagctaagccagtgggagggagggagagcatctgtttcaaatagcagtgtgaattcgaaggaggtgctttgacccctttggtaacttcctgcgggacaaacattgtgggctcggtatttgagcacttccttataattggctcttttggagccaggtttttttggtgtgttttactagactcattatgaagcaagcaagcaagcataatttttaggcataaaggtactacttagagaaaatttgcaaatgttctgtt

SEQ ID NO: 72697 - DNA, 1020 bp, Homo sapiens
acatagtgaaaccctgtctctactaaaaatgcaaaaaaaaaaaaaaaaaaaggtagccgggcatggtggcgggtgcttgtaatcccagctactcgagaggctgaggcaggagaatcggaggttgcagtgagccaagatcatgccattgcactccagcccgggcgacagtgcgagactccatctcagaaaacaaaaaaaaacaaaagatgatcggtggttgttttgccttaaagtaaggagttgttctggagagagcaaagtgtggcattgaggcctactcctcagtcaggtcttttgtgtacttgggaaaggaactggaaacaccagaactaaaactatgaagtctgtctcaggctccaggatcatttggcaaatttttaaatgctgctgaggagaccatagtccgtggagcatgagtatcaaaagttagagccgtgagttgttaaagcaaaggtttttgggcaatatacaaataagtttctaaaggcttagagcgtctcagattgtgtgtaccatggattgagtggtactgaaaggggtacttactttatctgtatgtctgtttatccatctacctacccatctgcacactaagggggtacttttaaagacctacttcttgtaattaataagatgcccaaaagttaatcataaattatatttttataagttaagcctgacagttaactgttccatagtacacttgcaatttaaaggaatcgcgtaaactgctaattttttttttttgtttgaatgtttgctgtgttcctctttgatgtgttctgtagtaggctgtgtgaccagggatttttctgacccttcctatgacttaggctatggaacatgctagtgagggtggggttttaaatctcacccccaagactgttttgagttgcaattttctggtttgcatatcctgagtgacggtttttaaacaagatgcaaatcaaagtatgaaatgatcttttccctcttgaatatatatagttattttctatttttctctttttttttcactat

SEQ ID NO: 72698 - DNA, 1024 bp, Homo sapiens
ttaaatgtgttgcaattaattactcgccagttttcttgcactccggggcttaggctggcctataaatcttagtcccaggttagttgtaaaatcttgatttatctctctgtctagatgtgctaacacatttgttggcttgaattatttaaagttatcatgaaaaaggtctgatttctattgcctgccctgatttgcactttaaatatagttccctgttgcagtttaccagaattcatgttgaaaatggaaaaggggaaattacttttaaacagcagtttggcatgtaaaagcatgatttaccctggaatatttctccaactgcacattaaagcactaaggccaaattttcaacaatattttccctactgaatctggaaattaatatgaagcaaacagcaaacattgagcctcaggtagccactcctgtgtacccctttggttggggccaggttggagggatctttccctcactccttcttttctttgtcagtcaccagcccagactcaaattgcagtatgcactcgttagcattgttgaaggtgacaggcaatttcttacctcccttgctaatttttctcactttgctcatctctttgcaccatctctctttcatttccatgaaaccaggatttttatggataagaattctgtaaatggttagttattttaatattggatttattagtggtatagcatattcagtgccttcacaatatatttggttcctttttatttttatttttatttttttaagaggcagggtctctgtcacccaggctggagtgaagtggcatgatcatagtttactgcagcctggaacttttggatacaaggagtcctcccacctcagcctcccaagtagctgggactacaggtgtgcactagcaagcctggctaagcattaattttttctttttctttttttggagagatggggtcccaccatcttgcccttttgacctcaagcgatcctcctgcctcagcctcccgaagtgctagaattacaggcacgtgccaccacgt

SEQ ID NO: 72699 - DNA, 1064 bp, Homo sapiens
gccacgtttggttccttgatgatttcttttgatttatttagattacacaaatttaaagataaaaccaactggcagccgggcatggtggttcatgcctgtaatctcagcactttgggaggccgaggtgggtggatcacctgaggtcaggagtttgagactagcctggccaacatggcaaaaccccatctctactaaaaatacaaaaattagctgggcatggtggcacgtgcctgtaaccccagctactcggaggctaaggtaggagagaatcgcttgaacctgggaggtggaggttgcgttgagttgagatagtgccactgcactccactctgggcaacagagtgagacctgtctcaaaacaaaacaaaaaacaactggaattttttctaaggattatcttgttttatgatttgctcctacaactgaaagtaactctgatgcattttttatgtcattgttttaaatattataatttgtatctatcatgggaaaaaggtattttaaatttcacagcagagtgataagaaatgacagacttttttggtttgggtttttttttttttaaagggatattttaactctaggtctatatttttggacagagctagaatctagtttaacttagctcagttaagctttgtctggctaaaggaatggtgtgttgattacgacaagcagaatttatggaatttatttgacatattggcaatatctttcctgtatgtaattcctactttaaacagttacatcatcaaatattagctacttactcacaaaaggtgatacattagtaattttcagaaccagtaccaaataaagataccttccctgcactatattctacattctaagggctagggacttttgtgttcacatgcactttgttgtcatatagctgtctggcctcgcaaaaaagtgaggtaaaagcaaacactgttattagatgatgctactggacctgttacattaagaaagttatcttatttgattaaagaggaaattgtaaccccagagatatttgactgtcctgtttgaaatttggaattaattcgggaggggtagat

SEQ ID NO: 72700 - DNA, 1413 bp, Homo sapiens
tgcaagttctcagaatattctattttctggaattctgtggtgctaagatatgttaacatgttgcaacctctctgtatgatattccttaagtaattctgtttttgatatcttcttcagggttttaaatgtgcatattagcttagaggtaaataaaataaagccaaaaaattaagtacccagaagcagaatttaaatgactttgcagtttaatctctcctttcttcttagaacttgaagaaatgattgggctttgtgtgtgtgtgtgtgtgcacgcgtgcgcgtgtgtgtgtatgtgtgtgtaaagtgagaaaatgcattagatcctggtgaaaataaaggtgaggggcactaaacgtctttgttctactgggtaggcgctgcctggtatagagagcaggtggtccttttgtgatgtgactctagggtcccccatagtgaagactttcactcattcatttattaagtaaatatttattgagtttcttctatgtgctagctgtgcttttggtgtggagacaaatggtagataaaactgtattcctggtggggtggtggctcaggcctgtaatcctagcactttggggtgctgagttgggcggcttgcctgagcccaggaatttgaggccagcctgagtaacatgttgaaaccttgtctccacaaaaaacacaaaaattagctgggcatggtggcacatgcctgtagtcccagctactcgggaggctgaggtgggaggatcatgagcccaggaatgaaggttgcagtgagctgagattgtgccattgcagtctagcctgggcaacagagtgagaccccatctcaaaaaacaaaaacaaaacaacacccccccaccccaccccccccccccgccaaaactcactataactgtattcctgcccttgtggagcttataatcagctgacatgtaagataagtgataaacaaatatatatgtcagttggtgataagtgctctggagaagagtaaagcagagtgaggtggataaggagggtgtggaattggggatttattattttacatgaggtggtcttggggaggccttgtataatgtctactgttatctaaattgttcacatagaggttcacatggcttacatttcagtttcaccctgccttttgaaatgtcattctggaaatggaaacgatgaaaccatgttagtcatttgcttcttagtgtgaagatgttttagatttctttcttttgagcaaatgttaatgcaggatttgaggcaatggatgtctgggggtggggatggggagggattagaagggatccaaatggatgaagtcgtctcctgcttctgattaaggtctcctctgccacccagggagcccctctgctgacactccttgtacattattgttccatggtgtcacttctcccacccttttag

SEQ ID NO: 72701 - DNA, 1006 bp, Homo sapiens
cattgccttagtagggttctgttagggtttagtagggttctgtgcttgctggtagcagtatctgcatcacacttctaaccttgcagcccttaggaaaaagcttgctccaaatttagctctgttgcctgccaggctctggcagtgattttgagggtgagaatctgtacttcttcctcctggattctcaggaattcccctttgcttaagaaggcaccagacttaaggtttctaagaaatagtattttgtacacatctattttatagtttatgtctatagacacaaatggcatacacagatttgaatttgtctgatgtactgtttcttttgcttggtagcctaagcgtgttggcttcgtgttgatgaataattttaggtctgagatgaagaaagccagtaatacaagtttgcagcaatgcagctgcttaaaaatgagcaaaatatgtcttgttaaagtatctttttttattataagcaaaactgttggatgtgagaattaacctgaattgctaattctaaggtagaaatatttcttttttttttttttccagcttttggtttggcttctgaagatacaaagaaagaggtcaagcagtctcaggtactaatcccaatgatcaaatcttttcctcccttctaagattcatttgtattttctctgataggaatagtaatcatttcattcttcaattgttatttttattgttacataattcatataatgtggtcaacatggattttgaatccctaatgcaacctataagatagacttgctttttacaaatcctttaatatttaaggctgatccacttggttttaaagttattttgagaaaaaacgtgttttgacatagagttggacattttaatagtcttgcttggataccatagttttccccagtcttaccaaatacctttttttatttcttttttgcgacggagtttcactctgtcgcccaggctggagtgcagtggcacgatctcagatcactgcaacctctgcctcctg

SEQ ID NO: 72702 - DNA, 1050 bp, Homo sapiens
tgtatcttgttagtggatatttttgttgcttcccatttttttcttttacacagtgccactgtaaacacttttgtcatatatccttgtgcacacatctgagtttctcaaggatgattaataagagtggaatttctgggtcattgggaatgtgcatcttctttattaaattaaaaaaaaaattattctctgaggcttatttactccattcttaacaaaaagaaatccttataactcctctttagatgtgtcagtttatattaatgtttcagatgtagtagatccaagataagaattcagttgaaactgaagacacccatttaagtcttacccatgtgtccaacatataaagccgagaagctggtttaaaatagagacaggtatatggaatgttcctatttatataaactcctaaagaaaaggaattaggtcatattcagtaggctgttcagcatttccttttacatattttatttagttttaaccaaagagcattttagattatttttaggatctagatggctcactgtggagctatctgttgtgtgaatatttgagcaagtgaataaatgaatggacctatagaatagagcataagaacaataaaatataatggaataaaattaaaatcaaattaggttctctgagctgaggtgttaaagagaaagattcatggtgggggaaaggtccccacatggctttgctgacaatctggctgaaggctagaatttacgtggcaccttcctctgccgacattcctgtctggtggcagggtgctgacacaatcactgttttatccatttctttgttataggcccagaacctggggaggcctaacgtgtttctctgggaggcagccttgctactgccattggcaagccctctgatggtctttgtgggcaggacatactcgggtttccttcctgttcgccgttgtaaaaagctggctgccttcaggtgcatctctagcaggctggtgaatactgccagcatggggtgttatagatgggctttatgcaggacttcacgctaaagccctgttgctgaggaatt

SEQ ID NO: 72703 - DNA, 1020 bp, Homo sapiens
tttttatttagacgagaataactcctctgactcattttgcttatttaatattgagtatttgttgttgaaaatgtttcggtcagctgggcgtggtggctcacgcctgtaatcccagcactgtgggaggccaaggtgggcggatcccttgacgtcaggcattggagaccagcctggccaacatggcaaaaccccatctctactaaaaatacgaaaattagcagggcctggtgatgcatgcccgtaatcccagctactcaggaggctgaggcagaagaatcgcttgaacccaggaggcagaggttgcagtgagccaagatcacactactgcactccagcctgggtgacagagtgggactcctctgtctcaaaaaaaaaaaaggaaaaaaacgttttggttaattcctaatgcacaaattatcatattctgaatttttttttgtgtgtgtgtatatatatatataaaaatatatataaatttaagagaactatataattgtgtggggcaactgtagatttgtcacgaagtatgataaaagcaagtagaagaaataactttctaaaggcaaggcttaaaatagagataattaatgttcaaaattttggtaacaagttctaaggcaattttcatgttggaataacattttcattaatcttagcgcagtgcttcctctatgagtctcttaatctacttttttaattggatgtcattaatttaacttttgagttgatttataatgtaatattccagaaggattatggagagaaaaatctacgcatataggtacattttaataacatttaaaataggcatgaacagaatataaagctgctctgaataatactggaggtttggagtgagggaggatctaccttgtgctgccctataggtgctttccttctttagctaagtaagtccatcaagacctctgcaccatgttgtgatgtccttcaagaccgaagtgcttgcctgtagataaatgctatccctttgttctcccaggaaagaactctttgacaaga

SEQ ID NO: 72704 - DNA, 1024 bp, Homo sapiens
agtcaggatgcttaaaagggtttcattattgggggcagaggtcggcgggtcagaggttggattacattttctgctttagaccaaatggagctaacctagctgcttagagacctctatactctctccacctgaactatgtagcttttgaagagaactgacacttctaattttgtagccttttgtggtgagactataaaccctttatttaaaacctggcataatctcaactttacaaattattttttttctgctgtttgcagaaagttttggaaatcactatttttcttgaaaagagttaggcccttgcctctttagttttttttttctttttttttttttatattaaaaacacctgattttcatttgttaagccaggagagctagcaaagcctttcatagattagtgtaaagaagcttgagaaagatggcctggcgttttctaatttcagaatttttttttattcacagggagactgtgagttacttcattaaaaggttaactttgagagtcatgagtgtgatttattgcctcagctttttgatgctgtatatcattaaacttttcttttgaagtgaaaggagttggatgcttaatagtttactaaaagttaattttatttttagaaattgataggcattaattgtatttttatttattaaattcgagactttattgcattgctgttgaatgcaaatttatcgacccattcattcaacaaatattgattgaatacttactttgggcagcggcctggataggatgctccaggagaaaatagaattttttttttatacacattctctcacttaaataatactgtcctttttcacatatacaactggcattcttagaaacatcttttatacatgtgtctttatatagaacttcatgcatcacaggaaatagaacattgagattcaaggccaagttgctcaacagtaatgaaatcttcacaccatttggaaggctgtgtcatgaccctttgtctctctttggttgcccagcatttgaacccctttgctt

SEQ ID NO: 72705 - DNA, 1868 bp, Homo sapiens
aatagctgttgatattacattatatatatatcctataactaggaagtataatacttgtttggaagtaaatttttgaggtgcattcattttccttcaatgtttaaaaaacttagctatgttttaattgaaggatttttaaagcatatatctcattgttctatcatcttgacacaaatattttcacttcctggttcttctagtctctgttcatctaggattttgttttattcttggaatcatgtctggtttttttctattaaacataaagacatttccgttgttataaagttttcatcataattttaattgatacataataactcattagctacttttatgtaaaactttaaaaagtatttgctatatttcttttcttgtctagctcacatttgcatttacccataattattccaaagttttatgcaaatagtaacatcattagtttctttacacatgattttctgctcttatgtaatccttcatgaatatatatatttgctggaattttaaaaagacaatgaaaattactgcataattcagaagtaacagtaggaaggccctgaattatttatattgggtaactgctaattcagccttaaggtttgctctttctaacataccacattgtttgtctgatttaacctgtgattactgttttttgcatttcatatttctacatggaagttgaaatgaatattatataaaataaatgagatttacttgaaatttaattccaaagatttacattaaagactattctcttcttaaataataaatatctatgaactttaagacagctgtgaaatccacatcagtgcagtaatgtttcagatacttaggtacttgttcttgaattcttttgtctgtaatggttactaggaatatagttttatggctagtataaaacacaggatataataaagtttgttgggggaggaggtttaagcatatgagatatgaaatttttgacttttggcttttgtaacaacttgaaatatagggaatagtgttttgcttcaaagctaacactcgtagccttaaaaatattaatctctctttatatatgtatacataatttatgtaagcacagttgtgccttatttctgaattttagttcctcctatgcttataaatttgtcaattccattattatgctattcctgttattgcctgagtaattaaggattacatttctcgaccaaaactttttgttatcagggtattttaatgtgtttagagaactttaaaaagtaaagtaatttttgcacatgaggtagatcaaatattgtatcctctagtttagccaaagggttttcattttcacatgttccatatgttgtatataaaataaaaaactgcttctgtgcctctgagttatccctgactacttcccccaggctcttcccttcaagtcaccttcacagatttcaggttggctcggagtcacggaagaccctccttgtaggtcttgagctctatttgggtgtgtgggtggtgcagagtgtagaggttgcatggattcagccaaaatacttcatttccagtagctcctggagaaaatgaggaaaaagaagtggtttgaagagtaccatgtcaggtctctagaaacagctgcattttaagccaagccttttctttttttcttttttcttttcttttcttttctttttttttttttttactttttttcggagtagtcaattcatacttatcttctttgatcattgttttctcaggagctccccagtgtcctcctccttcatcagctggctaaacaagaaggtgcatggaccatacttccgttgttaccgcagtacgtttgtttaactcacctgtgaattactgacattcctacctgaacactttta

SEQ ID NO: 72706 - DNA, 1032 bp, Homo sapiens
gtgactacaggcgtgcaccaccactcccagttatttttttatttttagtatagatgagattttaccatgttggccaggatggccttgatctgttgaccttgtgatccgtctgccttggcctcccaaagtgctgggataacaggcgtgagccaccacaccctgccctatatatgctttttcttaaagaataaaatgcttcaagttgatatttgaaaattatttatcccctgaactagtgttgttatggagagaattaactttacgaactccagctgttttttaaaccattagcatctggcttttctataagctgaagaaaaatatagagaaaaaaattagatatgccattctgtgtacccttcattcacttcctactgatcagttttaaaccttattattaacttattttacagaagtgattactgaaacttgtttcttttggtcagtttttctgtaacatatagcagaaattcatcttggattttcttctgtgaagaagagacaagaatacagattccaaaactcttggaaaccctcagaagatatgacccctctaaggtgaatataacttcaataccagttcttattttgggggacagtgtttcaaaggagatttaattttgattaagaagcttttgaatctaataaaaaaccacttagtttaaaattaaaaagaatgaaacattgttgaatatctgagatatgttaagtaatgctctttgaagtttgtagcttatagagggacagagcttataatgagccattttaaatgaaaaaaatctgttaatatatgtgttagcaatttcagagagttggaaactataacttgaagttcataaactgcttttcttagcaataaacttaagttggctatttctgcttattagacagtgaccatatattattttagatagaaaattttttttgagtgccagctgtatactgagcactgtggatggcggaggctagaacaaaacagacagcgattctgaacatgtgggtggcacagaatagcagggagaacagaccatt

SEQ ID NO: 72707 - DNA, 1074 bp, Homo sapiens
tcttaatttccatttctccactctagggtaagctatgttcctgcctggtgtgtggtagattctcaataaaaatcatttgaatgaatgagtaaataaataaataatcactgattctgaaaggaatttttcaaattattctttgaaaacctcagtagggtataagggcatactattttctttgccctaatagtctttttatatggaatattctataaaatacaacttttatacatttatggtataatgaggactaacattttgttcatcttgatgatcagatcttgaactacttttttgtatacaaagcttatattcattatcatactagtgttaattatatttttgttcacattctctagaaatatttaatctgtgctaataactctttatcacccaaaatatttaattatctgaaaccaatagtaccaccttctattggtcttacatgaaatgattgtttttaaagtgacatgttatatctttatttaacaggaatggtttttgggaaaagcattacatgatgaagaagctacaataattcaccattatgccttttccgagaatcctacagtttttaagtatccagactttgctgcaggctgggccttaagtattccacttgtaaacaagtaagaatttattggaattttttcggggggcgggaggggtgtgcatcaactttaatttcattgagtactgtaactgatggatctcaggatctcaaatgagtttttcagccagaggcagtgtgtggtaagatctggaaaaggagccagatgcttgagggtttctgcttcagcgctgtcatttactagacccttcagacaaatcattcaacctctctgtatttcttctcactcatccaaagataacaagttgtgagactaagggagaacacagaattgctctgagaaccatgcacatgggagcatcattactgttgttaagggatctacttagctataggtgtaactttgatcaccagtaagaaaatgaagcagtaacttgctggggttgagagttgatgactcattaggtgcatgggtatgcatacttaaacactggccagtcagg

SEQ ID NO: 72708 - DNA, 1537 bp, Homo sapiens
aatcaggcagccgtattatggcaggggcttgtaaaaactgaggaacaagccccttgtgtctcagtttctcttctgtttccagtaatgtacagtgttcatgcattcttttctttttttgttgttgtttaaaaattttatttattttataagtcactcaaatttcttctcttaactatttcagtttagtattacacagtatacagagtgggatgtaagaaccataaactgttccataaccacgtttgaatcaaataatcatgatttgtgttccctttggcatctcagtatctccaggctccagcacttgcttagctgttatgactccggcgagcctgtgtttctgggagagcgctacggctacggcctgggcactggtggctacagctacatcacgggaggaggagggtaactatgatcacagctttcttcaactactttaaacataaacttccctttccacacgagaggtaggtctctggcactgggatctatactgtacgtgagtactctgtgaatggtggttgttactataataggaaagtgaacattatatttgctaaatattaaaagaacactcagtaaagaatattttagcccttgaagaaatgatataaaaaagtatgtcatacttgctagaatgtccctaacaatggttgcttctagacagccaactagttttgattgtctatttaaatggaaaaaaaaaattggttatagattttaatctcagagaataagccattagactattaaattatgtaatgcttaataaatcgcctttggagaaagtgtagtatagaagcttacttaggcaattaagtaatatttatgtaggatttataggttttaaataacagttaaaaatcagtgttttaaatgaagcatctgcctaatctcatacgaagaaagattttaacttgatttatatgggtaaatcaattaagcagttttccctattacttctgtagtcttactattggtgcgtgtaggcaaaatcttatcaacggtagtcatttaaattcactcagtagatatttgttgcatgtcttctgtgttccaggcagcattctagtttataatctaatggattatacacttctggagggctaggacctttaattcctactttgcaattccctagattggaacaattcctacaggaacctgcaggatctcaacagtcgtactacaggcatcctgattttgtttagccaatacagtggtgaagataacacggttatggtggtggctcttttgtagtgataaccaaacctgagcatgtgtgctgatctttgttagacgatggcttgcatctacctgaggtcattaacaacaggagggggagtccagggaggcctttgaaaagacactagagtaagcccaaggagtgttgacctccttatcaaaaaaggttcaagctatttgcggccttactgtaatgcatcgggctttctgggtgaagagttagggccaattaaggatcagaacatggcacccattgagccaggatgttccactttgaaagtggccctgttat

SEQ ID NO: 72709 - DNA, 1725 bp, Homo sapiens
cttgttttctttcttcgaatgacatcacctaattacacattagagcagtagagaggccaagggaaatctgagaaatccttgtcccagccccccacaacaaacttacggccagtttccttagaagtacctggaacataacagtttttctgtctttgtgcagaagtgataatagtaacttaaatggcttatcaaagaaagctttttgtatttattactattgtttaggaatctcccagaggcaagactatggaacatagaagcaaaaagcagtgcatttggggtattaaggtaattggagacacaaaagcaaagcacctggagttagaagaaagatatcagaaaatagtttcctttttgcttttagattcctatagccaatgttaggtagtgaagtaaagcagtccactttataaattcaaatgctcttctgcagcaaaattatattcaatcaacaaggaagcctaactctctatttttcctgcaggctcggccggtggattaccctaaggactacctttctcatcaagttcccatatcgttccacaaacactggaacatcgatccagtgaaggtgtatttcacatggttggcacccagtgacgaagacaaagccaggcaggagacacagaaaggttttcgagaggagttataaatcagggtgacctgtgcgcctagcctgcgcagggaatgaactggagactgtggcctcatcccactgtgctgtgctcacaacacttgtgtctgccacatggcattgggtgcttcctgactttagggggagattttatgtatggtattttttgacagaggaagaaaaggggtcacaggagaaacatttttttttctgggaaaaatcacttgcttttgacttatgcagttgttttaacacttagtgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttgacatggatattgtgaatggtatgaacttttaaaccatattattgatgatgaaaattatttcctgggaactcagtaggaataataccgtattaaggaataatactgtacataaaacatcatgaaaccctagatatgaaatcccctgaagtctgtaatcatggtggttatgttttgtctattcttttgctgtttgtgcctcataaaaagagaatgaggtcttctgctagagcttcgtattgctttggaagttcatctgtgttttatttctccctgaagccctatctttatggcttacttgtaacatgaaagtagtagatgctgccagaaaatagtgtcctcaatattttaaaacaatgttgacatgttttgttcaagtcagcaagctctatgtgagtctcaggaagtgaattaaatttggaccttatgttttactcttgttttttttttttttttaaatgttacttaatgactctctcctgactcaggagagaaaccccttgtggaaggacagcatggtgatcaggcaatttctctgggttcccaaagaatgacatttgaacacagtattttgaaacagctctagttttcaaattatatctttaatatatagtaatgtaacatattcagtattaatgtat

SEQ ID NO: 72710 - DNA, 1127 bp, Homo sapiens
tctttgcctaagtttttgatttctcaaatattgtgttcattagtctagactgggaatggggaggggaaatggggaaaatgaatgaatgaaatcagaaaaaagtcagcggctcagtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaattaatgtaattgacatcttcaagaatgtttctattgtcttccattcataatcagagatgtaatttgtatggactaaataaaaactttattatgtaatgaaaagttgaacactttcttacaaagaaaactctaggcccagatggtttcatcggtgatattctccaggcatccaaagatgaaatactatgtttatgggacataaactctttcagagcataatgaaaaaggaaacatttcccagctgaatttatgagacccaagtttctctgacaccaaaacttgacaaaagaaaatcacagactaacaactttcatgagcataaaagacagtgatcctaaacaaaatgatcagcaatatgtaaaaagaggatacataaaaaggatagtaactcatgaccaaatgggtttattccagggatgcaaggctactgtaacattcaaaaatcaagtaattcaccacattaa

SEQ ID NO: 72711 - DNA, 1051 bp, Homo sapiens
cctcctctgtgaaggccggtggagtagccactttgaaaacagaacttccaaccaggttaccatgtctaacctatgaccagagagtcacactgatgaagcctcataccatttgccttttggattttatttaatatcagaagagatgaattcttaagatatttttctgaaggttgcccagggcacaaacaaattggacactttcactgctaaaaagtacactttaatattcttaaagtataatttctttagagcagtatccctattgctggcaagttctgctttcataaaatatgcagataagaagtgttaaatgggattcaagaattatggttttatttgggactgtttgcatactcacaatggttttgttctcattgtttttaacaaaaaagcaatgaagtttggggtggttttttgaaaacgaaactgaaaaaaattatatgtgaaaatgagaactgggtaaataaaattatattttgcacttgtccatatattaatttaagcttaacaaagaccatggatggggtttgttgactgttaagcatgtttctcctgataaagaatacagccaggaaacacagcatttcagttcacaagacacatcctatatttttctctcttccccttttgccacagcatgaggcagttacttaatttcttcactgttcacttcattctgagttcctttaatgagataaaatgtaagcagctgactaagaccaccacaatacctcctattacatattaaatggacaccctttatccagtagcatccagaagagaaagaaattcagagtttatgggtctcagccattctggtaatttacttgttattactcactattgactaaaatcataacgtgagttcattcattttgatcaagtaagatatttctcatgtataataaaagattttcattaggattctagaaataatgttcccactcattgactatgctaccctttcctttatggctttaaatttttctccatcttgtttcttcagtatgatgaattgcttcctaacttgttttccaggtttgctgacatt

SEQ ID NO: 72712 - DNA, 1048 bp, Homo sapiens
attagttccagggaatccctgaattctccatgcagggccctaggaacagaaagcaggccttctgcatagtgggaaataccacgtataaggtgcagtctattttcaacactattgaaatacgtgttcaccatataaaactacacctgttgtcttggtgatggatgtagccacacgcctattcctaatttgatactcacttctatgttaaagtagttgttgcttggctgaatggtatcaaaaactgatgtcacaattgtgacagttttgaagctgtgcctaaaaaattattataatctacatccattgttttataatttctcttccctagagttgtgtgtgtgtgtacgtgtgtgtgttctcttccttggtatgatttttaactgtctctgcttctaaaataatttgcagtagtaagctttaaaaaaagttcatttttgagctgtgaccatatgctgcctggaaacgtatccttatagttggcattttactcatgttactctcgtgctaagaatctcaaagtcccatatgcatgctttgagatttcaaatggaccctcctgtctaagtatttcactccattcttggtagcagtagtaaggtttgagtttcgaatacagatccagcacctcacttctaatatctctaaactgccaaaaatcaaagtagcaccaactaaagttgggaaagaacatgaggctttcttatcacactcttacgtcagaatagaaggtgttcccaaaacattgttagaaataagagtgaatagacttttttaagtggctagtgatctgcaaaactatgccaaattattgaaattgtagtttttctaaagttgtgcatttgcaatatcttattaacttaaaactgtccagaatcaacaaacttccactctgtatgctgttctctttctaaaacttcttattaactagcaatccatctttatttctatatttcatcaaattaaaaatgccatcagttgtaagacatagcattattttttctgctgtacacaaagagaaaatattgccaattttattatgacactccac

SEQ ID NO: 72713 - DNA, 1073 bp, Homo sapiens
ttttgttctctactatataccaattgcttaggacagtctgttttacatagtaaacctgctcaataaaatagttagtagaattagtgagtaaatatcctccatggaagccgtggagacacattgagaagctcgctaccctcctgttggttagaatacatattcttaaaattatgacactgacaggaatgccaaacctgaaaaaggcgaagcagtccttgatttaatttacagggtcctattccaaatatgccattacaaagctagtttaggatagaagaaattccattatatcttttattcatcttgatcactgaaggattacgtaacaacttacatcttggttctgttgtatggtctaaaatcaatttcttgaactctatacttagtccaattttacatacttgtcctattgtacatttaacatctaccagaattaacagagaagtgtctgtaggcctttctgaagcagaaactcagtgcttgtgaccttgcttggaaatacatccccaagaatatatatatctacttaggtacattgccctagagtccattttttaacccccaaaatggccgtctttacattttgacatgttatgaaggaaaagagaaagaaaccttgctgggcaacacagatctccatctgccagtgcctctgcttcctcactgctgccgcctgctcaggcagagcgcacttttagaccaaggacaggatgctagatgaagatgccagcagaaggaatggcacagaaactagcttagcaccctctctgaagcagtcccaggatctaaagccaattagcatagcccaaataaccccacactcagtgtaagagctagacctgcaaagacgcacccagcttccaatccagtgaaatgtgggacctctgaacacgtatcttacgaactgaggtcgctagtgggttccagcctgctagcttaggggaagatgatgtgggcagagtgtcattactgcctgtccccaagtacggtgaagcagtgtggcatggtggtgggtgctgtgaagcgacatggtagatagctagagcttgctctttcatatagtagaaaataat

SEQ ID NO: 72714 - DNA, 1041 bp, Homo sapiens
agccaggattgagtgccgaagactgttgattagcaggcagaaagagcaggagcccagaatctgtgccctcctcctgtcttccacccaacaaagtgtcccaggcccactgacccagcaagggagcgacgccagctggaccctggactagaaaacaagaaacacaattcaaagccaacaagagcctggggaaaatgaccacagtaccattgattttatctgggtcctggtttagattcaggacatcagtgatttctcccttgaaatctttgtaaaaaatatgcctattttttttacatgtgtgtgtgcttttttcttttcgtttctctactttcccttcctccctcccatcctccttttctttcttctgaagacagtccgtatctttcatcagattctcaaaggaatccatgagtaacaagtgtttaagaaccacaattctagattttctcctctttagcctctttgctgactatgactcaagttgctcctggaaagatggaaatttcaggcgatgtccccaactccaaagtttagataccatgggaaataaaacattttaaacccaaactttttcatgtccgtagcacccagtgaatcttagaaaccataaaattagagggaggctgctatggtgaggccaaacagcacggacagtgattctgcccactcccagcatggtctgaaggctgtaggatgacaccaaattgcctaacaaatggttgaactgggctgccatctaacttttgtgaacagatctttattattttgtctccagtgggcatatatgcccacaactttggctataattctgaacagccataggtccaaatacaccttctttgttctgaaattctaaaatacacccaacaaacacagtcattcaaaaaatatatgttctttcagatcgtaagtgcagtgagaattgatgacatttattttgtttttcactcagaatataagttcctcaagagcattgatattggtctgtggaaagaatggatgcttgaaggacatagagtatctcctttgtaaaaatgactg

SEQ ID NO: 72715 - DNA, 1041 bp, Homo sapiens
tttaggaaatgatcgactcgactttacccaggaaatgatctcttctcactaatgtttctttccagactcaacagccttgcctatgattctataattagaaatataatattcaaatccaggtactagaaaaaatgtggggcttattttctctacctctatatttgctatatttgtttggcttattgtcttctttcttgctcaatgaagaaaatgtatttaagcgtgagtatcagaaaaataaaattaaatgatttatagagttttctcatttggggaatattctacttttatactagttaattgtgttttgggacataagacacaggaaaggttttcctgtagtgcttatgtagtaactttttagcccacagaaatgtgttatattttctaccaatatgaccagtaaatacttctacccagaatatctgaagggaagatactcagtgtgatttcctgtgcatgatagtgtgtctcaaaatgagaattacaaaacctgatagtgctgtaaagctgtaaaggttttatgtttaggccaacatgctgtcctaaggcatttacaaattaactgctgcaaaaaatactgtttactaaaaatattttactaaaaatattttttaaatcccatagcctgatagtctcttactaataatctttattaatattctcttgaacttgatattacagtattgcaaacagtgctttgtaagactttctaatggatcaaagacaacttttattagttgtttgatgtgtaattctagaagactgtaagtttccttagacctcaaggccctattcttcgaacatgcttccatccaagagtccaattacttctctactagcatatactatgtaggcccagaaatcagctggtcagggtctaggagtcgggtatatactcttgcctaaggggaggcataataaagggtagtaggaaatgacacaagaaaaattcaagacagaataccagcccttgataggctgttgaagacggagggtgaacgtggaaaaaacaatgggcaaagaacactatataaaatt

SEQ ID NO: 72716 - DNA, 1080 bp, Homo sapiens
atcatttgcatgccatgcttccccctccaagaaaaatttcttgcttattgcagcttttcttaactctaaaatgaagaacatgaatgtacctgtagtagctaatttaattgaagcagacatccatatccatatgatttggggggaagatatgattatggaaggataaaatatacatcagtgcatgctcaagagtgctttacctctgcctcctagtttaggaatctagaaaatgttcatcttaacccctctctgagagatctctcaagtgaccagtgggctgcactgtcagagcctgccaggagaaaccagtgcggactaatcacagtatgttaaccttctggaccatttgctataaaatgctgctggtcactttagcatctgcaggaggcttccagacttcacctgctgttcatgaattctttgctgaagcacaccaggaaatgatgctaggaatctgtttcttgcttggcttcaccttttttccttgtccaaagtacttctcagtggggacaataacctaacatactgagttcagtgtaaacaggaaatctggcagcaaaaactggaccagggactaactttgcaaagccaagttttaatgagtaatttgcaaagtaattaatcaagaggtcattgtccctagaaaatggagtaagtgtaccccacactgatgtggtacctcttttggctgcctgaggccacagctgatcttccttataactagtggtgacccactagtaagagagtaacccagcatttccaggatcaaagacagaaaatgtggagtctacctcttcagtcttgaaaaactacagatcatgaaccattaataactcatcagtggttcagaaaatcaatttaatgagtccaggccaactttgttttttatttttttgagacccagtctcgctctgtcacccaggctggagtgcagtggcaccatttcggctcactgcaacctctgtctctcaggttcacatgattctcatggctcagcctcccaagtagctgggattacatgcatccaccaccatgcctggctaatttttgtatttttaatagagatgagttttcaccatc

SEQ ID NO: 72717 - DNA, 1232 bp, Homo sapiens
taaaacccaaagaagcagtttggcaaggatatggagaatttggaacccttgtgtactgctggtgggaatgtaaaatggtacaagctactatggaaatacagttggcagttccttaaaaaattaaagctagaactaccatatgatccagcaattctacttcggggtatgtacccaaaagaagtgaaagcaagagatagttgtacacccatatttatagcagcattagtcatagtaaccaaaaggtggaagcaacccaagtctccactaacagatgaatggataaacaagtgtggactgtacataaaatggaatattatttagccttaaaggaaggaaattctgacgtatgctacaacatggatgaatcttaaaaacattatactaagtgaaaaaaatccactggcaaaagggaaactgctgtataattcttcttttattagatacctccactagtcaaagtcataaagacagaaagtagaatggtggttatcaggggctgggaggagaaggaacagggaattattttttaatgagtacagagtttcagttttgcaagatgaaaagaattctgtggatgagtagtggtgatggtttcataacaatgtgaaagtgtttaatgccactgacttgtatgcttaaaaatcgttaaagtggcaattttatgttatgtgtattttaccacaattaaaaataaatgatgttttttaaaaacccaaaaaggttaaatgatatatccaaggtcacagtattgtagtctggagcttttaaaactatcccaggctattcatagtatgttttgaggtagcataataataaaggaaggacttaacgcttggaacccgtagacccttatcttgacaagtcacgtgatatcttagcccctcagttcccctacacatccagtcctgtcttctggaaccaactgaccagtaaggttaacatgataaaattaaatatgtatgggaaaaatatatatcctagattaatctgggccaaactcattatatgctggggaattaatgtgttattgagattttttttaaaaacattccagtaatgtagcaaatgtgtaagagccttgttgaaccccagcaatatgattccccagttcagttaaaatgatcaactgaatataaaagtttgcctcagccactgagcaaatttgtttcacttttctgttatctatatgatgatgattattttatttcatcgtcttccatgtgtgctgaaat

SEQ ID NO: 72718 - DNA, 1078 bp, Homo sapiens
ttctgagcagactgggacactaaagaacactaggacagtaagggatggggacttgaaggaagagacagtcagtgtaaggtggaccatgatatgtgatttgcctattattaggggaaacatgattcggtctgtctcagctaggtctttacttttctttaggaaatctgagttaaattctacaggtagttttatgcattcccaaattcctattgaggtacaggtgctcagacagggcagatctgatcagaaacatcctggcttttccttgtctgaaggaccattacatatggtgctgtggaaaatacaccaaagaataagaaattgactctatctctatcccccgccccacactcgaacaggaaaagtgaatactttatataaatgacaacaataagatgttaaaaccagtaagccccataaaagaaacatagataaagcactgtgagaatttggaacaagagcaaatgatttctggctggagatggaggcagggagaattttgagggcagaggttttgtaaccaagaaaatgtagtgcgaaagctaaaagcctgggctttggagcaagaagcttggacctgagtctgggctcctccatctattggctctgtgacctcaggcaattcactaaacttctctgaaccttagtttctgcaattggtaagtgcagcctggaacaatgaatcactcaagggttacaagtatccacctcctgaaaggacacagacccatgcacctgataggcatgctcaattagcgttagctgcgattactgttattacagaggaggcatttgtcaagcctagccccagaggccatggatgattttggtttgtgagatgagggcagggctgtgacagacaaagctactacaaagccatgggatgagagggtatgtgatgtcgctgttctctcatctgtcctctccaccctcttgccctgttaaagcaaatgcaatgatctggttggaatgagaagtgctgtgtgtccttacatgacctcatggcagcttgctcctcccgcatgtgtgagcatgtgtgagcaagggagagggggtgaggggtgaagagaaaaggctt

SEQ ID NO: 72719 - DNA, 1100 bp, Homo sapiens
aatacaaactctgttaacatttgggtatatttctttcagagattggtactcatattagagtggagttatttgggtttttgtttttcctttatgcctacttataatttacatgctcttatcctttgttttataatatttacaagttgcagttattattttaatatttcaggttaagttgacttttcaatatggagtcagttttaagtgtgtgcgttttaaaggggcatatttgcatttctgacccacaaagactaacatcacttgtgacaattaattttcactcatctaaattttgcaatgtttttaaaccaaaacaggtttaataatgataggtatccactaaacatccagcttttatcacatcacctgtagcttcccatggaaattttctacgaagcaaacattggctagtattacagatatttccttttcaagccctcatgtttaatcaactccgcttacctgtgtggctttaataagcgtaatgccaactccagctccccagagtgaggtaaacagtatgtatgggcataattagcaaatcatttggttgtaagatgttgtatgattcacatatttggttttctttaatgaggcattcctctccagacacattagtcgtttcccaaaatgctcctttgcaaatagctatagaaacagcaaatgatgaactaaaaaaggtgtgctgcacgtgggacaccagagggcgctagagtaatgttataatgtgcctctgcttttctcttagctttgctattaaaaaattaaagcttttaaaataatacactaccttgtcttgaagacatttatttgaagttatacgatatagctttatgatttgagtcaaacatttattattatttatcattacagtcagcatcttctcaaaagcaggtcttttattcccatgctgaattttagaaaagaaattctaacaatagtcctcctcttagactttttttttttaaggaaaacacattattattcttagattgtgactttgtcctctcccaagagacagtcacgtgtgttaaaatgtttagtagttctagtctgctagaaatgaataatagaggaagtgaattatttctaaactttta

SEQ ID NO: 72720 - DNA, 1081 bp, Homo sapiens
tttccttagagacttctatttaatctcatacatgctcttatgttggccccatggtaacagtgtgattgagaaagacacactcaccaaatagtttgagcttctgctttcctgattgatgaatttctcccagttagcacccaatcttttgtgcctaggattctatcttgctttatatttgaaaattaaacactgttcttgaagtttgggttgtaggaatgtatgttttttcctcctattatatcattatctcaaactttaaaaaatgcttttactttatatttccttactagaaaaaatgtattatcattagggtgagggagattcaggcagtctcatgggcttttagaaatggtttcatacaagtcactcattgttttgaagttcatggtacatttcagcttgacaaagttattctaggtcctgggagggaagtggtgcagatgattctcagaactggtgaaataacttaataatctaatacataaatatgattgctggattataattatagttatgattgctagattataatggtaactctcaattgggcatacttgtaaggaaaaatgcttttctctccagaaaatctgttgtggtttggagacctgttgctgaaagggcataaagagaacaaaacttgtattagtgtggaagtatattctcaagttggtaaacagaaccagctcctaaatatcaacaaatattaaaacgtatttagcatctaggaaaccaaaataaacagtgatttctgaaatgacccctaaatcccttataatgttatgtatctattgattccaggcactgggaagggaaaaggcaaatctcatctcacattgcaaccagacagaacacaaaaggggtgttgtgtgtatgtgacagagagagattgctgatggacatgggcatagcatggccatagaagctatctgccagctggagcacagcatggctggggaagatgaattatagagtgatgatttctgcacagtcagttaaggaagaaagtgcagaacatttccacatacatagagcaagagggaagggagcaaaggacataaaaatgcaaaatccaggagagaga

SEQ ID NO: 72721 - DNA, 1049 bp, Homo sapiens
agtgtgccacattgctgcatgttactcattgctgaatggagtggcacataacatctatttaaatgctgcataatagaactatggtatcgtttaggactttatataaaagttataacatttgaaatgccatgaatttcatcccagtggcaacatttctgtagtcagcttttaaggaatatgattagatgagatgtatactccacttttaaaatattttaattatcagaattatagaattacatgttttttttttaagtcacatagattcttcaagcttggatcttaccaagcctggacatcaatgagctatttcagtttgttgttgttgttgttttaatcaatgatagggcatcttggaaagcctatggcatttcctcaaaagtttccttcttattttccctcctaattattaatcttacataagatgtgccaagattgattcttggggatttactattttttgtttatagatcaagcttcaaaaagtgcatggtggttatgctgttgaagaacttagacaagaaaataactcacttggcagtgagcacagtggagaatcaaagaatcaatgaattgtggatctgaaagaaatagagaacatcaaattcagtgcactcattttacagatgaaaaactgtagacctacaaagacagttgacatggagggtcttctgattcccgtaatgttctatagcatcatccttcatgagatcatcacagaaacctagtttaagaacctctgggtcatttttgtatgcatgaaaagtgagaagaaaatgatacccacaccttcctgtgggtccagaggccagcaatccatgcatcaacctgtgtttattaaatacccacatgccctctgctgtgcaccagatattggtgggcagggctggtgtgtgaattaaaaaatacacgtcagtcagacttggtgagacacttactcacaggtgagccttagcctagtgcacagcatcaagacctcaactggttttattttgcagtccatccttaagagagaaaaagtctttctttgatgaaaatagccattaggt

SEQ ID NO: 72722 - DNA, 1041 bp, Homo sapiens
tttgggttttttttttaactcctgtgcttcagtaataatacacattagacaggttctatataaggagctgtttgcatttttgtttatctctctcaaaccaactgtcccaagcatcttaaaattattatctgattcccagaacattccccttaaattgggcagtgtgcaaggtcactttttgcactctggttggctccaggctattcaataaatttggagtaaagtgataaaaataatttcagtctcctagctctcaagccaatgttttgttatcaactctgagaccttttaagaattctgtgagaatcttctccaaatggctctaatttgacagatttacagccatgtaaatatatatgtgcattcatgatgacagtttaaatgttgtaagtagagtttatgaaaggaaaattgaaaaaggaatttcaaatagcccccttttccccattaaggcactgaccgttttataaaatcatgcttgcataggctaagattcacactgctatcaatactagggaatgtaagttttcgtgcaactgctgtttcatatggactgtatatctaacttaacaaatcataatgtaggttttaaagaatgaaacgagcaattttaaaacctattctagtaacattatttttagaataatcaggataatttaactcttaataaataatgcaagagttatgatctatgcatcaaattttaaaagatcgtaattatgtatgcagatattccattctgataggataaaaatctattggtttataaaatgtgaaagctcagaatttgggataattcaggcctccagccagggagtgatgtgagcagttagtacaagcataccctgggctctttcctctatgtcacaccccaccctcccacaccaccaagaaatggaattttccacagtggtgtatttgatttgttatatgttttgaattattttcaagaagaacagaagctataaaaatttcaagtagaatcatctagtttttttctcctcatccttttgctgtgatacatatcctgagtcttatttc

SEQ ID NO: 72723 - DNA, 1009 bp, Homo sapiens
tatttttaatatatctggcctattattccaccctaccccaaccatttatagaagagatcctggctgttatttgttatttttagtgccctcatccttcactttattcctaaatgtgataaatatgacacctctggctttatcccagtcatcaataaaaatacctaacgggacagaacagtaccattgttgtcctagagctaacagtaatatccattagctacacatagataaagatctagccagcatatataaagtgagactcttattggaaatattaacaagattaatgctgcccactgctaagttttctatttcaccagctgagtcttaaatgttcctctggctgtaccacattgatcacaaaaggcctttcaagttgtctgcctgatgatttttaaaaggtcaaattcatttaaagtatttcactcataatgtggggaaatagaagttgttctcaatctaaccagaaagaacgtcacttacaaaccagaatgcctacgttttgcagggccgaggatccaaggtgatgttcatcagctcctttcacatggatctaacctgcccatgtaggcccactccaatcacctggaaagtgtgagtccaaggccagaacctacccaggccagttctgtgatgccctctttctccttaccttgggcatccttggctttaatggccaattctgtacttgctgccctggctctactggtctcccacatagacagttcccacgtttgtgtttggccatcgaacgcagtgtttgggtaagaggcactccagatctctcagctgccagtccactgagctgattctctttttagttggagtagggagagtttaatcaaatttagagaactggggattggaatcatccagcaggcacatcacccttggtcatcacagggttacccatccagagcagtggagaaaatgaaatgttttcagaggcagtcaaacttgacctttaatttagcatggaccatagcttgtcaaggttcatcagcagagc

SEQ ID NO: 72724 - DNA, 1062 bp, Homo sapiens
ggcttctcagagtgatctcacccctgtggacggtctgcaaagatcattactcttgacctcacttctgcctcctaagctgagccgtgcagttggagtcgctcttcccactagcctgctaagctgctgccttccatcattcagacagtttctgacagccccaccctcctacacaaagccctgcctgtctggtcaaaggagggtggtgatttcccaccctttctaaaaacacgccttgtaagactttctctgtcctctaaaatatacttgctccttcagagtcacattttctactactgtacggttaaacatcgtctgtgggaggaaaggtgatgtatgggtttttctgctccactgttgtcgggcttagaccaccatcttctaaaaggcagaaacctggggtctgtaccagacagctccatgaacagatggtcattttgaagtctttgaaggtgaaatctgtgatgctcagtgaggtatacacttctttttaaagtggtagttccaaatgaagtgatgctgtaacatatccttaattccttagaccactgtccttaatctcagttgtaataacctggcgtgtgactattgtttattcctggtttacaagaattgtctagttatatagtttctattgcttttcctctaagctgaacaaagcactttgatactacttcattaatttcacagtagacagcttgatcgtttttatattgatttatcgctttctaatccccaattattttttggtcctatgtcagcttctcctgccagtagacagtgtgtgttttcatggatactcttgacatgagctttattagaacataaccaagaaggtgaatctgttgccaaaaaattaaataatgtttgccaaagagttacacagaataatttattacccagtgttctgcttttcctatgcaatggttcctcccagtggtatagaaaaccaaagattggcttgccctaagagatgaggcagtttggggatgggaaatagtgttcttcttttagtagataaataacatgtccaaggttataggatcgggatcaaaataaaaagca

SEQ ID NO: 72725 - DNA, 1272 bp, Homo sapiens
tggatgagcacccagcaagcagtaacagtgttttgtcttttgggatctttctatcttttattccaagcaggaactcagcatctaatcttagctctgaagtctctttcctctgtaaccctcacctgttgttttgtttgagtgagttcaacaagctaaattgtaccattgtgttcacagaactctgggcagatatgtccatgaaaagaaaagtgtagagtgaaatgatgttttatttgtataatgatcagccaacttgaggaaacatttcagagagaaattgtttgtttatttttaaatcattcagcactgtcaaggattgctatctgtaaaaatactaactttttcctacatttacctaaatgtcattaatgttacaaggatttaacttacttttataccttctaggcacttttgccaaattggaaggaaaccatgctcaatgaagtctgctgagctaatttaattctttactcacaaggtctttttccacgtggggaatgctgctgttttatatttatttggagacactgatggccttactagaaaaaaaaaatctgaatataaagattttatcttcttgattaaggtgcatgtactcaaatagctgccccaattggacatgcctgaataagcttcaggaagtgcctgagagtcaataaacagtcctccctttcccttcttaccaattattaaatgcttacatgtgtagggtactgtggtacatagagtacacagtgattcagcaggcccagctcctgccttctctgggcttcacaatcaaagacagcctactttgatgaaagggaaggtgtaaggaagttgcaagagaacagaaataggtgctctgcccatgccaggcattgtgctgggacctggggacactgacctaaataatcatttagagaaggaagtgattcatcattttaagagggagggaagaggctgagggatagttccatggagactgtgacatttgaacatgaagactgttacagagaagagggggaaaggcagagggaagaacctgagcaattgcagggagttggggaggtgcctgagggaatgacaactggatcccaagttccctgaaggagtgacagattgtgtatacaaaggcaagttgggtcagatgacagggagcatggaaggatctgccgaaaggtctggtcttattctgaaaacagtgggcaaccccataggtttttttgtttgtttgttttttgggacggagtcttgctctgtcggctggagtgcagtggcacgatctcagct

SEQ ID NO: 72726 - DNA, 1995 bp, Homo sapiens
tgattacatgtctcacatgcagaattacttgttatactatgagccaaaggatttttaatgttagagaatagaaaaaaatgatcattttgcagtgatctctttaaaaatacattttaaagaggtacagtacaagtaggaagagttcacattctttataagcccagataccccaagtgtttggttatttgatttgtgggggggggtcttttgtcattagtcatactgtggtttagaggccaattacatattttgtataatgaaggcctccttgcacaccacacaaaacagaagcagccctaccctcggttcagatgggcatggtcttcctccaggttctctgcaagccacaaaactgagcagtgcccctcctcttttagccaccacctgttcgcttggtgcatattgatgaaaatagccattttctgttgagtttatattttaacactttcattttgtgttcttgtttttactacaggaacgtttagattttgcaatgaaagaaatcattttcgattttctttgtgtgggaaaaccagcaaaagcattcagtctcaacccagaggtatgaatgatccttttatgtacttctaacagagcatgtcttccggagccatacctttgctttgcggctttggagaatgggatgagggatgtcttctcacaaagtcttctatttgtttctgtcaatgtccaaattcagatgatggtggaatttcagaagtaaaattttggatgaatagacttagaatgaaacggttagttgaaaggttgatgtgctaccatattctgttcttgtaaaacaaagtaattcttgcccaaaaagataattcatcactaaaagttaggttgttttattttagaaaagtcagtgcttttacttgtaactgttcaacaaatttagcatcgggaagtgatgaaatagagaagaacaaatatgtgtaataataaaaatagtaaaacaatgaaattaaataaataatgtatgcacatctgtttctgtgacagcatcccaactccagggcaggcagattgtggagatgagtatacagtgggcatcatacacaacatggagcagtggaggctgtgcacatgaacagcacatataattttaaacttttaaaaacactgtcagccaacagaagtatgcctggcacactgcctctttttctatgaggttgtagaaagaacactggaccagaagtcagcagagccaaatttgccacttgccacaggctctgctgcttttcctagctgtgtgacatttacctctatgaactgcagctttttcaccagtaaaaaggacaaaatgcctttctacctcaactcgcagaagaattgtgatattaggaagagtacattacaaactcttaagataaaaaaagggaaggaagaaagagagagagaggagactgcacaccataaaaatcaaatacatagagagttcctgtcatctctatattatcacctggctccttcattctgtcagtgaggaagggggcctggaggctggagactggcagcttgttagtagcagaggggacccaggtccctgttagtcccatgctccttcccaccacaccccatattctcttcttgatactaaggttgccacgtatctgggaacagcacaaaaagtccaaaaatgggagtttctgtctggtgtccagtgacctcacaggcttctggaatggctgcagccagggtctctgggccaatgggagggggcagggccagtgccaaaccagaggctttgggctggaaggaggcccagagctgtacagtgaagagccttctcttgctgggaaggttctcaagacattattcatttcttagcagtcatggctttactgtctttagcagtcatttctcagaattactggattacttgtctaaaaaggacatgttaaaagctactaccatcattatcactgtctataaaatgtattcttggttcttttctcaaactcctcattcagtcagtgcgtaattagttaa

SEQ ID NO: 72727 - DNA, 1024 bp, Homo sapiens
ttgttcataatatataaatgaatggatgaattaatttataaatttatgatatataaatgaatccattcatttatgtattattcacatagaattttcactaagatactctctcgtgccctttccaatttgcatcttgtatcaaatagttacatactatgtagatactacaaagagtgtgtggtcagtctagtttctttgggactaaaattcagtcacagtaaacaatttatcagttattttaacagatcaatgacttaaaataagtagcattttagttagcagtctaacaaagcatattcttgcagaatttctactcctcgaaattaataacatgaacactgtagtgaataatgtatggcactggtagattctcatgtacatgtatgagtctgaaattcaggtatatgtcttttcagtacaatgtgaaattggagctctaattatcttccactaaaacttgaaagatgaagctcagaaacacaggagttttactcactgccttccaccctctgggcactcacttttctgtgagaaaacccttatcactatctcacaagctgttctgcttcatgtatcagacgaaggcggtggggtgggtggggaggattcattttcccatagagagtaatcgcctcccctttgtacaggatgacgacaggccgatgattgatgtcatggatcagctaagttcttccattctagaaagttttattcatgtagcagtttcggattcagtaagtacacatttgattccaattaatggctcttaaaagctctggacctatctaaaatagtcagtgaaaaattatgtggaataatttgggtgtttatgtcagattaataaactgacccaaaggtacttatgaagataagactagtttttcagatgttaatttaagagacattcagataaatttcacacaaaatctggatcttaggaatatagataatatttttaaacaacagttttaagaattgctcaggattcttaaggaaaattactttgcctttttcattgtactta

SEQ ID NO: 72728 - DNA, 1104 bp, Homo sapiens
ttccgagttctcttaaagatgggcagcagtcaaaaaacatttaatatgtaagcagcagctgagtgggaagtgttgcagttttcccaggtattgattagaaaaaaatctctgcaggtcctatttttgatctttctttcccactctgagtcaaggtgctgctggctgcaacgtgaggacaggaagagtgcacacttagaaaagaaaatgtggcttgactttttaagtgcatgtttcattgcctaaagaaaactgtagttaaaaaatgaagtggttcctttcctcaaaatgtaagaaatatatataatagcgatatacagtatgtccagtcttataacctctaagtgtgtttttctccctagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagtaggtgatattgtactcacgaatgactgagtcagatggatggtctctctcgttaaactaataaccatgccttaaaaataagcttaaaataaataatacaatatcatagaataaaatctaagcgcacatacaaaaaaatcacatggacacacacgtacatagcttttctaagctcccattttcttctcatatttctcctgtatgggaaccatatatttttgctcatttacccattatatagctgtcttgtcaattaactttcaacctaaaaaagaaaaaaatagacatcacctcaggttcaaaatctacccagagcgacattccctttttaatctccttctatcctagaagactgccagaaataaatttccccccaactaggactattcaaaatcttcagaagcatgactcctttacagcctaatttccttcagaaaactaactgtatatcagctctgtcatacagaacataagttgctgactctcagattacctttgcctcggtggaactaatttaaactatggccctgatagtcagttggacctgccaattgcaaagttattcaagatctcctcttctccta

SEQ ID NO: 72729 - DNA, 1025 bp, Homo sapiens
ctgcaagagtttgcccttgaactttttagaatctttaaaaggtgttgtgtctttgctattaattgcatatgaacagtaagcatcatgatcacaaacacttttagctttgtgaacaggctcaggtgatgccacctttatttccagttgatgaccctcattcatgtttccataacatttaacagttttctcacgaatacatatttaggcattccaaaaaagtgttgaggagaccaaagttgtcacagaggtagaaagctatttcagaaattgtaataatgatttgttatcccagctctatcatccacagccaaaggatttggaatttctgatgtttaatgttgatttttctctttggagttagtgtatatttaccttttcttttaaggtgcacctactgaagtgtatattgttagcactgttggttaatgttgtgttaacactaagagaaatgttcttgagtatctttaatataatcattgtaaatagaccttttgtttgtttttctgctcattcaatctgctacccaggaacttcaggtaagatgatgctgtttttaattcaaatatgctagtagatgttttgcatctttgcagatttataacaacataattgcttttttcctcccttccagaatatatatgcttatttgcgtgcatatttccatttaggtgtgtgatataagaggtatttttcttggctgctctagtatggaaatgttttctaaaatgtaaatacatttttaaaacctttatatgcctagttctgaaagttgcatgattatatctcagagaagtggagttttcaaatctgatctatggcaatcctatcatttctcatcaagtggttgcacaactggatgggttttattgttaaattcttgtattaaaactgaaatcaccgggtaccatggctcccacctgtaatcccagcattttgggaggctgaggtgccagatcacttgaggccaggagttcaagaccagcctagccaacatggcgaaaccctgtctctactaaaaatataaa

SEQ ID NO: 72730 - DNA, 1078 bp, Homo sapiens
attgctgtggcagaaataggctggaatgtttacctaatgctcttccactaaatacccaaaggattctggaatgtgctacaagcagcatagctcctacttttttctccttctgaaaacagtactaaacaggggccgacctcagggtggtgggagtgggtgacacctcttttgaagttttcatactaatggtctctttgttacagatttttgaaaacacagatcattggtagtgtttaccaaaatcaactttttaaaaaatgtaattattacccaccatgccaaagaaaagtatgtaatcatttctgcctatgacttcacatgagtttacatgaaaatagtgtgcttttactacttttcacattgggtaaacaaaagttttgataccaaagtcgatgagggcctaagagttaataatgacaatatttgttcccaagctatgactaattgaatgtgtgaacatgtgagtgcaagaggattttggcataaaaaaccggctgatggtgtgatttcagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctagtaagtagcggctctcccactctaagaattgggaggcttattttttgtaactaatgcaggaggacagtttccagttgcagctaaggaaactttccacagctgctgaactaaaatcggaactgtcaggtggtgtcatacgggttctagctggcagagtcttctctgtaggttgcagatggaaacaaagactggggtccatgtgattcaccctgaaagccaccagatctgttaaggcctagatttttcccaaataccttttatgattctggaatctttttaaaaattccccagatctctaaagtgtggagatatgacagacattttgatgtgattttctgaaaatacctggattactagctgctatg

SEQ ID NO: 72731 - DNA, 1026 bp, Homo sapiens
ttcccacgtggagcattgtttccttatctgcaaaatgtggaggttggattggaggtcttgatggtcttttccaagtttagcgttcataccctataagcatgggccaagtacgaaaatctactgagagcccctttggggaccattatggaagagattgaaaagaagataaagaatgaacagtacttcagagaattcctgagtccagcctagaaacggactatactgtagctagaaaacaaatgtccccatttctatcaccatcagcatttcagtctctcttatttgttccttagttgaacaggttgtcctgtatgttttcttacacattgggggattcttttgtctttttattcttccaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgaggtaatggagcccttggctgatgtgagtggtgtgaatgtgcatggtacattatatggcattcacactcaagttaagtgtcacagttgcactgctgggacatcctaataaaggactccaaagtgacatatatcatggcaggctctcagctgagttagagtcatccaatcccattatagggcctcgtgtggaacaaagaaagaacacttacatatgaattcataaggccagaaagcaacgtaaaaagcaaaggaagagcctggaaacatggtccagaccttgtaagctttgaagataagcaacacttggcaagccttggaaataagttctttccatttggagttaaaaccctggaacaagaggctctttatataggaaatacctactctttaagtgggtgtcttttggcctggtggctgatatttctgagactagtgagatatagaaacagaaaaaaaaaatgtgaagagaaatagataaacaccagaggttagattaatcca

SEQ ID NO: 72732 - DNA, 1010 bp, Homo sapiens
ttcctcgaatcgtgaaagaatccgtgacctcttgccaggtgcggtggcacacacctgtaatcctgccactttgggaggccgaactgggtggatcacttgaggccaggaattcaagaccagcctggccaacatggtgaaatactgtctctactaaaaatgcaaatatttgctgggcatggtagcacacgcctgtagtcccagttactctggtgactgaggcacgagaattgcttgaacccacgaggcagaggttgcagtgagccgagatcatgccactgcactccagcctgggcgacagagcgagactcaaaacaaacaaacagaccaaaaagaatcacagtgactgctgaatgaaagccaagtccccaaagcaacttcaaaaggaagagtgggtagaatagctacctcattttgctgactctcagggtgagaatttataaaacccagtataggatgagaaggacatcacttcttgacatagtcgttttcattttttccagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaaggtatgtgtgctcactgaaagtgcagaggacttagtttctaaggggagccgggtaactttgaatttaaggagaggttgttcttctgttctggggttatactactgtattttctcctccagacacccctaaatttcctctgactttgaaatttcttctatttacccttaatcttgtcatccttctaaacatggtattgatgatttaggctgccatgaagtacctttcattcctgcatctcttggtgttactgacatcaccagtcctcagcagccatgacatcaggaccattaagggaatcttctgccaggcctatcctccat

SEQ ID NO: 72733 - DNA, 1134 bp, Homo sapiens
acatttgcagggggatcaagagatggagtaattacctgtcaaccaggggactccgaagaaaaggtaataaaagcctgttagaatgggtctcttgtgtgctctaacattgtgtattagttttggtctacccaagaagcctggaacttgagaaaagaagaggcggaatgagtcaccccaaacatttacatgaaaccaacagagtaagacagaatgccttccagcatgactgtgtgttgatgggatttgtggggaggtttcttcgttttggaaaagtagaggtataaaataaccttttttgctggatactgtctaactatactaataatttcctaataaatttattcttaattcagattataaggccaaatttcattaattcttcactgaaccacttagtttctttaatgaaggaagtttctctcaacctttcagcagtcactctaaaacagattttctcatttagaattgctacacacctcagtccagtgtgccgtactataaaggaaattaaaggacagagtaagaatggatgaaaatcattcattctgcagttacatattgagtgcctcctgtatggccccatggaggacacactcatgagcaacagacaaggcctctgctcttgtggagcttctgatcttgtcagcgagacagacattaatgaaacagtcatacagctattaactgcaacaaggaccatcaaggacaggaaagaacagaaagctgagagatcacagagcaaggctgcctgatccgatggggagggcggctctgggaagggttctccatggaagtagcatcttggcagagatctaaaatatgagatgaagaggagtgggcctgtagtctgcgtaagggcccggaggcaggggaaccaggcctttccaagaaccaaggagagcccatgtggctgaaagcaccgaaagccctgtggagaaaaggttgagaagagtctggagaagttggcagaagaagcccatgcagggctttggtgtttaacagcaataataagcaactgaaaaggattaacagtggggatgattagatcaaggctctcccactctgtctactgtggaaacagctcaaagtggcaagagtggttcagggaacttaggaggctgctgccccatctag

SEQ ID NO: 72734 - DNA, 1060 bp, Homo sapiens
taagcattttgtatatattatttccacttaatctttaaaataaacctttaggatggctattatcttcagtctcacagatgagaaaaccgaggcacataaaagtcagttaacttgtccatcttcctacagtacactgcagagccggcatttgaacccagatctactcactcttgagcctgatctcttgtactctttccttctgtatttattccctatttaagtctaacttaaatagaacacattttaaatgaagtcttaaccttttctataaggagagcatctcagcagttgacacatactcaatgcatccaactccacaatcccctacacataccatggagtacaatgtcatctatcctatctgaatttaccaaggtattaagcttatgcttaaccacacccataagatcctttttttttccttttgggatgtaaaattcccccagcacctaaatatagtttaaaaaacatttttttttaaatagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcaggtgactctgctatttcttttagaggtggttgcaggaaatgcacacctggttgttactctgtcatggttggagtctagcccactacggaaggctagatattttacagatctcttctcagatctttactgctgccaaaccagaaacactcagctttcagaacactacatattgaaagtgttggtgttggttctggccatttgtcgtccctaaaatgacaaaatgctgaagcacttcaaaatatacctttatataatttttaactaacatttgaatatattctttttggttttgcccctacattctgatattgtattcacattcattgaaaccagaaggctatagcaaataaggtaaatgttttaggagtgtcag

SEQ ID NO: 72735 - DNA, 1058 bp, Homo sapiens
aaactaaatcgtatgaaaatcctcttctctagtcgcactagccacgtttcgagtgcttaatgtggctagtggcaccggtttggacagcacagctgtaaaatgttcccatcctcacagtaagctgttaccgttccaggagatgggactgaattagaattcaaacaaattttccagcgcttctgagttttacctcagtcacataataaggaatgcatccctgtgtaagtgcattttggtcttctgttttgcagacttatttaccaagcattggaggaatatcgtaggtaaaaatgcctattggatccaaagagaggccaacattttttgaaatttttaagacacgctgcaacaaagcaggtattgacaaattttatataactttataaattacaccgagaaagtgttttctaaaaaatgcttgctaaaaacccagtacgtcacagtgttgcttagaaccataaactgttccttatgtgtgtataaatccagttaacaacataatcatcgtttgcaggttaaccacatgataaatatagaacgtctagtggataaagaggaaactggccccttgactagcagtaggaacaattactaacaaatcagaagcattaatgttactttatggcagaagttgtccaactttttggtttcagtactccttatactcttaaaaatgatctaggacccccggagtgcttttgtttatgtagcttaccatattagaaatttaaaactaagaatttaaggctgggcgtggtggctcacgcctgtaatcccagcactttgggaggccgaggtgggcggatcacttgaggccagaagtttgagaccagcctggccaacatggtgaaaccctatctctactaaaaatacaaaaaatgtgctgcgtgtggtggtgcgtgcctgtaatcccagctacacgggaggtggaggcaggagaatcgcttgaaccctggaggcagaggttgcagtgagccaagatcatgccactgcactctagcctgggccacatagcatgactctgtctcaaaacaaacaaacaaacaaaaaactaagaa

SEQ ID NO: 72736 - DNA, 1162 bp, Homo sapiens
atatatacagcttttaataatatagttaaatgccatcttgtaacttttgtgaactcttgttacacctttctatagattcgcaagagaatggattaatgatcttgtttaattaatatgccttaacaaaagtaatccatagtcaagatcttaagcatttttttccttatgatctttaactgttctgggtcacaaatttgtctgtcactggttaaaactaaggtgggattttttttttaaatagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggtaagtaatgcaatatggtagactggggagaactacaaactaggaatttaggcaaacctgtgttaaaatcttagctcattcattaattgtgtcatgctgggcaaatcagtctctctggcctctttttcctcactcgaaaaatggagacgatgaaaataatgtctcataggtttggattaaattaaataatgtaggtacttagtaaatgttctctttcatccctcctttgataaatttgccaactgagatttgctgaattacgtctttcttatgccaaaaaaacctaggacttgttttgatgttaattaaactaaactatatttctgcaagctatcacagaggacagagattattttaccgatatactataagtatcatgatttggaaggagtttccctggcgtaggtgccgcatgtttctaagcaattatgtaataagattatatattcagtcattcaaataattattacctacttgacataagtaatgaactttcccttttcttcagagtgttaatctctagtaaggggaataaagagtacacagataaagtatagtgtaaggttgaatgtagtatgtgctaagagaaaaatataaaaaagtataatgagagttgagaagaaagagcaaatagtattgggcaaagttaggcaattattcctttgagctaaa

SEQ ID NO: 72737 - DNA, 1070 bp, Homo sapiens
gataggtcttagaatatttaattgtatatatagtaagattaggtgagttttaattgtgtagaactgctaaagaaaggtttttagggattgttgtatgaataaaaggctttaggttcattggaatcaggggaatcaggctttactagaagaacaggagaaggggtgactgaccgaaaaataaaatgccaagtactcagaataaccctttaaatactgatatgtaatatttagcacattctacataaactgtttctatgagaaaggttgtgagaataatataaattatatggcttataaaatattaatgtgcttctgttttatactttaacaggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatc

SEQ ID NO: 72738 - DNA, 2965 bp, Homo sapiens
caagcagtcttcctgcctcagcctcccaaaagtgctgagattacaggcatgagccactgtgcccaaacactacctttttaacttagtgaaaaatatttagtgaatgtgattgatggtactttaattttgtcactttgtgtttttatgtttaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaa

SEQ ID NO: 72739 - DNA, 2217 bp, Homo sapiens
tttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggtaagtgttcatttttacctttcgtgttgccaatcactatttttaaagtgtttattcagtagacttggtatgctaacaattaagagtgttataaactatgtcttttcagccatttttgtgtagtcagtttgggggagtatggtttgatatacagatacacagattcagtattcgtatacagatttgatatcttggtatacagattcgatatctctgaatctgtataccaagaaatcatgttttaagggtctcaatatattttcaaaaagattattagtataataattgagaaattactgttaaaaagttttgagtttctctagaaaatttgaaactcttaacaaaacctgcataatactaacttaactgttttcatatacatagcaa

SEQ ID NO: 72740 - DNA, 1026 bp, Homo sapiens
gatttgtcttttcttatttaattttacatttgaataaataaaacattacatagttcattcatcagaactacaaaaaggtatacttagagtttttattcacccacctcttgcttactataggtaatcttttttagtgtttttttttcaggattctgtttaataaaaataagcaaatacatgtatatactcattaccctttcttactcaaaagatacagtatatacaccattttgcaccttgtttattggttgttgtttacttaagaattatttggagatgactccttaatgagtatatagagatcgtcctcattcttttttgtggttacatagtagttgatcatctggctgtgtcagtgtttcctagtttatttaaccaatttccaactagtggacttattgaagatttaattaggttccagttacatactgagaatgaacaatatctaaagcttagcttttaaaccttcataagactaaattttaaatttggtatttgcatcagaaattagctaacacctttgagttatgatggttaacatcaactgactaaatttatgctgatttctgttgtatgcttgtactgtgagttatttggtgcatagtcattatcaatttgtgaatcaatttattttcatagttaacatttattgagcatctgttacattcactgaaaattgtaaagcctataattgtctcaaattttttgtgtatttacagtaacatggatattctcttagattttaactaatatgtaatataaaataattgtttcctaggcacaataaaagatcgaagattgtttatgcatcatgtttctttagagccgattacctgtgtaccctttcggtaagacatgtttaaatttttctaaattctaatacagtatgagaaaagtctcgtttttataaatgaacatttctaaaaataatgacactaacgttaagaagttaacacttcccgttttataaaatttataaaatactttggtagtattttatagtgctgttcatatcattattttatt

SEQ ID NO: 72741 - DNA, 1722 bp, Homo sapiens
ttgttaggtgataatttaagcaatggaaatgactcacattagcaagggaaagtgtctaaggaagacatccagttttggagactttttttgaggaatcaggaagaggtaaaaccagtaaaagatgaaagaggtacagtgatggtgagaattttaaaagaaggaaaatgtaaactgtcatagctattaggaaagttgagtagaatgagtttgcgtgcatcccacatgcatctgggaggtcattaacaactttattgagaacagtttctgtagagtagtgggagaaatgagagtttattgagtagagattgaggaagtgaaaatagctacattacctattgaagaaggttgactgtggagtgtaacagtgagtattagcttgaggcagagataaaggtgagtgagaaaataagagtttcaaaggtaggcaagatttttgggctaaataaaaagggcactttaaaaaaggtataaataggtagaagagagaaaagggagcgaggtgggataattgaaagaggggatctcctgtggagactgaggtattaggcggagtagagagttcaggtgaagatgtgaaggtgagagaagaggatgggtagacatttccctggtgaaggaggtaaggagtactatgatggaattagaggggacacactgagagggtccacacttgacagactctcttctattatgtgttatgtgaggtagattgtaaagtcaaaggctagccttgaaaaatgtgatattgttttggaatggcaaccatggtgaatacaaaacagttaccagaatagtatcaccatgtagcaaatgagggtctgcaacaaaggcatattcctaaatatttatatgtgtactagtcaataaacttatatattttctccccattgcagcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttaggtattgtatgacaatttgtgtgatgaatttttgcctttcagttagatatttccgttgttaaataatgtcctgatggttttccccctttggtggtggtaattttaaagccctttttaatgttttagattttctaaatccaaagattaggtttaaattattctaatgtttctttcaaagataacttcttgtggacttgttaaaaaaaattagacacacaatctaggactgctgttactggaatatattttctatcatgctactaattttctttttaaaatgtgataaaaatagggccgggcgtggtggctcatgcctgtaatcccagaactttgggagactaaggcgggcggatcacctgaggtcaggagttcaagaccagcctggccaacatagtgaaaccc

SEQ ID NO: 72742 - DNA, 2000 bp, Homo sapiens
tgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacaggtatgtgtttgtctacaatactgatggcttttatgacagagtgtaattttatttcattaactagtatctacaaatggctttgtttaaagaatgaacacattagtgcaggaatggatgaatgaaatcatcatattttctaattagcctgcagtggcagcctctggccccttgctaggcctgcctcatcctgctaaagtgatctgtgcttccaaattactacttcttttcccccttcaaatctttcttattttgtcattgtaaatgctctcagctaggtgttaaagtagtcttactgatattcaaatgtgaataactgatagccctgaaccttctatgagctatttatattttccaaagaggattctccttaagccaatattatctaggtagaattttaggcaatggagaggtgaaaataatattgatgacattaatagctaactttgagcattttctaggtgtaagatgctcttctaagcacttcacatgcattaggtatatcttgcttaatcctcacagtcaccttgaaagaaaggcactgttactttgtttccattttgcaaatgagagaactgaagcatagagagggttaagtaactgccccaaagtcacttaactagtaagtggaagtgctatgattccaaagcaaagagtctgactccagagtcaaactctgaacaaacaaaaagacactttgggttagatatcctggggtgaaagcaagcactttgaaagtaagccaagcctgtgtacagatctgaccacctgaggtcacattccctaaaatacttaaacttctcccttttgtttcccatctaagtttttgaacttaagagattttgtaaaacatcacatttttttatcctcacagtaccttcctatggcagatttagcaggaggcgtataaacggggtggaaaaggtacagcagactgtggaatgtatggatcatttatattacattaaaatttttagtttctagtaaataacttaaatgtttttgtagtgaagattctagtagttaatgaaaatttttggtaaattcagttttggtttgttataattgtttttattgtgtgatacatgtttactttaaattgtttttcttttttgtgtgtgtttattttgtgtagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttataggtactctatgcaaaaagattgtgtgttaacttttatgtattccctcatccctctttcttctcttaactgtctctcgaactaaaaagttggctagaaatcaaatttttatgcatttaattgttttaagtgcattatggttaagcattctgtagaagtcttttgaaaagtgctgtttgtcctggggtttaatgaactggattttcttgatttgggacatttttcttaggcatttataaatatagcccaatttataaagttaaatttggccgggtacagtggctcatgcctgtaatcccagcactttgggaggccgaggcgggtagatcacctgaggtcaggagttcgagaccagcctggccaacgtggcgaaaccccatctctactaaaagtacaagaactatctgggcgtggtggcaggcacctgtaatcccggctactctggaggctgaggcaggagaatcgcttgaacctgggaggcagaggttgcagtgagccaagattgagccactgcactccaggctgggcgataagagtgagact

SEQ ID NO: 72743 - DNA, 1044 bp, Homo sapiens
ccacaaattcttagcttccaaaattttggtgatacctcatttcctattctctctagttgcctttgtccatgtagattttttgaggaagcttgggtaaataagtgtattttaaactattatgtttaaatcgaagttccttttatctgttttctaatagaaacatttaaatagcattaagaacttgtagcagtataaacaatatgtttgagaagtactatattgtgaaaatattttcacttttatacagttttttacttatttactgtcttactaatcttcctaagactttttaaagtgaatatttttaaggcagttctagaagaatgaaaactcttatgatatctgtaatagaattgaatacatatttaactactaaatcaatatatttattaatttgtccagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacaggtatgatgtattcttgaaacttaccatatatttctttcttttgatacaattaatttgtttgtttgtttgagatggagtttcggtctcttgcccaggctggagtgcaatggcgtgatcttggttcactgcagcctccacctcccgggttcaagtgattctcctgcctcagcctctcaagtagctgagccaccacacctggctaattttgtatttttggtagagaaggggtttcatcatgttggtcaggctgatctcgaactcctgacctcaggtgatccactaatctcagcctcccaaagttctgggattacagatgtgagccactgtgcctggcctgatacaattaacttgaatgttatatatgtgacttttttggtgtgtgtaacacattattacagtggatggagaagacatcatctggattatacatatttcgcaatgaaagagaggaagaaaaggaagcagcaaaatatgtggaggcccaac

SEQ ID NO: 72744 - DNA, 1816 bp, Homo sapiens
tggggctaagaatgagggttctagggccaacctctactacctatgtggcttgtgcaaattagttgtcccctttgtgcctcagttttacctacaacacagaaacaatgatattacctaccccatggactgttgtgaagattaaatgaattagtacatttactacacatagatctatttctcaaaataatgagcattcagatattagccatctgtaatgtagttggtgatgattatgattattagagtacatttataattggaggatcatttttgccgtagggaaatagaattattaatagtttgaggcacctgagaatattatgtgagaaactgattacattaaccacacccttaagatgagctctaattttgttgtatttgtcctgtttaaagccatctagttacaatagatggaacttttttgttctgattgctttttattccaatatcttaaatggtcacagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcaggtaagtatgtaaatgctttgtttttatcagttttattaacttaaaaaatgaccttactaacaaaatgattataaatccagataaagtataaagttagtttatatcagagaagcaaaatccactactaatgcccacaaagagataatataaaagaggatctgtatttattttgaaacaaacatttaaatgataatcacttcttccattgcatctttctcatctttctccaaacagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtacaaacctttcattgtaatttttcagttttgataagtgcttgttagtttatggaatctccatatgttgaatttttgttttgttttctgtaggtttcagatgaaattttatttcagatttaccagccacgggagccccttcacttcagcaaatttttagatccagactttcagccatcttgttctgaggtggacctaataggatttgtcgtttctgttgtgaaaaaaacaggtaatgcacaatatagttaattttttttattgattcttttaaaaaacattgtcttttaaaatctcttatgattagttggagctaccagttggcaaatttgctagctaactagtgatctgaaagtaagcctctttgaacctctgatttttcatgaaaagcaattctctcaattctatattatttcaagggtaacaagttacatcctagtctgtgtacttaattttatagaaattgtccttaattttattttctgcaatttatgttttcttactatttctggtgtatgtgtttatcccattgtgatgttatattggtgtcctcaatttatttccttagccatacactctacttttcattgtacagggctatttattatctcagagtcaagcttttttttttttttttttttccccgagatggagtctcactctgttgcccaggctggagtgcagtggcgctatctcagcccactgcaagttctgcctcccaggttcacaccattctcctgcctcagcctcccgag

SEQ ID NO: 72745 - DNA, 1049 bp, Homo sapiens
gtatgtgaagtatcactgtggttctagggagtcagacctgtacaaaaagatatacttcatgtcacttcctccttatccttgcagtcccaatcctaatcctcctttttcccccactcacaccctgttcctttagtttctgagtttatccttcctgatttcttttgctcaaatgaacagatacatgtgtattttcttatattcccttcttccttataagaaggggaacatactctagcctttcttttatgcttttcttttttaactcaacactgtcctggagatcagttcatagaaatcgtcctcactctttttttacagctacgtggtacaccattgtttggatgtaccacagtttatccaactctatcctgtatatgagctaataaaagttgcttccaatattttataattataatgtttcagtgagtaaccttgttcataggtgttttcatgaactttatgttcatgtgtattttactattattagaggtctatcttcagagaggagtacaagaaatgggattactgggtgcaaaggtaaatggatatgtgtctttgctaggtattgccaaatttatctccagaaatcttgcacaaatctgtactcctgttagcaatgtgtgcgtatacctgcttccacatgacctcagtaaaagaatgtgttgtcatattggtattgaaattttagcactgtaagcaacaggtcattttggaaaacctgagctttcgccaaattcagctattttgatttgcttttattattagcatataccaaaataaataggcatattagagtttcctttcttgcatcttaaaattcatctaacacatctataataacattcttttcttttttttccattctaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttt

SEQ ID NO: 72746 - DNA, 1033 bp, Homo sapiens
gattcccctaaatcactgatactggttttgtaattttgcatcggcatgtttgacaattggtatcacatttagggtttttcattcttttttggtccaaacttttcatttctgcttttaaaggaaatacttttggaaacataaatatgtgggtttgcaatttataaagcagcttttccacttattttcttagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctggtaagttaatgtaaactcaaggaatattataagaagtatatatggaggccatcgtatattctgttgtatacctagtaaacatggtaaaatgtaattaaacttaattagaaaatgtggttgttatgtggctcctgtaagtatagttatttagaaattttatttattgaagcaagatatgaaactctgggtgcacactttccaaacaggtgctttcatttacatgtgattgaaaagtgttttttgtcatttatttcactgttccatacaattagggttgtttctaagctgtttgtaagctgtttctaagctatttaagtggttaaatcacagtagatgcaaatcaagctaaagtctttaacattggctaatggctgattcttaaatagctaatacttgctaagggtatctatattaactcatttaatcctcataacaaccctatgagataaaacctaagtcctcacttaacattgtcaataggtttttggaaactgattttaagggaagtgatgtataacaaaaccatttttttttctcatcactgttctaacaaaatgatgttgaagatttaaatgacattgctcaaagacctgctatacattgtttgacttaaagtcacagtttccgagaacctatcaattatgttaagtgaggacttgactctattatcctgattttgtagatgaggagactgtg

SEQ ID NO: 72747 - DNA, 1045 bp, Homo sapiens
ctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgattctgcctgctttatttttagcgctatcacaggacccagagcctatgcccttt

SEQ ID NO: 72748 - DNA, 1021 bp, Homo sapiens
ctgtaacttaagtattctgcaagtcttattaatgagacttgttttgtttctaaaacagtttggttttcacatcctaattttgcagtgatccactctagaacaaggaataaaacttgggtttcaaacaggagaacagaaaaaattacaagaatttaaccttttcttttttgaatccttggtacaactgctattgtctgttctcatgtagaacacccattatgttgatagatatgtaatgcgcacacttttttataaattataaataacatccaagctacatgaaacaaaatatgaagcttgagtatatgtgcatattatcccctcaaaagtgacaatttaatgactacaaagtcaacatactgcatcataagggataatggtaaaaatttgtgttatttattcagcaatcatttaatgagaccctattgcccataaagagcatttgccagttctatgaatgatgcaaacagcgaacacaatacaagtcaatattgggtgttcaaagagttacacaaatcagaagccatgggagttgaaaaacagatcacttctacaggggataaagttgatggcatttaatcaatttttatggtttacaaaccaaatatttcaggggtcagctagggaaagaagagacattaaataggccaggaaactattctttagagctctagaaaagttatgtaacccagagccacttctccatagtggtcactcacttaacccaagtgagccaaaaaccctaaagcagggagccagccaagtcaggagggcttgaatctggtcctttgaaccgctcatgtgaaatcaaaggatggtaatttccactttgagctctctgacatttctcccctctaccagcccagacgagtcaagccatccatattgagctggttatgccaccaccctatcaaccaagatacccaggactacctgggcctggaaaatgggagcattattaagtagatcattaggagattattttatgttgtgcttggagatacagaagttagcaaagctg

SEQ ID NO: 72749 - DNA, 1035 bp, Homo sapiens
agaagcagcatctagatcataaatgaatcgcagactgctcaacctctaaagatctttagcctaaatgcaaaaacaccattgacatgtgcagtcccatgcagataaagtgcttttaaatgttccttgatgaagaagcattttagcagaatgttaaatgcatccttttaaaggaccaagtccaagccaagatttagcatttagcattatattagaaaactgacccaaaactaaagtcttcacattaataattccaaagttatcaatttccaagaattaccatttctggcctgaaaactaccatgtccatttccagcctgaaaagattcttttgttcggtctgaaatacctgaaaatagcaggatacataatgaggaactagaaaaacaaagaagtaccttgctaactcttgaacgttgaatttccagcgagtgtcaggttctcggaatataacttcatagttattttcaagtgcctgatttttcaaaagtacataaaacattgaagacatagtatgtatgtttgggaatgtttatgctgccatttaacatttactacaaatcttttcagaattccttttgttttaccagtaatccaatgccttaatttatcacaataaatgcagttgtttcattcccatacttagccactctcataattctccatgataaattttgctcaattttatctagtatgtaggaaatttgtaaaggttctttgttttggacatctttaaaaatagatgactgagctagtttaaaacgtcctgaacaccggtatgaatgaactcagtgacgtctcaaagtcacttatgggatttttgtagatttacttgtcagatgccttgtcctattcctcatgccttcctttagaaagtgggagtaccataggaacataactggtgaaataaaagtgatagtcacatacttcacatcatcttccttccaaaagtagctctccccattatgcaatacaatttgggtcaatgctctgggccccatttccttgagtttagaaaactattataatttccttata

SEQ ID NO: 72750 - DNA, 1060 bp, Homo sapiens
aaagagaacaagacaagaagctgctcaccagcgctccagcacattcttttggtcaaagcgagtcactttgctggcccacattgaagggcgaggaaagtagacttcttgatggaaggaagagcaaagaaaatgtggccactttaaatctagtacagataaagccagtgacacgaaggaagggataagtataaagaagacttgatgaaccagtgctcatagtttccgtatgaatgtctgttattcgacttctttaaagatacgcacatcgaaagtccaaaccttaacctctgatgcaaacaattatacagacaggacaaaaatctaagggtagcactgatgcattttcaggtatgtatattttatatttgtgaacactgtacagttttaaagttattttcatcaatattatttaaataatgaaagttgtgttcagagattaaataatagtgtataatgtatttcccttatcctctgtacactaagttaagcaaccatggtaactgaatccaagattttttttttctttcaggtcccgatttgatatcccttctaaatctggtttcatttgttctcctattaagtctgctacttacaagttttgttttggtttttgaacattttcagacttgaatttttcttttcatatacatacccttatctgctcttgttttcctctttgtggtttatattattgattggaagttaatactttataatatttcctttaaaaagactttaaggcatgagtatccaattcactgtttgttttgttttatttgaatcctatttccttctagaaaacaaaaacagcacataacactactgcccttttaatcacaaaattttaccttagagtaaaagctaaatggctcaggatcactatggggcaagaacaccatccatcatttcctgagacacatctgactgtggcctccatactcttcctaacaaacaggcagacaaaactaagggtgtttttcacctttaaggccaaggatttttttttttttttttttggcctgtatgatcttcctgaatgacttcaaaacttgttttatct

SEQ ID NO: 72751 - DNA, 1087 bp, Homo sapiens
gagaaactcaggggctaatcttgatttcacaacttattcttttgtgtaattctttatttaataatagagaaccatagagatatatttagatatctcttcagccagtcagtcactcactgagaaagtcagacattgcatgtaattttaacttgacgcccagttttttactagggaaattttcaagcatgcaaaagtagatggaataatatactcgatcctcatatacacatgaccagttatcaacatatggccagtcttctctcatgtccttcctatttcattgcatcagtcactccatcagtgtttagtctccctgcttgtctcatcagtgttttcctccagttggtgtgcgtgcaacagggaccaaacaagatccccacattgtatttggttgccatgtcccttaagtctcatttatcctatagtttgccctctcctttttatttccacctgaacttctcccgccacaaccttttaattagaaaatacacaaacctatggaaatgagttgaaaaacagtatattgaacgctgcttacccttcatctatggtcaccagatgttcacattttgccttagtttatgtctctcctatatatatttttggagaacaatatgaaagtaaattgcaggccgggcgcggtggctcacatttgtaatcccagcactttgggaggccaagacgggcggatcacttgaggtcaggagtttgagaccagcctggccaacacggcaaaatcccgtctctactaaaaataacaaacattagccagactggtggtgcacacctttaatcccagctactcaggaggctgaggcatgagaatcacttgaacccaggaggcagaaattgcagtgagccaagaccgtgccactacactccagctccagcctaggtgacagagcgaaactctgtctcaactgtctcaaaaaaaaaaaaaaaaaagataaactccatacatcgcgatactttattcctaaattctttatcaagtatctcttaagaataagaacaattccctgcataaccacaataccattattgcatctaaaaaattaaggcagagtgccctaagcaaggtccttca

SEQ ID NO: 72752 - DNA, 1052 bp, Homo sapiens
aaaatttatcaaacttgagagaagtgctacataccttaaattagaaaaaggatatatatggatggggatgagtggataatataggcatgttttctttcaattagtccaaagagaaggttacatttaattccctaactttgtggaggaatatacaggtataaggactcactggggatgactaaggtgcccactgtaggtgagtcctttattcttcattacatcttttctcctgtccggccctcagtcttacccattatgatagagtaacagctacaaattagatgtgtagttacttgacttggaagcaccttcctattgttgtgatctgtggtccacagtgacagacgtaactattctgagggctgttcattttccaggtagctggaggaggactggcttggaaggttagaaggatgatagaaaatctggaaaagccagtacttcacctaacctagtgggggtggctggggttctgttcacattagttggttattatttaaatgtgtccagaggcaatgctaatgggtacattttgaagtgaatagtaaaatcaaaatttagtgaatcattctagaactaatagttcaggacagtaggtatttcttaactgttctcataaacacctctatgggcaaagtagactcatttcgtctgtccatttaataaaaccaaatacatttttcctcatcttcttgtttctccttattccccatggagacattattgccacttaaaacacacatacacacacacagagcaatattttaaatgtttaaattgacatttgtggccaggcgtggtggctcatgcctataatcccagcattttgggaggccaagttgggtggatcacttgaggtcaggagttcgagaccagcctggccaacatagtgaaaccctgtctctactaaaaacacaaaaaaattagccgtgtgtggtggcacttgcctgtaatcacagctacttgggaggctgaggcaggagaatcacttgagcccaggaggcaaaggttgcagtgagccaacattgtgccactgcactccatcctgggcg

SEQ ID NO: 72753 - DNA, 1033 bp, Homo sapiens
ctaaagctggagtttgtctcagatctcaattagtaaacactatccagactccaatactaggattcatttgagttcttgccttatttgcaaggccactgaccatgagcttggctcgtccaatctagccaaacaaatcgcttcgtagcctctacttatggttttctctttatctctttcaagtacatgccatttccaaatatgaaattctttccctctgcttttctttcaagctacattctttttcccttgtacaaacacggcttataatgcacttccacatgtaaggcattccagagaaaactataacctcaaattctcttctacaatccttttagcactattaatgtcactcataaaatattcataagcttatcatttatattttctatatgcactaattttattttatgttagtcttgtctcccaatttagaaggtaagctagttgatgaatgaggtctatttcctttaaaaagctttctgaagtttaattaacggatgcttgatcattgttgattatgatgacatcatgcactcaaggtaagcgaggcatagaatcttttcacaatagtgtcttgatgcattctggtgcccctctaaggcagtgattgctaatctttttgcatcatagacccctctgaggagccgattaaatctatggacttctccccaaaaaaatggcacaaaataacccccaaaattttacatacaatttcagaatatggaccttggactacgatctcagaactaaaatgtcttcagttatcacttaaagctcccgaaagcaaaagcatttactttgaaaaaaattggtatgtttctttggtgttagtaggcgggtagaaaaattacaacaaataggctgggcgtggtggctcatgcctgtaatcccagcactttgggaggccgaggtgggtggatcatgaggtcaggagttggagaccagctcggccaggatggtgaaaccccatctctattaagaatccaaaaaaaaaaaaaaaaaaaattagccgggcgcagtggcgggcacctgt

SEQ ID NO: 72754 - DNA, 1037 bp, Homo sapiens
cttataccagtctgcatttactacagtccatctatactggcctctttgaactgttcttcagatatgataagcttgtccttgctaaaagctctaactgttatttctgcttggaatgctcttctcgtctactcttcctatgcctagcattttcttaatgtttaggtctcacctgagatgtcactttcactgtagtactagtagttgatgttactactgattcgttggcagtattcctgaaatagaatataggataaatgaggacatgtttattttgttcacagctgtgtccacaaaatctaaacagtgcctgtagtactgtaggagctcattaagtagtcggctgattgatttttgtacctaatggttctattaacaatattgacccccaaatgtattttcttcataaccttctcctctgaactccagtctgtatatttaactgtctacctgacatttccacttctaagcttaaaagctcctccaattgaacctgtgatctctttaaatctgggactccaggatttcctgccacagtgaatggatttaccttttatctatctctgtaagctagaaagttgagagtcttcttcaatgccttctttccccctcatattcaatccatcaaatggattctatggactttgccacctgaatatctcttgaatctgttcctacattttaaactaccatcatttgatggattttcacacagtgagtgtatctatataattaatacccaggtcaggaaatacgatattactagcaccttagaagctccttgtgccctctctctgtcagagtgatctttttaaagggaaaatgtgatcatgcttaatgcctttcagttgcttcccattgctcttagaataaagaccagaaatcataatgtgatatttaagatcctggatgatgttactgtttttcctatgcaacttcatgttttttaaattatttttctcactttctgtattccagccctgataaccacctctcaattccttgaatgtggtatgctgttccctcttgctaaaaaattc

SEQ ID NO: 72755 - DNA, 1212 bp, Homo sapiens
gtggcatgtgcctgtaatcctagctactcaggaggctgaggtaggagaatcgcttgaacctgggtggcagaggttgcagtgagccaagatggtgccatgcactccagcctgagcaacagagtgagactccatctcaaaaaaaaaaaaaaaaaaaattgatagagtttatactatttaatgtttaaatgttttctgtaaattaaacatcaatagacttgataatcatattttaggaacatttttttccattgaattatttacatatactgttgtactgtaaggctttaaattaattttaatattttattattttaattagcatttgaaatgtatagtgttcaataaatggattgctaaattatgttaagttggatttttttaaccctaattaattttcaggcagtatttcctaaaataagtcaatactacttgtaagtggttttacttacttttcttttatgtccacttgttacgtaagtatgttagtagtagacatcatggaaattacataaattttccgaatatttgaagaattaaaggagctttttctctataataggaactttttattcttttatggaattttaaattaattttctgaaagaacagtaaaagagacagttacttaagtttgctttgtaaataacttaaattttacaaggaaaatcttgaagtacagaattcttactgttgggtatttgctttattttgttttagtcaacttaaaaaaattgaagaactgggtcttgtttggtttctcttaattccttaagagtagtttgtgttttttcttcattgttctaaatgttagagttggagtttttgtttagaatagaaaagttggaatttttgtttagaaaagaaatgtcattggttttatgaatagattaagatagttttcaattcaggaaactggtaagcagtacataagggtattgagattataggaatatagttcaatgtaacccttggcagagatgcagttaagacatttatctagaatataagtaaattgaagtatttataggaaatgtgataagagtaatgggctagacattttgaaaattaaaaccagggatcttgttatctttggatcactactgtgtcctaggagctttattctttactaagaatcagtaactgttttattcgatattaggcacagtcttctccctaaaacagtcaacaaacttttgatacgaaggaagcagt

SEQ ID NO: 72756 - DNA, 1696 bp, Homo sapiens
caccatgcccgggtaatttttttgtgtttttaatagagacggggtttcaccttgttagccaggatggtgttgatctcctgacctcgtgatccacccgcctcggcctcccaaagtgctgggattactggcatgagccactgcgcctggccagaaattcttaatgtattatcactctatgcacaagaacaagaagaaggagtagcacaaataactttggaaagagagtctcaacagtaaatagttattctagaagctaagctgtatgtattgaaaagttttgactttttgtatatccaatagaaatttatttaatcattcataatctctttttcttccttctccttctgacaaattctgttctctgaaaaataaccctgttacattccagttgtggtaattgtaataattacacattataattcacttcccagaatggaatatgttaacttcagtaagttctcttaaatttcagtgtggaaaaaaatagatgatttttctgtaggatggacacaggcacagtctgatccctaatctcaaaactagacacaattgcattagcaattggtgagtaactgaagacttcacattgaagtcttggtttggtttttaatatttccatttcctttttttttgtaattgaactactttttgtaaattaatgggaagattgaaatactttgagaggagctattgggtttgcctctcagttttgctagtaactaagggaaaaagaataatgtggtttttcatggttgaaattgtgttttagtagagtccattgaaatatactttattatttggattattttcttattttccagttttaactgttttcagatggtacatgtaaagttaaagttttattcttggtgttaattttcagttggtaattataataattatacagctttcagaatatctcttcattctgaaagaaattctgaagagtaattctgaactcttcagttttttagtgtaacaaaatgaaagaaaatttactcaggaagggattgtgggttctttgttttcctttttttttcttccgtttttcttaatcttagaaatcatatttctttttctttcatagtcttttcttgtgtacgtgttttctttcactctattcattttttgctcagctatcctcctgtaacctcataacattcttaatgaagatgatgggatggtaagtgtctggcaaagcgggagataatatctttttccctcctgtattctactgaactcattgttccttctcagccttacttaatcaagttaaacttatacaccacagctctgcatttagtttcctgaccctgtgggttaggtagaatttagatacgaaaatggctggaaagatttataaaaatctattatgttaatcattggtggggaatccataacatggcatagaacttgaatgtatggatttgagaaaaaatatttacattaacttaattatatgatgatggatgctaattgataagcagtaggttgaaattcactgttacataattcactattatgtcatggttgctggttgcccttaactgaatgattttgaaggaaagctgataactattttgagttaaatttttacaagtggttccttatatggtgcaatgccgctgcaacaaacagtaggaattttgtagcaaaaagtcttaatagtatccatttaaataactgctgcttattt

SEQ ID NO: 72757 - DNA, 1337 bp, Homo sapiens
tctcagcatcccaagtagctgggacttcaagcatgcactgccacacctggcttattttgcattaaaaaaatttttttgtagagatggggtcttgccttgtttcccaaactggtcttgtactcctggcctcaagtgatcctcccaaagtgctgagattacaggcatgagccactgcaccagctttagtgatttttttttttttttttgagacagagtctttctctggatcacccaagctggagtacagtggcatgatgtcagctcactgcaacctccacctcccaggttcaagcgattctcctgcctcagcctcccgagtagctgggattagaggcactcgccaccatacctggataatttttgtatttttagtagagacagtgtttcaccatgttggccaggcaggtctcgaactcctgaccccaggtgatccgcctgccttggcctcccaaagtgctgggtgggattacaggcatgagccaccacaccaggcctagttggtttttttaaagtggaaaaacagttgttttcctaaacattgtggctaattttaattaaaaacagaatggaggaatgaatatgcagtggaaatactaaaatcactgtttaaagtcattgcttggtgtttaaaaatctataaaaatgtgaaatttacaatttttcatcaaaattctattcagacagtcttttttgggggttggggttaagagatgaggtctctttctgttgtatagactggacttgaactggtctcaagtgatcctcctgcctcagcctacctggtagctgggattacaggcacccagccaggtataatgttagtggaatagacccctgctgctatgccctattctaaccatctccatcacaaataattaaagtggatattaatcatatttacctaagatggagtacatcttagttaagtagaatacaacttctagtttggttcagtaagattaaattgtatttatttttttgtttgttccataggtttagtgcagaagttacttttttgtggtaaatgaatttatgattttttatgtttcataattttagtgaaaattcttgtgtggtaattaatttgaacttttgatactgctttttaaccaggtaatctttattttcagtatttatctttgtaaaagataatgttagcttttttatatttttgtctgttttaaaagtaagattatttacaaaagactgaatttttttaattgttggagtgggtgatttaagtatttgaactttgcttatctcttgtctaattaatacagattctggaattttccagttttacgtatagataagttttgaaagtatgatttaagagg

SEQ ID NO: 72758 - DNA, 1429 bp, Homo sapiens
gggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattagcgcagtttgaaaattgtacaaaaggatttcattttgggacaggtgaaacaactcttaggtagactatatgtccctttctttctgtctgtcttcataaacttaggagtaatagtactataaatttagctttttggccgggcacggtggctaacacctgtaatcccagcactttgggaggccgaggtgggcagatcacctgaggtcaggagtttgagacca

SEQ ID NO: 72759 - DNA, 1017 bp, Homo sapiens
aaatgtgatagcaactgtcataaataacttctaaaaagtgatattttacttcaatttttgcaagtcctagaagtccactcaatctttctgtaattcttaaaacagtatttcataatctttaattttgttattaacaaggggatatagtcagcaggctcagtgaataggtagttctatgtgaaaaggatgtaattaacatttttctgtgatatatggaatctttatacctttttaaaatattgataaaaacatttgagtttttaataagtctttttacataaaatgtggacagatgaaatatatattgtttatttacaaaatattatttagaatttgtgtgctttttctctaaaacagttaatctctaagcctgtacattctgcaacaaagatttacaatccttttcttttttgttaggaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaata

SEQ ID NO: 72760 - DNA, 1316 bp, Homo sapiens
ctgcaagctccgcctccccagttgaagcgattctcctgcctcagccacctgagtagctgagattataggtgcctgcccccatgcccagctaatttttgtatttttagtagagacagggtttcaccatgttggccaggctggtctcgaactcctgagctcagcccatctgccgtgctcagcctcccaaagtgctgggattacaggcatgagccaccacgcccagcctcatattgttttgactttccttaaggatagtaatcttaaggaattactattccttgagaatagtaatcaaaatttatccggttaaatagtcttaactgttataaaccatattattttataaagcgtcatttttcttggtcgagcaagtgtatagtattgtcgaaatgaaatttaactgtctgccttctttttactttaagaagtacttctctgggtttttgttttcttcctttcctttgtgtaggccataggaaaaggatacagagtagagtttcatgaacctgaaacttggtggaaatttgatcctgaagaattagaaaagtaagacactcgaatttttattgaatccttaacttttcttctttcttttgtgaattctgacatcctttcacagtttattgaatacaaatgtaggttcaggaaactgagggtaaaatgtgaggaccttttttctctggtttttggctaggccacttctctgcattgtccttctgccttcatctccttctcattttaggtcccatcaactttttactttgtgctttcatgttgctcccacttttctatcttttcaactacaggaccgtagtattataccaagatccttggaatcaatgtgttttggaatttaggttttagcaatttttgaaaggtaatatagtgcatatacatctaatcttaactcccttttcagagtttgggggagcatgttataatcaaacatcttaatatttctgcagcaaatcatgactagtcaattcaagtaaataacaaagaatctgcataatgtaaagtcaattctgagtaagttgttctgccaaatgagtacagatatgggtagagtttgctgccaaatgagtcagggagaactgagttttcgcagcttaaccagatttcagtaattgtggtgagagattgtgaacttctattttcagtcctaactcttccatttgtacctatctttaccttttcccttcatatcactgtgtttcctgactgttattccttttttttttcctttacttttttttttttgagatggagtctcgctctgttgcccaggctggagtgcagtggtgcaatctcagctc

SEQ ID NO: 72761 - DNA, 1439 bp, Homo sapiens
atggtgaaaccctgtctgtactaaaaatgcaaaaattagccaggcatggtggcacatgcttgtaatcccagctactcaggaggctgaggcaggagaatcacttgaacccgggaggcggaggttgcagtgagccaagatcgtgccactgcactccagcctgggcgacagagaccatctaaaaaaaaaaaaaaaaagagtttctgttagcatctgtaattgtgtagatttaagtgtaaagtgatttgaaatctgaaatctttgtaagattattcagctcttgtgctggtctgttcgtgatatactttcaggtaagtatcagaaatccatttaataacctttcctgtgtgatttatttcacttggttatatttatttctgatagtttatttctgatggttatagattttgtaaatggcacctttatgatttcttttattaacagaattctgcttggtcagaatcgtgatggcattgtgttcagcactgatgactattttcaccatcaagatgggtacaggtataatgttaatcaacttggtgatgcccatgactggaaccagaacagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatactggttgtgaatattaaaagtttttctcattgatattgctctacaagaaacctacttaatacattttttagcggacatgggtcaatttctgtttatcattaataggggttcttaacctgggctacacttttgaatttcttggggactttaaaaaaaagcaaaaaaaaaaaaaaaaaaaaaaaaaaaacagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtat

SEQ ID NO: 72762 - DNA, 1059 bp, Homo sapiens
cattaatttacatttggtttgtctgaagtgatttgaactgtaattctgtaagtggaaatagaggtttgtgcaaaagtaatcacagtttttaattggcattttaatggcaaaaactgcaattacgttcacaccaacctatacatacttaaattgttttcttttgatacaagtgattttataaaatacaccactggccctccatatttgttgattccacatcagtgaattcaacgaactttggactgaaagtatttgagaaaaaatattgcatctgtattgaaatgtacagacttttttccttgttatttcctaaacaatacagtataacaactatttacataatattcacattgtagagtattaggtattataaataatccagagatgagttaaagtgtatgggaggatgtgcatagtttatatgcaaacagccatttttatatcaagggcttgagcagcaagtgtggtcctggaaccaatctcccatggatattgagggagagaactgtatatgataccattataagctgagggatggagagatgacacttgtcatcttaatagtttaaacccttcctactatttttttagtgagaggtaagtaagcttgaatcattccaggccaatattcttttactctcaattccttctattaatataccaccttccatcccaccaatcccctcaaaattatacagtgatatccaaatgcctaatggttcaaggagaggagagaaacaacaaaatactctcgttgttgttcttggatccaaatcattatcttgctgcattttccctatcatagcacactcccaatttctttcatgagtcattggtaatgagagttctgagtacttgttaatcttgctgtacttgtcaatttaaggcagtatcgttttcaaaacaaagcttgattatcattgacctgaactgagagttttttatttagtgtttaataatttcatttaacgacttaagttcttaaaaatttaaagtttgattatactttggaggatcacagattgttccataaccttaagcctccaactatttccgact

SEQ ID NO: 72763 - DNA, 1019 bp, Homo sapiens
atgcaagctcaagtctaagacagaagctacttttttttttttttttttagtaatctccgaagtgacatcccatcacctgtatcatattctgttccttagaagctagggactaaatccaagcatactgcaggataagaggatgcaaggttgtgagtaccaggaggcagggatcattggaggcctttggttttggggtcaaggaggtgctttatcttagttctcccactaccatctaacttgccaaaattatttcttctcctggattagtttattatcaaattggcaggcttttatgaggattaaatgaggtcatagatttatgtaaaatgtttgacataaaataggctctcaaaaagatagctattgttttgaaaaaatagaaatcaagtggccaatgagcccagatttgatttttttaaattagatatttgacttactcacatttctaaattttgacattctgagaatccattttagtacctgacttgagagttctgacagtctaagaattttgaaaatactgatgttcttaaataatttatttttgctttagaggcttgataagacattcagatattcctagattcatataggtgtttttttaagtccataaaataaagcttcatggtttgaagtaattcacggaatttgaaaaatatgcataaacagtctatgctgcctgggaggaaaagtcttttcaagttaaacttatttactatagttatgatttatatatttaagaaaatgttctttatagagatttgttcatatgtattgttgacttgttttaatgatataaattggtgtattgctcccccaccttttattttgagaaaatttaaaccgttttttagatacaaaaaatatgattgtcatgtagaatgatattattaacatcttaaaaatcacctgtgccgggcacggtggctcacgcctgtaatcccagcactttaggaggctgaggtgggaggatcacctgaggtcaggagttcaagactagcctggccaacatggtgaaa

SEQ ID NO: 72764 - DNA, 1928 bp, Homo sapiens
tgcagtgactcatgcatgtaatcccaacactttgggaggccagggtggaccagtcacttgagctcaggagtttgagaccagcctgggcaacatagtgagaccctgtctctaaaaaatgaaataaaaatgttagaactataatgatacttgtaatcactgacaagtgcttttatgtttctagtagaagaaaatctttaatttgctacacttgagaatagcatctgacagtgtaactatttaaaaatcttttctgatagaagaaaggagaattggcatatgtttatatttagattctgctaagggctttaaaaatagataacactacgtataattatggcagtgatgaaagcaaatgctacttgagaactgtcctggcctacccttttgagtcagctgttcaaggaaagttggactcagtgttagaaaatttgagtttttcaagttcagttggaggtgagaaaaagagaaaatttgggtattgactcagttatttccctttttcaccttgggcaagttttgctctctgttaatggaataaatgatacttactttttctggaattgggaatcaaatgagatgacccaaggaaaggaattttgaatgtgttgagcactgtgccatgttcataccattgattggcagaaggaacccttttttgatttcttaaaattcaggagtttgaagtgagtaatatctgaattggtgttagaactgttggtggtttattgtattacaagatatttcaaattcctttttttgtttacatttttaaactattgatgcacttgaatatgtttatgcagttgtgaaaaaatagtgtaaagaaagcagtacaaattatcttgagtttatataagatgattcaagatttgtgccggacaaggagaaaaagaaaatttgttgatatctttgggtgaggatggagaggtccaagaaaccattttgcaaatgttttatattactaacaagacaatctaaacctaaataaacatctttttcagagaaaagacactagagaaagatttaatttgtgatatttcaagctagattataaactgtgatctttgtgaatgaattaattcattccagaattaaattttggtctttgtattttgattccttttactttagtgaggattttgtagagaagatgaaatttcacctctataataatagaagttaggagtgaggtctcacaaacatgggctgtcttctagatttgggatataccatcagagacaataaataactgaaatttggaaactggataaaagagtctgctagttaggaccacttgactaagagtgggtatagaagaaacctaaggaagaaaagttagatttgagacaacatattggagtatgttgaaattaaaggtgaataaagtagtggaaattcgatagaatttaaaggagacattgtagtgggagatggtagaggtgattagatataatatgtatatttatttgaaaaatagatatataagaatgaaagttgtatgtagtaccaacaagtaccattcgtattatgattcacaatttacagagtattttcatatataaaaatcttgtgcaatgggttgttttttcattttatagaaggagcagaggctaaaggaagttgaggttaagtgatttggaagttacaaaaactagtaagagctcaaactagcaataaaattatagtatgtttttcccttgccttcactgtaatgcttaatggttgtgtagtcttatacgtgactcctgacttcaaggatcctggtctgtacctctttaggtcaacacgttttgagtgaactggtgttggttatttggaattagatataaagtcatatattctttggtgaggaatggcttcatataggagttcacattcaaaacaagctttgacaaaataatagagtgaaaattggtagatcagagttg

SEQ ID NO: 72765 - DNA, 2158 bp, Homo sapiens
cccaatgcttgaacggcagtatagtcattgttctcagttaacacatcccgagttcccagacagaacgttttttatattaactcatgtagtggtcaggtaaagtaattaaaagccacaaatatggacttgaaagacagctcttcatgcagtacacatgtctgagatgttcgcatctttagggacaataaaatgagtattcaatggtgtatgcaggtcagttcgtgcaacaattaatcttgtatctcatggtgatagcagaaaacctaattaaaatttgtagtgctgaatatgtaggtgaaaattacatgggaacttttatgtgaagatagatttagtctcagaaacttaactgtaaaaacacatcttaagaacattattccttataaataaaatttgtacttaatatacatttacaaatatgtctaacaagatgcactttagactttataaaaattaccaaaatagtgactttttcctcctttttctgatggttttaaaaattgttctcttctcagctggcgtttacttaaaggtatattttaaatgggaaggtagtgtttgtcttggccttttttctttttttcttttctccttgtttcggttaaggctgattttccctatattaacttttcttttacagcagcttttgttactcttgtaggctttgttctctcgtgttatgtctctcccctctccccatattagagagagatgtggtgatgatagtgattgttgttaggagatgtttgtattaagcttatttgtaataagattctaccgagttggctgttggatgaaagttgtttaaattgttctgcagctttgtttaacgaagtaacattttgagcagtaggctttatcaataatttgttaggcctaagataaagtgatactctgtattaggcagggcttgccctggagaggggtgcaatggtagaaaatacccaaaactttgtggggaaggaatatttcgggaagctgtattctttctgctttacctcttgggaaatttagagactgccttagaactaacaggagtgctcagtatgatttggcatacggactcttgaatgacatggactgtatataacgtatattggaaaagaatacatttgtgtttcctctgttagtgttaaagagcaacaagaaaacttaaggatgatctccaactcacttatacatgagaaattaggttcagattttaatttcattgatttatctgaggtcacagtcatattcatgtggtggaactggggcagcccttaagatatcctggaagcttagaagtttccccattgtctttttttgttctattcaggatttagcaatatttattaataaaaattcagggtagtacattaccctccatccccttctcacctttttattcatttaaccaagaataaagttttgtggttagccgtctgtttcagcgtctggtttttaataatttctgtttaggattcagtccatttaggttgtctcagaagatagcctcttgtaggtctctgtctccgggagccgtctttctttatgtaacattacttgacatggcatttatttattctttgtgaaacttctaagagtaatttgggaaagttagtattgacctttgttttgttacaagatatagtgcgtgcatgagtatgcgtgtattttttcatttttaaactcagtttgctacacaagtcatctgtcacttctagttacaataggcgttttacttggttttcgtattcctgttcgggaatgttaaagattccaaaaatacttagtttaaaaacaagcccagtagtttctctgagagtgtatttactttttaagaagctgccaaatggttcgcaattctgactccttggagagtagaggtaagaagccctttcctcacactgttctgttacaaccacttgattctaaccatttcccccattacttgaaaaaggttttagaatcctttctcattaattagttcagaattaagaataaatttgctgtgttgagactgtaattgttttagctggcatgagtgatcgtgcacagtgaaaaaatcatgataataaaacttagatgaataaaatttatttgttcaaatcttaaagcctttgaggtttaaaaagtataatcattgtgttctaataattagacattaataataagt

SEQ ID NO: 72766 - DNA, 1073 bp, Homo sapiens
ttttactgaaaaaaatccatgtataaatgaacctgcacagttcaaacctgtgttgttgttacatattttcaactagctagaagagaggcttttgaatgttcccaacacaaataaatgataaatgtttgaagtgatggatatgttaattaccccgatttgatcattacacattgtatatgttgaagtatcaccatgtaacccacaaacatgtacaattatatgctggttaaaaagcataaaaataaaacccccgaacctactagctgtcacttcccatcaccccttatttctttagtgtttgggataagccaggtcaaatgcttaggttggtgccaaaatgtaagtacacagtaaaaaagcagttataactttttgcagggagactgtgtggcaaagtccatttacatagttttagagaatgcaaaaatgggataattactgaatggatgtttgcatacttccatactgtgcaaggatgtggtgcacagtgctggctagagatacaaagatgaaagatactcaatcaagagatgtatattcaagtgggaggaaagaggctggtataaaaatacttataaaacaagccagagtatagttagtgccttcaggaagggctcaatacaatatttggaattggaaacttgacaaatggagattagtcatgttactctgagagtacaggaactatgaaaaaattcttgaaggagcaaccattttgaccaagtcttagatgatggaaagatgggatttctggctttaatgaagagtaaagaatgcaatgctttttgaagtcttaaactatttgtttttgtttttgtaccctcatgctgctgccagatgattgcctctggaagctattcctacacctttttttgatgtttctaatctgttatgaacctgggggactaaattagtaaataatcttttagtgagagcctgatgtctgtatgaaaaggataccaatatatggtcttacgctgtcgttttgatatagttgcttttttagtttattctgtgggtcttggtttcatccctgttaattggtcttacagaataagtaattcctagataaa

SEQ ID NO: 72767 - DNA, 1022 bp, Homo sapiens
tttctgcttgagctctatctgccctatgctgctgcaaactgggagtgtcctcaggagtaatgctgtacaaatttgaatctcctccactatacttccccttctttcatgatcagatctccagtttctacttgctcttgattgctttcctctgttttcaagtcattctttaaaagtattttttttcccagggtttataattgctatttgtggaaagattatttcagtgagtttgctgaattctattccaccatgtccagaactgttcacactcattttcattcattttaaactgggcgttaaacacagttgctaacttaatacacaccttgttttagaataagatagaaactcagtattgtttcagtcacatacacttgataagaataggttatttgatggaaagctaagagctaatgaatgtttatgaaggctggtgaaagggatagccatatttctactgttgtctcttttcctctttattggcagcaacctgatagacagcagtgggacacatggtaccaggtgatactggaagaaaatatcatttttcagctgtctttgacctttacccctcttgatatttctactctgaggaaaaaatactaaaatgtaattgttggtctcaactgcttctgtctaaaaatagatagggctgttggacatttatctttaaatggttaggtaggaccagctcaagtccaaaagaccctttaggatcattttacaaatatttgtttgtggctctgactttagctaagcagattaaagaaaaggtatattcaagagggaactacattgaattggttttagagatggcacatacatcttttaataagttggttattttgtattgccagcacaagtataagggacagtgcagtttaaatgcatttattaaagttgatttttcttttgaatttgaacattgtccgttttgttttaatgtaaatgtaactgtaagaagttaggttttaatatttgatcttgctcctttaggaagtgaatgcattcaaaacaatgtt

SEQ ID NO: 72768 - DNA, 1024 bp, Homo sapiens
gcatggtagattagtcaaaaaattgtatgttgaaaaaggcagatttttgtttaaacagttggaaaatatgtaaacagggctttcaagttgtatgcttaggggagaatagcataatttacttagcgttttttctcgtaggaaaaactcccattagatttttggttgtccctcaacaagaataagctaaacttcttacactgtttaattattgtgtactgaagagttgtctttatggagggcaccatctgctggttgcaagaggtagcagttgtggcgaagactgccttctgtagttatatcagactctttacaaaatcttatgttttcctttgaattccacctcaaacctggagtgaaatcccagaaggaaaaacagctttaaattaacatggcccagtatggattctagtagtggtttgatttgatttctgtgactgtgaatttttaagaaaaatcaacatgaaactggcagatgccggtctttatttgttgatttggatgcctaaatcaactaaaaaataggattgcttattgttatgattgctcttgctctttagtcagtactttgttttccttttctattcagtgaaaatatcttacatattttttactacagtctcttgtttagttacatctatgaacatttatttatgtctgataatattaaagaatgaccatttcattgatttttcttgtactcagtgtgattaaaagattctcatatatttaattaatgatcattttatttgaactttaaaaaaaaactttagtattagaatattttcttttcttttttctttttgagatgaaatctcgctgtctcacccatgctggagtgcaacggcacgatctcagctcactgcaacctccacctcccaggttcaagtgattctctggcctcagcctcctgagtagttgagactacaggcatgcgccaccatgcccagctaatatttgtatatttagtagagacggggtttcgccatgttgtcctggctggtctcaaactcctgacctcaggtga

SEQ ID NO: 72769 - DNA, 1335 bp, Homo sapiens
ttgacatcctttcttaaataaaaccatgtgactggagtggtttaatgacttaaatggaaaattaaattgtcatcttagggttttctttaggcatatactttttcttctcatgaaaggattagaaatattatttttaaaaaagatggtattcttaaggacatactccttttagtccagttgtacaagtgagaccagaagtttccacaaatattctattggaattcttccaataatgactactacataagggcaatttaatctttaaaaatctggttagcagatattttgggtaaatgaaaaaatattttagtaagtcttttaaatagaagtttactttgtagttttaggagaattgtgttctctcaaatagagactttctgcagaaaaatgaaagtatattcatttgaagttaaccttagcaattaacatgacctttatttcacatgactgtagttttacatggagcatttcattatttgattttttatttttgtatagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggcaagtactgatttaaataactccaagattgaccgatactttgatttatctttctaactaaaatgggagttaaggtatttagatgatttccttggattctttgacattagctacagtaatcttttgctaaacttaatgtttttttttttttttagaacttatttttgaaaaactttctggtcttgaggttaagaagtagattaatacagtgtgtattttttttatatcatgtcatcattagctctgtttctttcattataattttgggggcaattccttttcacttttgaaaatccatattgaagaccatggccattatttaaaacataatacctagtataaacatgagtttataatatataatcctcatttatttaatggaaggtgtgatataaattgttatatttgtgttataaattgtgttatacattgttatgaagaaaatacaggccaggcgcagtggctcaggcctgtaatcccagcactgtgggaggccgaggcaggatgattacttgagttcatgagtttgaggacagcttgggcaacatagcaaggcgttgtctctactttaaaaaaaaaaaaaaaaaaaaaaaggaaattagccttgtgtggtactgtgcacctgtaatccca

SEQ ID NO: 72770 - DNA, 1015 bp, Homo sapiens
aggatgtgcaacctgttttgggcatgcttgttttaaattttgattggtgaaagaatcttaggatgagggaggtagagggcaatatttgtcatttaaaggtggtattgaattgtaagatttgagaatggtcggagacttaaagtagataacatgagctggtccatgtagttgtatacccaggtactagcttgatttctaaatgtgaatttctcatttggagatacttaattggtttaaggaatgattccatttgtttgatagtggctgtggctctcccgtactagatgtcttgttggcattctcatgacgaggaagtctaacttaagactgctactgtacaatttatttatctctcttggggatctttcagtttgcataatcaaggacctatttcagggctttgggggtaacgagaaattctccctaaagaatagctacatatctgttctgtttctaacaggacaatttatgagaagactgtaaaagagctgaaattagggtctttgtgcattattccctagctgaaaaatgttaagtatttggtttttctgatgaatttttgagtcttattctaaatgcctcttttttctttttgggggatagtacttaaaattactgactttgagggtgctttctaaatatttaagagatttcacttcgtcttgattagcggcaaattcgtatatctgtatgtctatatattttgtctacagtagtgttgtatacagattagaaaattgtgatatttgagccttacctttccactttcagttagttattgtcatcagcaaaccccttttatacagttggcttcatgtttaggcagtaattggtgaggttataagtgactgttgtctttccatcgctacatagggtcaatatggcgtgtgtactctttcagcaatccaggaagggttcattcatagagaacatattttccacagtactactatcaaagtaactttttttgttttaagtaacctttttttttaaaaaattgtgttttaggtgcagg

SEQ ID NO: 72771 - DNA, 1061 bp, Homo sapiens
aattgtatagtggtgaagtctgagcttttagtgcccctgtcacctgagaagtgtacattgtacccaatgtgtacacaatgtgttttttgtctcttgttccctctctgccttctgattccctgtagtccattatatcactctgtgtgcctttgtgtacctatagttttgtttccacttataaatgagaacacacagtatttggtttcccattcctgagttacttcacttagaataatggcctccagctccatccaagttgctgcaaaagacattatttcattctttttatcgctgagtagtattccatggtgtatatataccatgttttctttatccactcatcagtcagtggacagttagattggttccatatcttaagcatgctatttttaatcctcattatagtaggtgtgttatattagtggaataagacaagacatacaatataagaggattggaagaaactgaactgaaatatgattgtgcagaaaacacaaaatggtgtacagacaaatttatagaaaatataagaacattctagaaggttgtgagacataaggtacaaaaaccttctagcataatttcaaaaaattttcatttgtagctttaacaaagatgtgaggtacttagaaatttaaccgtaatgtgtatcacctttatgttgaaaattgttataattgactgaaaagcataatagaagacttacatatgttgagagatttactgtttatggaaggggagacttagtatcataatgatgtcaatcttctgcatactgatcaataattcaatcaaaaatagaaaccgaggccaggctcactagctctctctcattatcccagcactttgggaagccgaggcaggggaatcacttgagctcaggagtttgagaccagcctgaacaacatggcaaaaccctgtctctagaaaaattagctgggcaagtgacgcatgtctgtagtcccagtgacttgggaggctgaggtgggaggatcgcttgcagggaggtcaaggctgcagtgagctgtgatcacaccacggcactccagcctgggtgacca

SEQ ID NO: 72772 - DNA, 1030 bp, Homo sapiens
gagtaatctgcttttttacagctgcccaaaactcctttgtccctccccgcctatgggatgcccatcgctgcccacactagaacatagttcattctcttaggatattttgtgttttttggacctgaagtggaacagcttgtatttgtacttaactgaattgattttgggactagatctagagtgactctatctaataagcatttattgaccatttctgtgtggtttacattatgttatgaacaaaataggaagagaatataattatccttacgtggatggaatcttagatccagtaggccagttagtcctaaaaaaagaaaagtggttttgccttctctcttttattccaattgagtcttagttttttcattcatttactcaagtagcattttgaatacaggtaatattttgcttttcatagttagagatatataatatagatattgtttatgtttttcagaatttaaacaagcaagcatatgatttggcaaaggctttactgaagaggacagctcaagctattgagccatatattaccaatgtaagtcttacttgtaattggttgtcagaaggattaaactgaaaatttaaagacttgctagaagcaaaatttcatcagatagtatatagttttaaaaacaacaaatttgtgttgttttaacccttaagtaatatattttctttctccttcttaaaattattcttgctttatattttttggaaggcttgctctcatcctatttgttcttttatcttctttcaaattgcctgagaacttaaacagttttattttggttagcaagatattctgtttgtttctactgatagaaatagagttaaatgtaattagataaaacatatggaacttttcattattcagagacgttgcttacaggtttttggagcttaaattgatttgtacaagaagaagatatgaactaatattaagacctagaaattgaaggcaagtatgaatggcagtagtgatttagtaaaagttgcttatctattgctattcctggggtagatt

SEQ ID NO: 72773 - DNA, 1019 bp, Homo sapiens
ctccacctgcttttcagtttcactcacctccagacaagtaaaggatataaatttgcattcctgagtaaagtaagaaagaaagcctttaataattacttatgcattctcctaaaatttgagggagagtttttcttgtagtatacacaaatttaaagtcagtgtatgaaatatatcatgaaaagatgtactttgaaaactaactacttcataaaacagtaacttaataaattccagcttttgtttctggcttatagccttagagaatcccaagcatacgatgatttggaaaaattaatttaatttgtaagaaattgttttgaagggtaaactttcagaagctgtggaatcaaatctgtaatctatcttaattgctccaagattttcagggaacttccaatactggtttctgcagttttgtaagttacgggtactggctgaaataaattggttggattgagttttttcatcattggcttagtggcacttgaagtgtgtagacctagacttaaaacattctgtaattatccttttcccttgcttcaagtacttctaaatgactatttccatgggccattagagcacactaggtgagctcctcctggtggccatttatttaaactcatattgccaagccagtttttttttttctttttttttggaggggaggggggacacatcttattttgatttctttttctggcataaaaataagaaaagaacgctatactgtattgatatctctactgttattggggaaaatcaatatttgattggggcaattaaaggaaaaaacccacaataaatgatgatacttgttagagttagatgattaggttcgttatactgttctctcaaattttgtatgtttgaaaatgtttataatggaagttaaataaagaaaaaaaggctgaggaaatatttttaacaatcccagaatacatcaaggtaaaaacatttctttatcacttataccttgtgttaatttcctgttgttcttgcttgcagaaatagaatccttc

SEQ ID NO: 72774 - DNA, 1050 bp, Homo sapiens
ctttatgttcaagtctagtattgtgactggctcattcacttatccattgagtcatttgttggaagtgccaaaatcaatagtaaaattgagttcacatccttagggtgcccccaatataatatataaaacaaatttgagttttcacaggtttaaggcctctttttactgttgagctccttttagaaatctggtctgtgtagatgaagtgtcttactgggagactgtagcacatactaatagagctaaaaagtttattcacacagagttttctgttttctgtaggcctggcctctgtcagtgtctgttctgaaaaaccacacatagtttttcaagggtcctgggtaggttttataagagttcattttttattttaactctgaatagaaataaactttaattgtaggaggggcctctaacattggaacaaactttaaagatgtattttcatgaaaggtacttctttaatggaatttgagataattagagcatttatgatgacatttaattttgtgaaaagtatagtgagcatttttatgtaatttttcatttagagttcatgaaagattttctgtggaattggagcatcagggaaattatggcaaagaatgggcagccttattctgaatatctactgcatggttttaaagctgtgattgtgttttattttagagcaatgataatgaggagcgcctacaagttgttaaactactggcaaaaatgtttggggcaaaggattcagaattggcttctcaaaacaagccactttggcagtgctacttgggcaggtatatgattttggtttcccatttaaaagtaatacattattctactgaccgtttttttaagaaacattatccacatttaaactgtgttctctggaatcataaaaatgaaggattttttatgttgaaagttttgaaagttgttaatgactggctatatttatatttactctttttagtctttatcctcagtaatttttaaaagataatacattttaaagctatctcttatggtattatgaccatgaagttaatattattactttaa

SEQ ID NO: 72775 - DNA, 1172 bp, Homo sapiens
tatgcaaactattttctttatgaccttacactccttcctcagtttttagtgcaaggtaatggtagtgagtgactgggctcattcccacccaagccataaatgaagcagtaatgtacatataactttagggatgggtacaggttttacgttccattttcatatactgtatttgaacagtcatatctaaaaataggtatgtgtaatagttataattttagttcataggtaattgtgttacaaggatcttcattaatttttttcaaagaaaactttaaaaagctgttgaattttacacatttaaaaacaatttctactgaaggctaaaaaacagtttataaatttatataaaaaacacattatctgaatataatcttaatattttttccattccaggctaagattagatcttgtatggactgcagtcatttattagttaatagagctctaaatcctgcttatagtctgaaatgatttgataggttattagtggagaccaaatgattttgcctgtagcagatcagaatgagaaaattaagaagcaggtcacactaaaattttaagaggcatagatactaaaaactggattatctatgaaactttatagttgtttttataaaattgaagttgtacttcttgagggtatggcatcagtgcacaaagaattacattatgattttgtaggacttttttttagtacttttagccaggtctgttttcatgatgatgcctatgaaaatgcaaaagaatcttaagagtttctttagttttgacttagaaatttagaacttggcatttgaaaggacctggcatattttaaaactctgtattatacagataaagaaaaaatccctggtacataatgtgcccaacatcctgaagatggtagttgtcttagctgggtgtagggctgttttcagtacatccagctaaatcctgttttggtccccttctatctacagatagaaggttttgatttggaaatctcatttccacttagagcggcaggaacttctttaatatatgttctttacatagttttagaattttatatacaactttagaacattagaaaaaaatcaatacaatgccttctctgcttttttgtagactacttgttgaacggatctttgctcaatacatggttcctcacaatttagaaactacagaacgga

SEQ ID NO: 72776 - DNA, 1027 bp, Homo sapiens
attttctgtttatgttttatacagaaatagtgaggacaaggttgtagaggggagaaatacacatttttttttcctacctgctgtatttcaggcactggaatttgtattatgtataactgcttttgtgctacagtggaaaagtaggttgcagagagatctgattgcccacaaagcttaaaatatttactgtccggccttttacagaaaaagcttggcaaccctggtttaagtgacatttttcctgttttacatatgatgaaataaatcacacaaatgttaagttccacagaatcacacaaggaataagagggagccaggattcgcactcaatcctgcttggttccaaagcttgttctttttccactacacgtagtaaaatacattactctcatatttacttttattacttgtaaacttttctctggaattgaaatacatcctaaaattgttggtttgtcatagcctaattggtggctctttttctcatggcaaaattaattgatggcctcttaaattggatgaaatatggtatttatatcatatttgaaactacctattggaaatcatagtaaatctagacttctctactcagcccaactgtcattcaagagtaaaaatgaaatgtcacttttaagcaaaaatgaagaatttgccagtcctacttgaaaaaattactaaagaataaccttattttggtaagaaaggaaattaaatctataaagaagtaataagattcaagaatttgaaacacttctataaatataaataataaaggactgtaaaaacagtaataatacagttttatttgcaaggggtgggagtgtggattaaaaagtaggtagcatgtaggccaatatttagccagtaccatacaccactgcagtactatgtgagatttcctgagtgtccctggaatcctccttcctatggtcctaccatgcctgggcagggctggaatgtctccaggaccttcttgcactgcccatgattctgactggttgatgcctgatgcctttgtgaaaaattt

SEQ ID NO: 72777 - DNA, 1014 bp, Homo sapiens
aaagtaagcttcaaaatctaggcctttcagaagttagaatgattgagcatataggaaagagagaatacattgactttggagttcagaagtaattttacaaatgactaccccgtttctttgaaaattattttaatcttacaactcttgttagatttttagtcctctggagtatgaacattttgctttcaatgtttatattcttgaactgtgcttatgaaaatttatacaacttagtaactttaaattagtaaagtatagctatttaaaatataacttctaagatgaaaatgtcctaataatgttgcttttgccagtaccattttgacgtgactactataaaggaattcaggtgtcccaaatttgaactggtttatctcctttaaaaaatccaaaggcatttttcaaacatattgttaaagggcagaattaaaatattaaacgatgttctttgtctattaaaagaaaaagagtttcttatatgcctctgtgttactgctttttggcagtgcttcatatgtatggtaatagaggttaatagaagtgtagaataattgaaaacaaactgatgaaaagttttccttgtttttggagatttccttaaaaatttttaattgtgtggctctaatctgtaaccaagtgtttcattaattattctctatatgttaatattatttatatattataatatattaaacgacattataatacaatattgttgcttatatatcgagtacctgtatgatttttttagatttaaatttctgcctgagaacaatacaactattaagagaacatcagagtttttgacatataaaaatattcacttataaataattccagactgtttacaatttaaataagatttgtcttaagaaaaagtatccccattctctcataactaattcttctttttatgtttttgattccatttcatccttcctgctacaacaccttacgctgtcagttattcctttatttctcaaatttataatttctccagttaattcctaccct

SEQ ID NO: 72778 - DNA, 1046 bp, Homo sapiens
atgcatgtatatgtaaactctctgggttggtttaatgataaacagggaaatacaggaaaatagttcttaaaggtaaaacttagtgattaatctcttaaattataagagagcaatgtatgcaacaagctcaaggggacagtaataaaattggcattattcaggttgacatttgatgcctttaaatattacaagggattacttagaagtagccattttagactttccttgcatatatgtcccttcacaatgctcctgttttatatttctagaaaatatatttttatgtgtgaaaattgactgttgaaggtttttcacaatttattttgttaaactaaactgaatttgtacgtaaggattttaaggcaataaaaggaatgaaaaatattgacctattattattttaagaattaaaaaaaattgattttaattgaactttaatttattttaaggaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtggtaaggagagaaaagagctgatgtttgaaaaagcccccaaatcttctttattgtttctctcttttataaaagtaatttatattcattatattaaatttgaaaaatgtcacataaaaatgcagataaactataatttctctatagagacaattgttaatattgtggtgtatgtccttctaaaatgagatattatacatacagttttgtacattttactttttcattaattagtcttttatagtatttaatagctccatagcataccactgaatacatgtactataatttgttgagtagtccactaagttacacatttagattttttcctactttttgattactattaagaagaatataattaatatttttacacagtcttgattctttctttaggataaattctaagaagtacaattgcatgggctaacagctcatttttaaagcctttaatatgctt

SEQ ID NO: 72779 - DNA, 1196 bp, Homo sapiens
gacaagaagtagaagcctctatatttgtaagaggaagactctgaatcagacaaatttattaagtaagtaatctcatgccttctctattcaaggcagtactctttaggtactggcaaagcatagtgtgctgttataccttctgtcagtagtggaataaagatttcaaatcaggagattatattgtagttcagtaagattattgcaaatagagttcacagtattgaaagaggatatctctaagggataatatttcacctaagaggggagaatgggtaagattctgtttttatagaagtgccattcttgccattgaggttaacataaattaagctaatttgatagtaaagaaaagggatatttagaaaatgattgccatctatttatagtgtaatgtggcatcatataaaactgttatgagatgatccttaaaaagccagatggggagcagattgtgaaagcctttaacattgagcttccttttactttatctgttgagaactatggatgattgagatgatggctaggaggagggaagtagaagagatagattgccaaggtgttttaattgtctatggctagtagtggaatggaaaggagacaacgtacttgaaggaaattttaaaacaacaacctaaaaaattgccagcttactgggtatggggaataaaggcaaggaagaaccagaaatattaggattcaagtccaaatgatgtggagaatagtagtaccttgaaaagaatgaaaggaactgtttttgaaggaggtgagagaggttgtgcttcctacttgtacatgacaaacaattaaaaaaaaatcaaggcctatcaagtttaatgtgaaactatgagaatggattaatctgctcagattgtatagaaagaagtaaaaagatcatagacagaactttggaaattttttttacagtagagaaattgtagaaatgtaagaagactaggttattgtaatgttttgagttaagatggaggaggttttcagaagtaaagtatattgtggacaaagagactgaaaaccaggaatagatcttggctttaggaatcagaaggtcatagtgatctagaaggtatgtcaaaacataaacaataagaacaagtagcagttagtgctttataatgtgcctggtgttactctaagaatttatgttttaactaacttctttctccaaggataggaactat

SEQ ID NO: 72780 - DNA, 1032 bp, Homo sapiens
ttttcaatatatattttatattattttatccacattctaaataacttttacccaggcattgcaattttattgctgcctattgtaattagaacctaacactaacactgttagtgcaaataaaagctaagcagaaaattcataaaatcctactttgtaattttagttcaagagccttgagtagagtcaaaacaatttagaaattattctgatgctccttgacataagtacttggacttaatatctttgttttagaaagttggtacttttgtcatattttcatgtattatgttaaagacctgaaggagaaagaaaagtagtatatcctccaaacaccatctttcctgtagatagcagataatttaatttttgtgtatttggggatggcggtattttctgtagtctgtgtttgtatatgagaatggcttcaataaattgatgttaatttataggaaagttttctttttggttgctctccttttcctctcaatagtgatgagagaaacactgatataagttgaatttcagagtagttctttcattttgatattgtatctgctgttttatctttacaagaacctctgtagtcctcctcctatgtagcatttggttggctggcttcctgagaaaaggtttcttagaaatatctggcatttttgaggttccactaatctagggcctggccattaattttgctttttagaaatgattttgttatggaaaattaccaaacttataatctaattgaaaaaactacactatgatatttttgtttataatatgaacaataggctggcaagatgtgcaatggaagtactgagggaagtcttcaagaatagcaagaagtaaactcatttaaatgtatttttgactaaatgaagcctcacattgccctaatttgttgggaaagaacagttttgtattggcctttcaagcctacaattcttggtgttcagtgtgggagaatagagcaccagtttttcattaaaatgtggcattaaaatgtctaatagaaaataaattcacttgtttcaa

SEQ ID NO: 72781 - DNA, 1028 bp, Homo sapiens
ctctcttgaccagaactcattcatatatcctcacttaactgcacaggaagctgcaagtagagtcatccttatgcccaggaaattgaagtggatattggtgagccctagcagtctctaacacattcatgtatatggtcataaactatatgctatgaagtctgtgtcgaaatgtttctttaccctacctctaaactgaattgggcaaaactgaaaatgtttgaacctgatgccttctggacatagataacctatagaagtctaaatgtaatcttgagttactacttatactatgtatatttattgaaatttttgtagtttttataatttgaattacaaaataaattacaaaataaattttgtaatttgaaaatgaaatatgtaaacagtttatttgtatatgtgtagagttgaaatatattttcctcccctcattttcagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcgggtaatttatattttttagattcatgttctttgtaatgttaacttttgcaattttatccaacaaggaaagaagtgaaatgatatcaataatacttccatttgactgccttgattttaggttttcctgtttaaaaaaaataagccttgtctccattataagcaaaaccatcttgaaacatctttttagttgagaataggcatatgacctcaaatacattccttgataaatataaaatataacctgatgctatctatttcagatttacaggggtttaatttttgacaggacatctatttttaaaaatatgcagattggtaaaccagctcatagtatggttgtcatgattatagttttacctttttctatataaacttgttcttttccctacattgggagagaacgaaaaaacattgggagaggaaataatgatt

SEQ ID NO: 72782 - DNA, 1382 bp, Homo sapiens
tgttttcctcaccacacctgctttcattcttcttctgtgcttagcacagtagttgtgtttgatttattagcaagctagaacatatttggtgcctcatctatatataaacatttctccaacaaaatccatagtagaatatgtaaaacctaacaactaaacatacagacagatttcttctacgcttgactaagacttgttttatttagaatgagggaattaaatgacttgagtgacactagcattgacttatgtttaaaagaagaattttgtagtattagacaacatcttccaaagttaaatgagcataatatggtgttcagtattgctaaattattttctgtattagcctgctcagactgctgtaataaaataccaggcttataaacaacagaaatttatatctcacagttctggaggctgggaaatccaagatcagggtgccagcatggttgggttctggtgagggccctctccagggttgcagactgctgacttcttgctgtgtcctcaaatggcagaagcggtaaacaagccctctcaggccactttttaaagacactaatcccattcatgagggtttcccacaatgacctaatcacctccccaaaggctccacctcctaatactatctcctaggtacttgcatttcaacataggaattttgggggacacaaacattcagatcacagcatttttttttaaacttttttgtgccagaatttttaataaaattagatgtacagaagattttgtacaaatattttaaatgctaatctatattcattctactcatttttcagtaaaccagatatgtcacgtctgagacttgctgctgggagtgctattgtgaagctggcacaagaaccctgttaccatgaaatcatcacattagaacaatatcagctatgtgcattagctatcaacgtaaggaaatggctgtgtacaactactttttgaaggtctttgacttttaggaaggaaaaacatccactgtgatacatagattaaaatcttgaatgtgtatggtttgtttgtttctgaaaaatttatgcatgagaaacatttcagagttctgaaactgtcatttgagttttgggttgctaacatagtacagttgatcttcttctttgtaatagttttgttctataatgttatcacaggcattcagttagcagatactgaacagttgctcttaggagaactcacagaatagattccttcaagcccctggccacaacattttcatcatccagttaatatacagccttgttttatgtatgtttctgtttaaagactatttattatatatagttgtctcaactgaactcacagccaacagcactgtaactcatacctgaacaaagcttatctagcacacacat

SEQ ID NO: 72783 - DNA, 1868 bp, Homo sapiens
aagaagtgctcagtatgtgttagccattcttattttggtgcacctttcacattgaagtgtagcttctgtctctgattatgctttagtgtgagctctttacctagtcttactcatctttatatttttagattctaatataggcctggaacatagtaaacagtcaataaatatttgatagaatttaattttaatttcaccagattttgaactgtgttacctttttctttccacgtcggccttgaaatgaatgatgttacacacaaactgttctctgtagatttagcaatagaaataaagaaaatttgatgctttattgacacatatacatgaggttaaaacatccaatttatatttttatttggcaaataggaaatataaatggaaattgtccagaatatgagtcccagtctatgtgtaccccttattaaaccaattaggattaccattctgacctctttaacagaatatgtttatctcagccaacatacaaaaataattgcatttaaactaaatagctgtttctttatttaaaatgccctagaaactcttaagtctgttcctttattctgtttttctgttacaattagtatcaacctcttgttgttccatattgactctgaaaaatactagatgttacttattttgctcagcagcttacaagagagtgttaaacatagggtcatttctaataggaaaaatagatgttttttctctcactcttgaatatagtttgtttgggtcactttttccttacgtattttaaaactgaaatatttgtttttgtagcctcagcccatggtgtatttagtaggccatttcaatattgaacatggtagatgaatgaatagactgtttatcatgtacctcaacacagggtatttcaatatatttttcttcaagtcattgtggtgaactgttgggatgcagaaaatatagtacgaaagaaagagtatgtaagatttggttttctaacctggatatttttgttttgttttgttttttgctttttcttttgtttttttttgtttgtttgtttgttttctttttcagaaaaattattgtctcttctaccagagtatgttgttccatatacaattcaccttttggcacatgacccagattatgtcaaagtacaggatattgaacaacttaaagatgttaaagagtaagactttttccatcccattttcatattttctgaaagttattttttctccttaatgctgataattggatctcaattataattagtttattgatgtatttcatttcttaggtgtttaaggttctttatttgctctcttgtctttcttttttcataccatctctttatattacatttttaatgtagtttcccaaaacttaatcataattattatagttatgtttctgtaccagtctggtgttccttttctattgaagtaattcattaaaatttccattccatttcttatcttttccttcttccttctgaaactgtgtagattttcatgtgaggtcaattaatcatcttgcttttactcatgtagtaagcacatttttctttgcaataactatcttcctctgtagaaggagaatggtctaattttaacaatgggccaaattcgtaactggggaactactcctacttattacttaattggtgattctctaactagagtttaaaatatttgtaattctttcaaagattattgcttaaagactgaaaacactgtacatgcctgggtggggaataggaatatagtgatatttagagaaatctttaagaccagcataattctttaaataagctcgagaccctggtccttgttcagttacaataaaagattaccattgggatttttaatcaactaatttatgatgccttt

SEQ ID NO: 72784 - DNA, 1810 bp, Homo sapiens
gcagttatattctcttgaagagttcccatcaggactgtagtcagtcttgagtatctgaggcctcacttgatccgtggccccactattcctttgacagtctttaactccctgtcatagctgagggttaagataacttcatcctttctaccatttatgtttcccctttaacccgcctccttggaaatctggtgagattttaagaagggatcttataagctcatatctgcattgttgacctgtttttatatgtttgtatgacatattctttttccctgctggtttgtaactgtttcttttttttttttcttcctggagttatattatctaggtttgttatatttatatttagaattattgtatctatatttaacaaaggatgattttcttctatatttcttttttccttttttttttttttagatgtctttggtttgttctggaaatattaatggctaaaaatgaaaataacagtcacgcttttatcagaaagatggtagaaaatattaaacaaacaaaagatgcccaaggaccagatgatgcaaaaatgaatgaagtatgtaattctttgtaaataattatggttccatattgatttaaaaatttaggtgtaaagtatgaaacttctgtagtatttatagatagcatcaaataattttttctattagtaattagaattacgtagaattagcagtaattttattacaagtaaatgagcaaaaccagtagtgtaagctaagatgcttacacagactgttgctttcattagtttgctattcagactggattcatgttctgaaattattcctagtttacagagtctagattgccagcttaagtatctgtgtttttaaaaatatactattgcagaaactgtacactgtgtgtgatgttgccatgaatatcatcatgtcaaagagtactacatacagtttggaatctcctaaagacccggtactaccagctcgtttcttcactcaacctgacaaggtagttactttacaatttgtttgtgtaagttgaaataaaatgtattctcagcactggattgtaggaagatcaggaaggatcatggaaaaattgctgtgagtcttaagaatgtgatttaagatcagaaccagaatatgagtcaaactggaggacacacataaggttcagatattaggatgatctggtgtttatgttcagttttaagacagtcttagagcgcaggtagaaatgtgatcaaagcatgtgaatctgtgaattaatggccattgttcaaaatgggaaggagagtgctgatagagatacagtctgaagttaaaagccctttattgggatttataattggtatgaggaaacaagcagagaacagacactagaacatgcctaagaccctgggaatactacaagagtgttaccaaaccatgctccaaaaactcgagtgtgatataagatgtaaaaagtgtttcccacagtccctcttactcctttataatttatttatttaattcctcgtaatttagctgaacatattgagtaacagagtctggaaataaccactatcctctttttgcttttaaagcaaaatgccagttaagaccttaccagtgtatagagatttggaacaggcctgtaggattgctcagtagctaaaagggctgtcacgttggtgtgagcagagtaataggaatatgtacatgtggtctttcccctgaagggtgttattaaagaagcatgtgttttctgatgcactcttagagctctaacatgttagagctcaaatatgttttgttaatattagagttggcatgaggttggtttaacctta

SEQ ID NO: 72785 - DNA, 1053 bp, Homo sapiens
ggctggagtgcagtggcgcatctcggctcactgcaagctccgcctcctgggttcaagtcattctcctgcctcagcctcctgagtagctgggactacaggtgcctgccaccacgcctggctaattttttgtatttttagtagagacggggtttcactgtgttagccaggatggtctcgatctcctgacctcgtgatacacccgccttggcctcccaaagtgctgggattacaggcgtgagccactgcacccggccaaaaaagcatattcttatgtctttccatggcaagagtctaattatctattttcattgttgattattcatttcatttgttctcactttttatgtaagccgttttctccagataactaagaaattcaactgttatgctgtctgtatagtttttaatttgttcaagtgatatttagtttatacttattactttgcttaaggatagacacatttttcatgatttgtaagtaaatactttgagagagatgttatttatggttctttacacgtaactttcttttggctttaaccaaataaaaagagatgtgcatttctcatttcagcctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggtaagtgcaaaagaaatgccacaatttacatttaaggattccagcaaggctatgagatctgaaataatataatccaaaatgtttcatgtcagtaaatggaaagtaatgtattacttaatttttccatttaacattggtagtcacaagttcatacttatttgcttgctcattttggatgggtgctctgtcttagtctttcattctttagcttgttgggggtaatctgtgttagtacacataaactagtttccaacctcagtgtgtagcaattgtaaaactgttgtattatggtgtatgatacaatggaatacatagtcattaaacatgatgagg

SEQ ID NO: 72786 - DNA, 1530 bp, Homo sapiens
tttctaatggattagatgtgaacagttagggaaagggacgatttaagggtgtatcctgggctttttacctgaataactggagagatggtggtaccgtttactgagatacagaagccttgaggaagaacaggctctgtttgtatgtatgtgttttggggaagtggaaataagaagagtgttcaaataactgttttggctacattaaagatcaggtgcctattagaatttcaagtgaagtgttgagtagacaattggatatgtgagtttagaactcagcgtagctggaccagagattgagatttagagttcaacaacatataaatagttttaaaaactagataaaggtgagaccacccaggacagaggcctggacctttatatgaatgccaactctatgcctggcactgatttaagtgcttggcatacattggtaagtaaaattgattgacacaagattcatgcttatattctaacgggaaggcagtcagtacgtaataaatgtaataattatagtgtgttagagggtgttaaatgctacagagagaagaaaaaatagaatagggtaaggaaccagggcaggttgcagtgtagaccaagctaaactgccaacgagaaaagttttaattggttctatgatctgaccccaaaatagaatttaggttttaaaaagacttagaaaaatattagatttaaatttttgatttttaaaattttctcactatattaaattaaatgagcttcattgcttgttgagttggtaccaaatatggtagaatgaaactgattcatttttgaaaagaacgaaattttttccataaatctgtaaagctacactaggaacagaaaaagcttgtaaggttatttgattgtaataacaattacaaatgtctgtattaaaaggcttgatagttctgaaatggatcacagtgaaaatgaagattacacaatgtcttcacctttgccggggaaaaaaagtgacaagagagacgactctgatcttgtaagggtgagatatttgcattgattttataataatattaatgataattttacttagtaatgtttacactgaaaccagttaacatgactatcaaatttacattttattttattttattttagtggttttaaccacaaacctgagtttataattatcctctatgtaatttaagtatatagaatctgtgcttcttatcaatgtgataagtaatctcaattgttcagatttttggtattagacttgccagttgcatactcaactgcttggtttttgtattgttttcctcatttgcttgtggttttgttgttgttgttgtttttgttaacataggatatttagacttagccttagagaaggggaatggaatgaggacccttaaaacttctttcatttaatttatttcttgagccttttactaaataagctgctgttaaaggtagaaaatgctatagttctcgtcaagtccttgttcagtttttaaatcttaatagaaatgataaaatgataacttgtatgatagacagtttgtg

SEQ ID NO: 72787 - DNA, 1374 bp, Homo sapiens
gtttaccttttgtatcttgcaacctccatttgtaaaataatagttcttttatgatgttgtaagcatgtcatatagttaatattttatgtcttacgcactatgtggtaaaattagaattacttaaattgactatccaaacagatactttagtatagttgtcatttaggaccaagcactgaatttataatgctctttttaatgagatagctcttcactaaaatttataatttagtaagatactgatcttgagaggtttccttttaagacactctagctgaaaagtaagagtgcaaatgtacccttttatcccagataagtttttaaaattaaaaactataataaaagcaaataaatacagttctggtgtatttaagagctgtatattttaggtacatatctaggacaacattagataacagatttttttgtttcattcctcaaaatatgtatactcacaatttcataaccataaattgtgattttttttttcccctagtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagaggtaagcatgtgtaactctaaactgcatctgtttcgttactatattataaatcataatttgatgctatccacatttgggtcttccccaaagcagagcagaatctcctgaatctagtgcaattgaatccacacagtccacaccacagaaaggacgaggaagaccatcaaaaacgccatcaccatcacaaccaaaaaaaaatgtgtaagttgtaaatattacatttcaaaccaatttcaaattattttgcaaaagttcctaaatttgtaaacatacatattgctgtatttaaattccatatatttagccccattacactaggtaagataaaatttttataaacttaccttagtgattgatatctcaataaactatcttgtacatttttacaggtgcaggcaaatcttcataaatgaataccaaatagtatattatttccta

SEQ ID NO: 72788 - DNA, 1425 bp, Homo sapiens
aaatgataatatgtttgaattttaggttattttactgtattgataattgttaagatccaaactcagtaactgctttcccagaaagataatgtaagttcataaatgtgaaatgttttcatttaccacaggaaacataagtagaaagatgattaatctgtttgagttatttttcttgctgtagacattgacttctgttcatttctctttaaaattattagatagaaaagtaaaataatttttttctttcactgttctggggaagtctgtgagcctgtaagggatcaaatgttatagaggtctaaatatgtgatgccagggcagaaagtaaggataaaaagtttcagggaaaggaaagcaaagaaaatcaggaacaaatgagaataaagattagttaaaaatgattactgcatatcttatgcacatatacccattttaattaagcatctggtgactttccttttaaggtacggcggcgaagtgctaaaagggaacggcgatgaacaaatgtaattaataactttctctgtgaaagctttggaaaaatctttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaat

SEQ ID NO: 72789 - DNA, 2248 bp, Homo sapiens
tataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaatacagttgtattattttgtgtatgtaaatcaacatatatatttaaatactaaatggagaaaggcacatttgatgatttttaattttggagcctttgtttcatgaagtggaaacacgtctcagtaactttttccaaaccttttgtttaaacttctcatgcaaaatgttggcggacagagaattctaagtattatttaagttgaataattgcgtaactgaacaaaataaatgtataatataaactttaaaaataagcactaaataaataagttgccagtagcagttttattaattcgttcagcaaacatttattgagtgccttctatgtgccaggcactcaaaaattttactcagttttgcagaggataaagtgtgatcaagatagtgtaagtccctgcttttgtggtactttcattatgttagaggtgggtgaataagaaaaaaaaaattaatatatgatgtcagattgtgaaaaatgcagtgaaaaaaaggaaaagcaggatagaaagtactaatgataggtggagaagttattttatatactttgaaacatacagtttaggattgttatatcttcatgatgaagtgatatggtttataatttaaaatgtcacttggtatctttatgaatatttttaatctactttgcttgatattaatgtagccatatcagttttgtttcagctattgtttgcatgataaaacttttccttttattttcaacatacttacgttctcatggttaaaatgtgtatcatgtaaacattttatacttggattttgttctttcatctgagaatctttgttctttaatagtgtttaagctctagtgtagttacttatatagttgattttaaatctaccattttgctatttattttcttttatgccagtctctcctttattttctcctttcctgcctatttctggctcatttaaagtgctttttattattctatctcttccattagctttttagttaaacctgattgtgttattcttttagaattacagtatttatgtttggcttattatagtctgtgattaatgcttttgccaccatccgaacaatgcaaaaagtttaaaacaattcagctgtatctgcctctctagcctttgtgctaaagttgttgtctattttcagtataaaaatgctacagtatccttgttgaatagtcatgttctcatatttacccatagattttccatttttgctctgttctttttttaagaatcattatgtgctatcatcttagttcatttttcttctttttttt

SEQ ID NO: 72790 - DNA, 1019 bp, Homo sapiens
tgctaaggaaggatggtagaagcctctgctgtagtgacacacggcatacagaaaagtaaactgagtgatggcagacagtaagcaggagcagggccacatcaaggactgtgtctacaactggctcagtctcaattgcaggccaagtcaacattgaaaaattccatcacctgcatttttggtaagctggagatgctggtgcctttgggaatgcagcacagggacaaaatcaaagcgagacaaattgcaccagctgagattgttttttcctcttgagtctggaagagtcccactatctagatgcagcttgcagctacagtcccccaaggcatggtgtaattcaagctaagctgcttctagagaagacggtcttaggagatcttggccgccgtgccaataaagtgactcaagaggctgctcagctgcccccagaggtctattatttttatcaggactgtggaaagtgggagttagtaggtgccagtggaagtgaagtaaggtggggagcctagatgaaaatagaagttcaagatttaaaaagatttaagaagacttactctcatggggcagggccatcagcaccaagaaagcagctggttaagatgcaagtgagttgggcatggtggctcatgctgtaatcccagcacttggaggggccgaggcaggaggatgacttgagtccaggaattcaacaccagccaggccaggatagcaagatcaagtctctacaataataaaattttttttaaaattagctgggcatgatggtacatgcctgtagtcctgcctacttgggaggctgaggcaggaagatcacttgaacccaggagtttgaggctgtagtgagctataatggtaccactgaactccagctttgatgacagagtgagatcctgtccctaaaagaaaaaaaaattaaaaagaagaaaccaaaatagttgaagtaggagaaagaaaatggggttacccagagacctttaaggacggaaggtgagaacaagtcctaaggagtttgatctgta

SEQ ID NO: 72791 - DNA, 1075 bp, Homo sapiens
tggcaaaggaaaacgtgaaatcccgagcagctcattagatgagctgtaagatagaattggttacatttaatttcaaagttctctcacatttctctgtaaagggcttattgcaatatagaattatgaactgggaggttgtcttatcttgggaaaatttaatatttcatcttgtcctttaatgtgcttgccaaggtatttaaagagctgagtaaaaattaggatgactggtattagaatgatgaaaaatgctttaagcactttaaaccactgggtgtaaattcaggaagataaggttaagaagcccgcgtatgctgccacatggtaatgtcaaggttgaaatggacatggtgacattccacagtgcaatgaatgacaaccgagtgcaattagctgcctcgtgtagccaggtctcccaagactcatcagtggcactgatgggggtcatatcaacaccgatagatcagcttgtgccctcacctactgacagcacctcctgccttggaaagttccctcaaggcaggtttcagtgttcctggggtttcatgtgtgtattcctgagtgatcactcccctaatagctttgccatgtctcccttctcttctatgttgaagcctgaggaagaggtgtggggaagggtgaaaatgtccccatctagttcatcttatgctctgtgagccatggggaatgcaggctgctagtgctctcaatgatagaggctgcaaggaagcctctctcttattctccttgcaacctttctgttcctgggatgcagtccatgaagatagacatgggatagtccacaggacaaacactgccagactcaaaatagtcgttctcctctggttctgaggtctgattacctggccaagtggatgcttctgttgccttggttccttaagggggattttttacagttaggctttctgttctgtgaaggcaggggccatacttgtcttgtttaactctatatcactgcagggtgggcaaacaataaatacttgttatcgctctgcctgggactctcaagtcttttggaaaacaggttctcctggggctggccccacaagtttgctgg

SEQ ID NO: 72792 - DNA, 1050 bp, Homo sapiens
atatataggcaacagaatcctattcaggcacaaaaagaatgaaatcttgacatttgcaacttctatcattgttatgtcctgtttaacaaactggttcattttaacaaacgcttatagaatgatgcagcagaaaaggtcctaacagatgaagtttccaagttaattgaggcatgatccatgcccttaaaagtctatagcctagcgggagagttaggctatcagtgacctatgacccaccagatagggaggtcaatgtagtcactggggacatgaaggggtggctgggcatcactggatcattaagtacatggtcaggaatgacaccacttaagtgagtaaagtgatatacccccagccttgggcactgatcatttccttgggtttcagaccttatattagttagggttctctagagaaacagaacaaataggagatatatgtggagatttactatgaggaattagctgacatgattttggagatggagaagtcccatgacctgctgtcaccaagctggagatccaagaaagctgcggttgtaatttggtctgagtctggaagcccgtggaaagccagtgatgtagatcccagtctgaggcaggagaagatggcatgagacatcccagctcaagtagtgagtgaggaaaaaatgggcaaatttctccttcctctgcctttgttttattagggccctcagtggtttgcaagttgctcaaccacattggggagagtaatttacaattgacccttgaacaatgtggaaattggaggcatccacacccctgcacagttgaaaatttgcatgtagactcctccagaactgaactactaacagcctaccattgatcggaagctttaccaataacataaatggacaatcaacaaatattttgtattatatgtatatactgtattcttaaaataaagtaagctagagaaaagaaaatgttaagaaaatcataaggaagagaaaatatatctgctattcatttagtggtgatggatcatcataaaagtcttcatcctcaccacctccacattgagtagact

SEQ ID NO: 72793 - DNA, 1024 bp, Homo sapiens
tgtgaaaacagattaaggtggcaacccactaagtaaatattagtttttcaaagtaagtagattaagttaagttaatggtacaagttgctagagcccaaacagggagttcttgatgttgttgctgtgagaggttgaactacatttttcaattaagtctcccttatggtttggaagtatcagatatgagtcttttacatttaatcagttcttggattaaagttgacactagtctaaggctaaagccacattactttcaagaaataaatgtctttggccctttctgagtcacaagcaagaagccagatcaaagcaggctttattttagctgagcaaacatttacagagcgtgacttctgtactgggcaccgtgcttagcatggcagagcatatggatggatgagactcactctctgatcttaaggatcttacaattgagggagatgaggcatgaacacaaaaaactccaacacaacaaatttggagaatttccatagaaaggttacaaagaaaagtccaaggagggagagatgaagaatgagggcttcatggaggaagtgacaactgaaggctgagatatgtgaggaacacattttgggtacctgctcggcagatagcataagcagaagtcaggagagcccagtgtattcatctggcttgcatgtatggcagacatacaaagtgacaccaaatgacactgaaaaatgacgctggggccataaaggaaggacattgaatattagggcaaggagtgtatgcttgattcattaagcattggggaaccgtcgggtgttgttgagggacttaccagttacagtgttctcagctgtaaagacagaaccaaatatccaacgaacagtcatttgaacagtcatttaaacaataagtacattttattatctcacataattccagagttgggtatcccgcagctcagtgatgccagggctaaagtcagcctctattggctttccctttaaggtcacaatataattgtcacaacttataattatcacatcttcacaaa

SEQ ID NO: 72794 - DNA, 1046 bp, Homo sapiens
gctgcccttcttcctagaaagtgctggggtgggatgcccattctcccccaagttttcccggggcacctggggcccacagagctcagggcctcttgtgacttcacagtggaccttttctgacactagggagtacaaggagtgaggtgggaattgggtaagacctgtgttgttctctagacagtggatctggaactcagccatcctctagtgagagaaaagtgtgtattaaaggagggtccacattttcagagagaagtcttgggtggagatttttttcttccagattttacagttctgtcctcagtcatagctgaggcccgtagaccagaatagttacagttgtattctgcacttgtagctagtgaacagtagccagtcagaaaaaagtatcaatgttctgccaacttctggtgtttgtgaaattttgccagaagcaaaacaggatcaaaaataataaacagacctcctccctggcttcttgactgctatttacataaagagattgatgaactgactctgcttgtgggagtgtgcagggaagggaatttttaaggagaaaaggttaattttggggtccttggttgcaagtgatttgaggttttcttcactaattgggtttccagagacaacctttactatagatggtgttgcttctccattataagcagcctaaactatggataagacaacctgacacatggattacatgcagctataaaacttccacagggaaagaaaatgaaccttgaaaacaaaggaataatatgagccttaagtagaacacttatgttcccagtagagggagagacctaatttgtatggcaagcttgggaaatctgggtacgggaggcctgggttctcgagcacgtttgtcctaacatggtagtcatcgatatttttgttaacctctcatgcctcagtttttgaatctatgaaatgggaatactattagctcctactattctgtaatataattgaggaaaaagtaatcaatgtgaaatcaattcaaatggaaggtgtggtgctcagttctagagtgcctgagg

SEQ ID NO: 72795 - DNA, 1267 bp, Homo sapiens
aggtggacggtagttggtgcaggtagctggctggctgtccgcaggccctgccagctgtgaaagcaggctttcctccctttgaggttgcaaggaaaggcctccctttgggactccattgtccacgaaccacagcaagagaggaagtgattgttttgagccaggaggtccttaagaatccttgcgtggatcagaaggccgccccctccttagtacctctcccagtgtcacactgccccttgctgcttctgtgcatgctccatggagccctctttctgtagggccaaggatgcagtgggcggtccagccatctcagagccttcactgggagctttaggacactttagtcactgcctcatgcctgccccaataagggaacgtggccagactccacagcacagttcctgggcagtgcagggtttaggaccccattcaccaacatgttggctgctggaagatgcttcggggactgggggaagcatgattggaagggcccctgaggtgaccctgaggcaagtctctggaccttgttgcctctgtgtcctctccaggactatctcttgagctgggcagtgaccaccacatggggcagaagaaagttctagagaagaaggtctgatgcctagaaagaaggaaaggacaccactggtgaagcgggagatttaaccttctttgaactcctcccttttttccttacttgaactgtaaagcaagtggtttgctaggtgttctgcccttaaacccatgcacccacatcctcatcagcctgaaagcattctggggaagatgcccagaatctatagcaccttgagagaaggtcactagcaagctaaattagaagtggagattatggatgattccaacactcaatgttgtaagcatacaatgttcattccacattttctctccaacacagtggccacatttagtgtgcacctaagaaataaacagacttttttggtttggacccagaaataaattgtggtaacccagcagttttgactgttgatgtttaaaaacctgtacatgcactgtagacctcaattaataacaattagtaactttccctgttatcatgctaaattgtatattctacatgatggatggtgttagagaaatttttgtggtctagtaaacttttgttgcttcataacttcagaatgcttactgcaaatgtttctttcatagcttctgttatttacgtttgttagtttgttaaatcaatgggtcctcaggaaacaagaagtcattccaggaggcctgccaaggc

SEQ ID NO: 72796 - DNA, 1056 bp, Homo sapiens
ttttcacaaagaacactccaaactcccactctggtttgagtggagtaaagattttattatgtttttaaattttattttttgttgagaaggagcctcatgatgttgcttaggttggtctcgaactcttggcctcaagcaatccttttggcttggcctcccaaaatgctatgattacaggcttgagtcactgtgcctggctgagggaaggggttaatctatgatagcattagttttatcaagtgtaaactgtagatttgggggtgggggggaaccttaagtaatgttttaaattaatcagcttgatcaaatattccaaaacgttgttcatcacattcacccataatgcatggctattatgaaatttcctgtcattcatggtgatttaatcaactgtgacttaatagttaagtgtttgtatgtacattttctatctttttaatggattaatgctaaatatttcaacatttggaagggtaacgcataggcatatctagcttctctagcccactctgcagccccagttttcaatgcttaattcactcagtaaatatatattgagcatttactatgttctgagcactgcattcactactagggatgcagacattaaaaatccacttcctaccctcaggagggtttcaatccaatgtaggaataaaactgttactttgtggggcttaggtgtaactttagaaaagaagagtcagtgtgctccaggcagaagaacacgtgcaaaggcactgaggcagagagtgtggtgcatttaaggaactgccagttcctctatttcttctatgagtatctgacaagtattggtgttgagggtaagaggaagaaagtgtaccagggccttgaggacagtgatgaagatttaagctaaccactgtgactgtttctggaaaacaggaaccagaccctgctagagacatggcaaagattttgctgataattctcaccccattggcatcatgtcatcagtctgtgcagttctggaacttcattgacagtgtgtggtggcctgcatataagactagatagaggggttttgccagatag

SEQ ID NO: 72797 - DNA, 1050 bp, Homo sapiens
tctgctttagagaattctcctaaatcttctctacccatttatcatttagcacatactgctttgtagtgataaaagtcacatatgcacatcttgctggctatgcagtgagctcttgaaattccaggcttgtatctcattcctcattgtgtaagactatatcttattccttcttgtatctacagcccccaaaaaagtacctaccttctaatagattctcaatgatcaccactgaataaaatttgaacccttttgaaattttgcagtgcttagcacaatgcatttctaatagaaggtcttagattaaggtatgggtcagttccagccaacttcagtgctttacttacagtgtttatggattgcctgacctgctgtactctctactaagggaattctcaataactataatataaacctaatcaaaacataattagaaggcaaactactgtaaaaaagccatcatctaatgcattcctaaaagagatttggggattatatctgcaccactggttttctccttcaggataattaaaagttgattgaaagagaattgcttaaaaataaagaaggtgactgtttctttttcagtaccattgtcatgattgaaatgtggatcttgagaaggcacttggctagaagtaaggggcacatcgcaaatgttatgtccaacaggatttaagaaacatttactcatcttcaattagaggttcaaaggtcacttcctcttagagttaaatgtacttcctggcacatcttcattcattccttattcactcattcattcactcactcacttgcttactacttattcgccccctcacttaactcacaggctcattctttcaacaagcaattttctgggcacctacaataaaccaagtgctggtgatttcagcactcataagctagtctagtgtaagagacagacacatataatttcttaagtaaaagggagttttcagaccatcctctttgcttactattctctaaactaaatctggtagtttgctctacttttctgaccaatcatttacacattagtatcatcatata

SEQ ID NO: 72798 - DNA, 1050 bp, Homo sapiens
cacacactggggcctgtcatggggtggggggaggggggaggggggagggatagcattaggagatatacctaatgtaaatgaccagttaatgggtgcagcacagcaatatggcacatgtatacatatgtaacacacctgcacgttgtgcacatgtaccctagaacttaaagtataattaaacaaaaaaataatttaagttttttttaacatatctaatcttgaagtcgctttgagaatttaaacttattattttccaatctgcaatttttaaaagtctcctcgtacttgtataacagagcaatactatggaaaagagtaccttaaaatttaacatatgcaactgttatattctaataacatttggaatttcgcattcatttcatttttaagacttgcctggctcttgccagtagcattctcctacatattttcaccttacccacgcaagagctgcagtttcactgcaaggcgagggcagatgctcagtcaaaatccttgtctgcaacgactcaggcctgttgttctcatgcatccatttactctgtcttccagataggaaggtccagctaatagtgattatctgaagccacgtttattaaagaaaactctgtctgttggaactttaccttatttatcatgtaaaaaaaggatgaaatgctagtttggaaactcattttcagtaaaaaatgtgtatttgcatgtgttatatgcatatatcagtgtatcttgatgggatcatatatcccctgccataatataagttcttgtctttttcagcattgtactccccagattatgcacaagaaagttttctaaattgaaatggaatctatgaccacataagctaggcatgacagaagggagaggcattttatttctaagtctcatttcatcactatcatcacaacaaatttaacattccttattttctgagaaaaataatctatttgatatcccagtataatcatatctttggagaaaagggattctgctcatttttctggagccacacatggctgtgcatttggggagttccctgcagctaggctt

SEQ ID NO: 72799 - DNA, 1023 bp, Homo sapiens
tgtttgggtttctcttttttttttgctgttcaacatctatattattactaatcattactctaatgtgtttctacattcttggttaacagaattatccagacttttctcatttcatcatacaacctttattctactatgtgttgggcagagtagtgggtgctggtgaaatatagataaataaaattgcaaccaggcgcggtggctcacgcctctaatcccagcactttgggaggctgaggcaggcagatcacctgaggtcgggagttccagaccagcctgaccaacatggagaaaccccatctctactaaaaaaaaaaaaaatagaaaaattagccgggcatggggcacatgcctgtaatcccagctattcgggaggcagaggcaggagaatcgtttgaatctgggaggcagaggttgtggcgagctgagatcgcgccactgcactccagtctgggcaacaagagtgaaactccgtctcaaaaaaaaaaaaagattgcacttttgtcttcaagacactcaacatctaattaggcagaagttggataaatgttgatggctattatttgatagatttgaactataatatattgtactgacagaaaaataagtgagtgcctgaatgatgctatttgttctacaaattttcttcaagagcttattaatcatgtcatctttgccacctgaccccagcctttaggacattcctgacatagccatcaaggtgttcatggtctcttctaccctaatgtcaatgtccttttttgctaagccagtagtctcactgtttcttgacttctactcctagagatttggtatcctacatgctactcatatggctcccttcgaacttagtattccctcgtattgcacagtaagagatgagtctggttcgatggttgtgaatgttctccaggaacattcaatttgaggataaaaagaagtatcaaattctgaatcaaactgttctcaactgtctctgaagggaaaatctcatggttgtgctcttaggctgtaactcaaatg

SEQ ID NO: 72800 - DNA, 1046 bp, Homo sapiens
tatgtgtgtgaccatagatgggctattaagttctgaataaatttttctaatctgtaaaatgaggagataatgctcattttaaagaagaataaagagaccaagaagatcctaaaacttgtgtttgctatcttctcctacgtactatggtatgaaagggaaaagtgctcacattacttctctcctctcatccctttcctttctcaagcaacacttggatcaaacgatggaaaatgttattttcatttttcattaacatgggaattctactattcttgtcttttggtgtgtgatgacacgtgcagctcacagggtagaagatttgaggtggaagggctaaaacatggtcgccctatgatcatttctattgttgcatcacaatagaggataagggttaaattcaaccattttttttccaggtttcaaaaaatgtttttgtttttttttttttctgctgtggccagcagaccttgatttctgttgctaggaaacctggaaggtactttttagtcctcatagaaaccatgttttaatgcaatcactttcaatgactctttattggctgttttgcttggtgccaactcaaagaaggttcacatcaaacccttacaaggtgaacctgatcgtgtcaaactgcgctagccctggggactttgtggaagtgcctcaggggtttcttggggataggaaagggtgggagccagggggcaatacccctccccacttcaagcagagcaattctactttgatctgctttaatgttaggctttctttgaagaaaatgctttatgggagggagtatttgaaaagccttgacctaatctaacacacaagaaagctgaatttctgcgaagtgacttgcccaaagttacccagttcccaaacaccaagactgggattaaacctgagtgttctgattccagatctctttctattaccccacacttcctgctcctcctcaccatgcctacctggtccttcctttcaccatgttccggagatccctggcctgactctgtgcccagaactgtgaaggacagtagaccctg

SEQ ID NO: 72801 - DNA, 1068 bp, Homo sapiens
ccacatttagagttcctaaaattccagataacataacattctggcagatgagaaaataataatttttaaaaggattaaaagtacaaaaaataaaacccaaagaaataagacactcttacaattaagtagattaaaataggtagataaaaagccaagtaaaattttgagaaataaaaagcaatcattatattaaaaattaaattgacagattaaataacaaagtcagaactgaagcaggaatttgtgaatggcaaaatagttctgaggatattatgcagagtggactaccaagaaatggtgaagaaatgtggagggtagaatgaaaatcagcaatacatgtcagacagaaatgtcagaaagaaatgataaggatctgagaggcagaaatttctaaaatttatgaaattcataaatgctcagattcatgtagtacaattaatgccaagcataataaaaagaaatttgcatctagacacatgatagtgaaattacagaacaccaaagacaaggagaagatcttaggagaaaccagaaagaaaaagaacaaatattttatcaatagcaaacttctccaaagcaatactggaggctagaaaagaatagaataacttaagaatgctaaaagaggccaggtgcagtggctcatgcctgtaattccagcaatttgggaggccaagacaggcagatcacctgaggtcaggagtttgagaccagcctggccaatatagcaaaaccccgtctttactaaaaaaatacaaatattagctgggcatggtggtgtgtgcctgtaatctcagctatgcaggaggctgaggcaggagaattgctttaatctgggaggcagaggttgcagtgagctgagattgggccactgcactccagcccgagggacagagcaagactttgtctttaaaaaaaaaaaaaagaatgctaaaagaaaatgtctaaaaagctagatctctgtatttaactaaacaataactatgagtacagttgaaatatagaccagtccagacaaaaatatagagagttttctactcacagatctttgcccaaagacataccaaa

SEQ ID NO: 72802 - DNA, 1064 bp, Homo sapiens
taatcctccttcaccttccctcatcatctccttggccattatgtggtagatgcaagaaagacatttgtttctcttctaacacgtttcccatccttgtcttactggtatagttactgagatagaaagattcagatcttcctaagcagtaattaactcattggcattcattatgaatccctttgagatatgagcctgcatttaaaaacaaaaaccaaaaaactcagtctttgtaaattagatcccatgttctgctgtcagcccagtgtgcattatataccggtggaaataatcagtgctctgtccagccctggaaagtgttaaataaatcacacagttttatgagcttacaacaagactcacttggtagcctctttcttacccaataatcttttactaataaaagcactagggatttataaacactacatgtacttttagtgatcttccaaaatatgttaccctccttccttctgaagaaatggcaggttgacacctatctatctaaaaccatttatccagttctcaaaataagcaggtattgtgctgaactaaaaccaaaattgtccggagtattcataaaatcaggtagacatttaagagtatgatttccattttcttttctaaaagcacttagaatagcctcttcatgttcttacattggtaaatcatgtataagagatatggtttcatcttcttggtgattacggaagtgctgagcattccaggtcctaatgctgatgcctatacctcatggtacaagacatgtgaatgcagttatgagctttgggctcaacagtgcgaaactagggaataacctagaagatttgtgtttgtttattttaatcaaatgtctatgatagttatatttgttgaatttgattaattgaaatgtagatttctggagtacaacaacaagatgctattaatatatgctatgattttttactttatttctttaaatatctatgtaaatacaaaagcttctagtattcaaaataccatattcagagatcaggttaaaatattttcatgatatctggtgagcacataaaagtaatttgcgt

SEQ ID NO: 72803 - DNA, 1016 bp, Homo sapiens
ttaccgaacttaaaaaaactattgactcttttatttattgagatggagtctcggtctgttatccaggctggagtgcagtagcccaatttcagctcactgcaacctccgcctcccaggttcctgccattctcctgcctcagcctccggagtagcggggactacaggcccccgccaccacgcccggctaattttttgtatttttagtagagacgaggtttcaccacgttagccactatggtctcgatcccctgacctcatgatccgcccgcctcggcctcccaaagtgttgggattacaggcgtgagccactacgcccggccaaaaactacttactcttttacttaccttactcatcctgacggaaaagataaaataagatcctgtgtgagaaatgttttgtaaactgtgttgcaaacgtcacaatgacgagaacgaaggagggacagaggaagtggagaccctgttactgtggcgagcatttcagggtcaggggcctgtcaaggaagcatccaacaacagaatccagattgctcaaaggtaaagtcctgcttcttatttaagggaagttcttgatcatgttttacctaatgctcccttgttgagtggtgactgaactggagaaaacctgaatcccttgacgttttatgcaatttatgcaataaattttcaaaggagtgcctctgtggcatttttcatattctgaagaagtatttaattaaaaaaaatccaaataaacttttgaccagatgcaacaagacatgcaagaagctatcgagttgaagatagaacataagaaaaaacaatacacagatatttaatcttgttatggtcaagaattaatggctactcttgtacctttaattaagaaataagaccatttaagttatctctcgatgagcagttaaatgacagcaatattttctttcaccagctcccttctcctgccagttgctttgtgctggttaattttgatggaaagacaatgcctaataggattatttcagacaatggaggaa

SEQ ID NO: 72804 - DNA, 1374 bp, Homo sapiens
actgctgcaccctcagattttaggtaggatgtcctttggggttcacctactcaatatgtaggtaggagagaacctgtgtcatgggaatatgccctggggacttacatggaaatataagcccctatcaaggatgagaaaggatatggagcaagaatatggtttgctttttgtggagggagatatggatgcagattggtgctctctgtgaaaagggtacagtgagggtttggagatctcaggggaagtaacaattaacttagtccctgtatatctgataaaggcaaaggaggagagtaggaacatgtggacaaagatttaagaaaatagatgcagtttgattatcatctacgtcttctcttttaagttctctagggcacaaaaagaagactcaacatcttattttccccagtgagagagaaatattatacagtgatgccctcttaggaacagatcaatgagctagctaaaagcatcgagtattctacctctggaggcagatcagacttgaacaaaaatattaaaagttcctgtacatttctacaggaagatcggattttgttaacaacattagacaaataattgccttctatattgttgaacttgttctacctccttttatgtctgataaatccttggctcctagtctgtactataattactttcaactttccaatttaatttgccgcaatcacaggaaactggactgtacacactaacacctgatcccaacagatttttcacatcttacagagcagtgccaatgaagttgtagcggcggagtttaatcccctcccatgcctaagcaagcaggaagcgacattcaggataaagtcctgcggatcgggactgccatttggttacagttgcactggtgttttctctctatgggattggacctgcacccagaccccctttcaactggcaaggataatttgatcccatttttaagcatactgatttacagagagcagagagaaaacccagtctattctggacacttccacacatgtgtaaaagtacaacaaatctacatgaccgtttcattatggaagacattttattttttaaacagtggtgagttttttccttttaagtcagagctgtgcgtgcacgtttgacagtgagctgttattcctaaaggcaggaggttaggcagcatgttagagtttcatattaaacaacaaagagttttaaggagcgtcctcaaattacactcacagtttcaaagttcaagaattgtggctgagcactccttaccttacaatttcgggtccaaagaggtctttaagtttaaagcagtacatcaaatgtgcaggatttattttcttgcatgaaagtctcatctgtcatagcactccactccccgagaagagc

SEQ ID NO: 72805 - DNA, 1070 bp, Homo sapiens
ggcctgaatctcagagttacagaatcctaatctcatggatgatagggtctgttcattagtcagtcctttattttaaaaagttttctaggagattctgatagtcaggtttgggagttcccgctttctagcatttagttttgtatcttgcatgtgctgtcacgtatataagttatacaaaattagtgtcaggcgaatagtaaacttttcagcatatatatatttatatatatatatatatatataaaagatacacaatattttgtgtatctacccatgaaactccaagttttacacatatataaaaaattgggtgtatctactcatgaactgggagtttcatgggtagacacataaaatatttgttacttaaaaagtagtttggttctacctagagcagttcagtttgactagggaaaaatgccttgttcttttttttcaggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacagtaagcatttcactttgaggccctgaaagtaatttatagcggggactttcagtcttggtcatgtatgtccccccaactcagttgcttcctaatgtatgatttaaataagaattccacaggtagtcttggggcacaggatttgagagctactgatatggatctgttataaccagagcaaagccatttatgttagataggaaataagagcaacagagggtttggggtaaaatgtagagggtgagattaatttcagattacctaataagacaatgtcttagctgaaattagaactcaggtttccagacttcatttttctgagagcagtagtggggatggaaagaaagagaatgattttgagaaaaatgttaaacatggtatcaagtgacttggtaaagagtgggcaactgactgactgggaaaggaggcctgcaactctgggaagttgagaggctttctgtgatcttgcccttgccaagatgtccagctgcatacc

SEQ ID NO: 72806 - DNA, 1299 bp, Homo sapiens
gtctattatatactcaccaaactgaaaaattgaaaggcatgataaaacctactgtagatggggaatgttggggaagagtgttgccagtggaaaagtgaattgttaaactgttttatgaagcagactggtcaatacatacacacatacacacacatgtattatattaaagttagaaaacacattcccttcaatccagaaaactgggaatctcttacatagaaatgaaagcagtatatgcaacatatgtacagagatattaattgtggaattgtttgagttcagaaaacaaaatgtccatcagtatgaccagctttgcaacatccatgccataggttggtgtgtgactataacactgtgccaattgtctgagagggattgccaagatatattaagtaggaaaagcaaaacacagagacgtgtatgatttcctttttttaatttttattttttacaagaaacattgacactccatgaaaatacatttgtgtatgtttatttttgtgttaacatgggaaagactgaaaggaacagatcgtttgcaatgatctgtgtttcagatggtatacagatttggtttggggatttctggagataaggaaaagaaaaaagtagtcacaatgaaacaggatgtgtgattgacccaatttatataaaaacatgtttatctgcacattgagaaaagagtgggattaacaaagttaaaacatgaatggtggttatctcaagttttactttgtgtaataaaaggaaaaccaatgaaaatacaaaagagtggggaaataggcaataaataaatgttaaaaatatctttttctttgtccacagactccatctaaaaaaaaaattgaaattagcaccattgcaagtaactaccaccttgaagttaatcctaggtaagttactactatatagaaattaagtatttttaaagaaattggttttgggctttctttttttaaaagattgaaacccttttttgaaataaattgatacgtgtggaagcacagtttataaaacagactaaagtggagctgccctgcttgaaatgggaatcctagagcccttcctgttttgccttctgtgtcaaataatttcaacaatgtatttaccttttctagctctagggagctcattgatgtacacacagtacattgtattgtcagtaaatttttgttaattatgttggctcattcattactgatgagcagtgtgtctaaaaagtttacagtgtttggagtaaatatttcagaaattgactttgggttgccaaatctttctttgtcactctctttgtttaaa

SEQ ID NO: 72807 - DNA, 2150 bp, Homo sapiens
acctccctcctctcctctttctggtcctctcctgccacctgagcgcagtgcccaacttaacaccgcttcttctcactttttaggaccgcgagtaacccagtacccgcggtgaaggttttgggtcgactttagagtttagttaggaggtgaggaggcctcctgttctctggggttctttttctcacacttaattgtccttggtgtcgctctccgaggatgacagccttgcccctggagcctaaattcccccgtgctgctgaaatgtgagaagcgcattagcttccaacttgagcagctggggtgtgatgttttcgaaggagacagaaaatgatgcagttttgcatctgtctttaaatattccaaggccatgatggagagtgttgtgtctgtatccatccccctccatctcagaagcagccgtcccttctttgtaatattgccctgaatatactgatctcttagtcattttttgtgcacacaaggtgtgtgaggacaccaaatcacacaggttgatttctgtggttactttcagtagtgtggcatgtgggtaaagactaaaggaaaggttttaaacgcagccctaggttttggttcctttcatggtaagaaagagttactgcagaagtgtgtatgacttaatgttttgcgctatctacagagaggctcagaagcgtttaagatgtcagggaaagaaatggaaagaaggagaggagaatcatacattgaggataattaacagtagttcatatttagtgctttgtaaatggaggttttgttttgttttgttttgtttttaaatgcagccaagctttttaaacagttttctctgcaatagatctagtctttgacatactgtaaggttgggctttgggaggcaagacataaatcgagagcaatcagttgagtattgtatttggtgtggggtcacaggaatataacaatatgcttacaggggtactttgtaacacccatgcagtcatttttcagctaagcaattatttttacttactctattggaaaactgagagaaagctgcagctacatcagtggtgtcctgagacatgcattagataatgtctacggtttatgaacctcgtaaatgcacagaaaagttgaagctgtttttttccttttgctagtgtgtcaggtcaaaggagattatctgtctttgttatattcattgctgtttaaaacaaaacacctctttttacttttttgtacctttcaaataaatcatcatgaaaagtcagtgtaagtttgagggaatgtcactaagttgatataaccaagttcttttcagaacactactagaaatacagttttcttgagttttaattttaactagctgcaaataagaggtcagtacttgccatttctttttaaaagaagataaatctcaaactgttagtatgttagcaggtaactgtatttctgtaatttaaaggaacacatttttagttgcagttttgatctaaccaatatcatttttaagttagattatattaggctattttagtaagtattcctatgcttacttaatacattttaacctggtaagaggcagtagagctttcacaacctggaaactgatttgaatgtataaccagtttggactctgcagcagtagcaatgtgtgctgaatcagttcttaacagatggggttttttagatatacggtagactaagaaaggaagtgaaatgtttctcttgagataaaaaagaaatttaactcttcagagcaatgaaaatctgacatgaagtttcagtatgcagacgttattttagagaactttaccattaagcttagagtcactagaaataaagtaatactgagatagtatatccccaaatctacctaagattttgtaactgcaatgatatttggaatttaaagagttaggtttaaaatttctttgtatgtatttaaagaatgcaatagatttttaaatagaaacttttggagaaaagaataaatgacaaaaggagctgtttattactaagttgttaattatattaattgtggagtataaattagtcatttgaagtgtaattttcttgaactgtagatttagggctttattgtccaatacactcatgaaaatgtcatatgaaaatttaagtggattctcaaaaatatgtggaagtcatgg

SEQ ID NO: 72808 - DNA, 1054 bp, Homo sapiens
gattttttaaaattttcagttttagtttaacacattaaataaaaatgtaaggtgaaatagtgaaatacctattactgtgccctgaatgacagaaaagaaaggagaactaatgaaacttcaaaaaaaagaggagtttctaccttaaacaatacctttgtctcagtcgcctttgtcagtatatttttctttctttttcctgtttattttttcttcctatgtaaggatactcataaatacttggtttttaggtgctgtttctcacatgccttggccaaagaattaaaagctgggcagagtgaagttttaagcatgcactaaagtgtaggacttcttcaacagagcggtggctgtaatttttctgctttgtttcccaaaggtctagagacctatttttactactaggtggattgtgggagtttggtgaggaatcaccaatgtgatatgatataaaattagtcatttttattagagatgtatgtattttgtataatgatgttatagttgacttaaaacagtgaaatatggaatggataatgttaggaaggtaggtaaattagtttgtgaataaagttacagtcagagtgcattgtcaaggattttgcattgtagctctactaatgaaagaaactgatcgttaacaaagtttggcttctggaggaattatttaaagtggcaatataagagaatttaactacagagaagagattttgttgattgttttcagttgtaaaactggcgtactacctaatctattacttcttttgtaaacacacttaacatatgtttatataagctttatccatatttgaagtaaaagctatgtaagtatcgtgttattgttgcttataacatggaagtttcttttataaacataaatttctagaaaaatatgtttataatagaggattaatatttacttagtgaaagaattcataatttttttggaatggctttcttatgtgtatagtataattctatgattataattatggaatttaattatagacaaattttttatgaataactgaattcatgaaattttttcatgaaattt

SEQ ID NO: 72809 - DNA, 1051 bp, Homo sapiens
atttgtctttgtcttttttcaccctctggtaaggtggtaagtacactttctattgtgtctaagatagccatgttaaacatggatatttaagtagttatatgtatgaaaagaagtgagtgtctgagatgggtgggtagccaaggactctaatgttatagatttctgacggttttggctgcctagcatccattctttctgctgttaacattctcgattttttgatactcttttagggagtcattcttgatttttatggtctggggcttcactggactttatcctgctttcctggaccagacagagaaactgacgtctggcccaacagtaactggtattggttataaaatttagctgcatttctgagacagcttgataacttctttctgaagaaagaaaaaggtgctttcgctggggttgctgaaaatgttagaatgtaagtctagaattgattgcagtctgcaccatgaagtcagattctacttgagaacagagctgttaaagaggcacctaaaaccaagccatacattgctgatggcagctttggatcccctcaagtcagttttatctccagatgtttcagtgcatcattttgccttaagccagtttgagttgggtttctatccatttgtgccccaatattctaaattaaaaaatatttaaatactaatgtttaaattaaatattctaatattctaaattaaaaaatttagaatattctaattttctaaattaaatatttagaaatatttaatttctaatattctaaattaaaaaaattttaaatactttaggtattaaatattacaggacgaagcataagaaaaatgtttacttgtcaaagaacttgatatatttcaagaaagaagaaatatacatgtttaattaatataaaaatactcactttggctaaataagaacataaggcaacagataacatgaaaaggaagtgattaaaaagaaatgaccagctggtcatggtggctcatgcctgtaattccagcactttgggagtctgaggtgggaggattgcttgagccagggagttcaagac

SEQ ID NO: 72810 - DNA, 1052 bp, Homo sapiens
tgatgatctgaggtggaacagtttcatcccaaaaccattccccctgaacccccctattcatggaaaaattgtcttccatgaaactggctcctggtgccaaaaaggttggggatcgctgccctaaagaatatagtatagaactatttacatagcatttacattgtattaggtattatctggagaggagttaaagtatacaggagggtgtgcataggttatgtgcaaatactataccattgtataccaggaacttgggaatctatggattttggtaaccacagggggccctggaaccaatcccccagagatatcaagggacaactgtgtttgtttacttatcagactgcactagaggctctgaatcttttgaggatcagcacattatcttaccttgctattatgagtatttaacatagtatctggcattttgtggtgtttagtgaactttactgtggatattttctctcatctttggtatagttagtttgcttgtttcagtcatattcagcttcggcacaaatcttatctttgcaggctattctgattcttttaatttctacattttcctcttgctttaacatttcagtttttatttttgagtgggggatgattggtgtacctacatgtatgcagttgtcccttggtatccatggaagattggtttcaggacccctcaggataccaaaatccatggatgctcaagtcgtttgtataaaatggcatagtatttgcatataaccaatgaatatcttctcatatacttcaaatcatctccagattacttataatacctaatgcagtgtaaatgctaggtaaatagttgttctgttgcagtgttgagggaagtgacaagaaaaaatgtacatgttcaatacagatgcaaccatctattttttaaaagaaatattttcgatcccctattggttgaatctatggatgtagaactcatggatacagagggtccactgtaaatacatggtttatattttaaaaaaagttttctggatatttgagactggtaaggagtcagagtgtttttggatctggtcaat

SEQ ID NO: 72811 - DNA, 1022 bp, Homo sapiens
ttattttgaagtacacagtacaatattgttaatcatagtcactgtatattttaaccattttaaagtttacagtttggtggcattaagtgatttcacgttgttgttcaaccatcatcaccatccttgtccagaattttttcatcttcccaaactgaaatcctgtgcccattaaatagtaacttccatttctcctctcccaacctcgggtgatccgcccacctcggcctcccaaagtgttgggcttacaggtgtgagccactgcacccagccaaaagtaatttctacaggactcagattctttagttctgtttctttaatatcatgtggaatatatatatatatacacacacacacacatatatatacacacacacatatatacatacatatgtataaacacaaacacatacacacacacatatatatacccaccatagtgatatttatttaaaaattcattttttcccttgcatttgttttgttctcatagtagagctactcttgattctcttatcttgaaacttctatgtattgctccacacctagccctaaccctgtattttcatagtattccatttccttcatctttattacaaagcttaaaataattaaactgggaagacagtcttaaaaggtgagggaggtgaagagactcagcaggccaagccagaattctggcacaggaaaagaaagaccacgaacactcacacatgtataatttttgttttgtcacctaaaaatcgatttgtggacaacaaaactaatttgttatgtatgattaagcctgatgatttcacttccttactgaatattcagcagtgattttatcccaagtcctcctttatctaaagcaaaatacctgtaattcatcttttccttaagagattgtaaacatgttacattaaacaatctgaattttaacattaaaaaaaggtaaagcaaaaacttctatttatctttcatactacctgtctatttataggcttctagagagcatgaccaatatctatttgaacttattt

SEQ ID NO: 72812 - DNA, 1075 bp, Homo sapiens
ttaaaaattatatatgtacctcacattatatttcttttagatagcattgttctaactgaggtaagtcagttgttaggtcttatattggagactttgggagacaaattcatattttacatgattttatgaactataatagtcacttgtcctttatctttggagcaaaaacgattcatttttatttataatgaaattagaggatattcatcagtaagaaggggaggacagattcagattaagttttgactgggggaagtgacaatgggaggagaccctctaatgcctggtaaagtcaggcctgttatatagtaaacatttgatacatattaattttttaaaaattgggtcaggatttgaagaaatagtaataataggatatttcacaccatgaatagagttatagtttaaatgcataggtgtaagtttaggccctggggagactggaggtgcttttggtttttactgcctgcccttgagagtaggagctagaactccgggcatttgtgaaaaatgaataagagaaaaggtggaggaagggatgagagtaagtaaactgagagtgtttggaacttatttctaatttttgcagtctcataaaatttgatttccaagaattgcaatagtttatcaaagtagagttaaatggcttgctaaaactgagaagaaaattcaagttggtctgatacagttcagtattctaagatcaggatcaccatgaatatggatttttccttaactgttttggtagcagcactattatgtcaaacctttctttttctgtaaggatatcctgtcccctcaccacctcctaaaggaattgtttttttccttcctgcaaattgagttacagttttccattaatctgcaataaaaattgaaagtatgttacagaaaaaataccttagaagccaggtcaaatagtattatatgtaataatacagtaactaattatgaagtgctatgtttatttgtcgtgttttttaagagttgaggtttaatgattcttttttttaccaaaatgttacttttcatattgtaagtttctttagagtatctattgctatgaataaaatat

SEQ ID NO: 72813 - DNA, 1143 bp, Homo sapiens
gacacatttctcaaaatgtatctctgttgttaagtgatgaatgactgtattttatcctagaaataatgtttaaccttattagtgatgtgcactctgaaagataaactaatatattttagttactgtatgacaaactgtcactcagtgtgacagctgaacccaattacattgaaaaattatgctgccaaactctgaaataaattgaagatgacctggctggaaaatataggatatagacatttacaacagagatttgaattccaacgaaagaatggttgtagttttggatcggtatgcattttatattttagaaccttaatttattatctgtgtatgtaaaaagattagagcggtattagtgggaagattgtttatgggaataaaatttaataattagatgtgtcacacttgtggcatgttattagttgttaaagagggactctattaatgtagcttattcctgagaaaaaaccacaagtctaataaaagttttgctttatattattatcaggatatgatcagatattaatgtttaacatacactcataagttattaaattatatcattgtccagttttgactcagttattcagtgtgggttactatatttagctcacagatgatctattcttttgctcctagctatttctctgtggcttcccctcctcctgcacgcacccccatataaataccagtctattggatctaaatatgtatattcattttcaatctaacttcatatctggtcacatatccattttatcccacaaacttttattgattacttaccgtatgtaaagctaggcacttcggatacaatgatcaagataaggtctctgccctggagtttatagagttgtagagggtgacaaatatgggcaatgagatgtgtaaattctatcatagaaatcaattagggtattgtgggctacactgaaaaaagaaatctaccaagtaagtcaaggtaagtctttataaaggtgatgaagcttgagttgagttttgaaagatggctagaagctagatctggctacagctgtgtggtccagcatggcggccactagccacacatgtggctagtgagcatttaaaatgtccttagaatataaaatgcacacttaattttgagggctaggtgtaaaa

SEQ ID NO: 72814 - DNA, 1902 bp, Homo sapiens
tatctctttaaaggttctatctccaaatgcaatgccattaggctgtactgtgttccccccaaaattcataatgttgaagtcctcacctttagcatatgaatttttggggggatacagtgcagcccataacagctggtcttaactaagcgaaaataagggtaaaatgagtgatagtgataaaaatgtaaggtcttttattagtaatgctttacttaaattcctgtaaaaatgacagttttctatttgtaaacccattgcttttttactttgaattatttcatccttttccatgcttctactcttttcttcccccccccgatatatttttattctcacatgccttcatctgtgcatccaaaggcactgttgattcagtagtatcagcggaaaagcccaaatagttttgactccagctaattaaaagaaaacacctttaaaaaatatatgctgcaatgtttgtagaaaatctaggtcttacttttctttattaatatcaataataataaaaataataataaacctctgttaagtgcatattaggtaccagggattttgctaaatgctttaccctatgactttggtagttttatagatgagggaactaaaggttaaagaaagtgaaataatttttccaagatttcagagcaaataattgttaaattaagcttcagacacaggcagtacttgctatgcttactgcctgttttttagaattcttaggaatttaacttgcaactgtctcgaatccaagctatactctgattgaaattaagatatggaaataacatcatatgttgatagcttttgtggtaactatcgtgtttactatggcaagcattcagcacactgagctttggatgtttaaatatattgaagctttgattcttgaagtcctcaagaatctgtttgcttacccaggcacaaaatcactcagcatcttcacttggcacataaatgctaattcagtagcatgatatacatggcatgtcataatttgcccctgcctgtctttctagtgacattttattttttctcatagctctacactctttagtcataataaactactacacttattttctggaatttaattattcttatggctccttggggttgctcatgttccttagttccatttaggaaatattttattgattacttactaacgcacaattcaaggtttgtttgtttctgtctgcactattgagagtgatgttggggcccaaaagaccaaaaaggagttgtttacaggtggacttggactgttctgaagagaatctgcagatacctatttgtgttttgctaagtggagcttaaatgacaatgggccacaaggagcagggctacaaagggaagagcagggggagaacgttatctatgtctctgggtccattagtaggtacgtgcttgatcccagctggatcaggttaacactggagcagaattaggaacagagggcaatagaaacagtgagtggggaaaggattattgtggtgactatcactttggtgctccatagcggtgcctagagtagaggacccatcacagaagtgttctagcaatgacttatctaggaaactagctactgtaaacttggttatttgtttatttcttcagacttggtgatacatattatggtcttccattaacattatatggtatatgtcagcagcattcttgtatggttttaaaccctgacagaactataaagaccttttggtgaggagaagcagattagtttaaacatacttgtatttctaggtagttgatgggagcatagcatagggatggtatgcccaactctgaggacagaacaggattgggaagatgattcttatctttaaggatttcaagatctaataagagagactaatgtgtaaattaaaaaatactaaataatgt

SEQ ID NO: 72815 - DNA, 1062 bp, Homo sapiens
ttaatgtaattattaatattgccacaattctggcagttatcattgctgtttattccgtatttattacatctgtttttctttctccttttcctattttatgtctggttttggattaattgaatatttgttatgacttaattttacacatactcttgatttattaactacacttttttttttacatgtttaatggtttttctagagtttatcatatgcatcattaacttagtgctctctaacttaaaagtaatatgctacttcaagtttagggttaagaaccttataaaagtacacatatatttctcccgccatgtcctttgtgctgttgttgttactgtttttatttctacgtgcattatcttaagcccatagtacattgttgttatttttactttagatagttatgttttaaagagatttcaaactgtggaattttttctaaacaagatacttaacattctggtgctcttcagttttttgtgtggatttaaaatttctgtatgttttcttctgtctgatgaagttacttacatttctcatagtaaaagtctatgagcaacaaattctgtcttgtagttggctgcagaagtctttttttgctttcatttatgaaatagattaggatttttacttgttagactaagagaatttaaaagtgtatagtcgtttggccattaacacttcatttttaactcattttacttgtcacttgactactggcagtcaggtatccttactatatctattgttatagacatataaagccattataaaggtggttatacagcttttgaaaaattgcgtgttgctttaaatatatttgaaagatgtattttcaagtaggcactttatgatagtcactccctttgttttcccttccctagagtttttatagactgtatttgtagcagcatttgatatactcttgggtacagttatttctataacacaggaaattgccaatatgaattacttgagagaggaccagtgtaaaagaaataggaagcaaataagtaattttctattttacttgcctttgtttcttagctggggtacagggtc

SEQ ID NO: 72816 - DNA, 1058 bp, Homo sapiens
tattcatatatttatttatggtattgagaagacatggatttaaattctgatgctaacactagctttgggatcttgggctggttatttaatgtatgccaacctcagtttcctcatttgagacacccattgcacagaattttgagaattaaatgaggctatacacataaattactcagcatgtgataaatgttcacaaaatggtgattcttaattatgtttctgcttacatttttatctctgtataatttcatatagctttatctagaagaagatttatgttttagaaattaataactcaagagctttataatatagattgtgcctactttgaaaaataatttgaattggcttacagtgaaagatagcagtatactaaaggaaggaaagcaaaaactagtcaggaagacagaataaagaaaggagataatgaagacaaatatagttatcaaaatttgatccttaatttttaatttcctggaaaccaaggctaaaaggataatatggtggcttacactattcttattgtatattaaaagaaagcatactagttcattaaggtgcttaacattttcccccagattttatgataagaaaaatgtatttctttataaagggacactgtcagtgtaactgatgggagaagtcacctacaggtcagatgcctaaggagatgagaaattatactactgatctcatactatattcttaacttgtttatattttaaagggctttcatacttttttcaatttttatctttgtgtcctgtataagttatattaaatataatttatagtagagctatagtagatcctataaaagtatgcgatcatagaggagggtagtattaattttgaaaagaaatgtttcagatgatctcatcaaggaggtggaagttaagttgggccttgaagacattactaaggtttagagagacaaaagtacgtacatctgtgtgtgtatgtaaatatagttacctatacaaaagaaaaagtgtgagtaaaaacaaggaaatatagaataatgcagtggtcacaaagtagaacatggcagaagtgag

SEQ ID NO: 72817 - DNA, 1056 bp, Homo sapiens
aacttcattcatttttatggctgaataatattccattgtatggactatattattaaaagttattataaatttttaataattaagactgtagtattgggcttctttctttttgtttctgcttattcatattcctttgttcagttacagcaatggtgagaggacaattttctcagaaacttttcttgtctatttgactgttgagggcacaaacaattagtctataacattatgtgttatatatgatatataacacatatatatgtgtttatataatgatatataaacatttagtctataacaccatagtctataacaccactgctgtggtgtggatggctgtaatgggagtccaagaaaaaccatctttgtgggtactgggaggagtttctggattaagtggtatctaaattgatatttgtagatttaatggaagttaacaaatccagagtttgagagggaaccctgtatcatgcatagggagtaacacatacaaaggattttctatgaagtgagggatggtattgtagaaactttccttatggcagtagctgggaattagaaaaaactgaggctgggagttaatttgggctttctgaaaagtgttaccattttagagtttatccaaaataacaaattgcaaagaaatccagcagtttaacaattgttcactttgatttaaataatgaacattgaattattgcgtatgatcctaataatctaagatttcaaatcaagatatttaaagactcactctatacctaaaacatacacaaaaggtacttaaattgctagtatttataaacctcagtgctcttagaagacaacatgtttccaagtcagcattttgtatttcaaaatttttattcagtaaagtttatttactttatgtaaataaaagttactgcagtttaaaaagctcagctgtgatatttattttacacaaattcacttaagactgattcttgagtagcaagcatcattgtggaccacttctctaacagcggtagtaccttttagaattttttgaaggcctggaggaaaagaacaccgttaact

SEQ ID NO: 72818 - DNA, 1007 bp, Homo sapiens
gtagatgtttcatttcttacccataaaaatcattgtttcctcattttactcttcatagagctttataaatatcccctctctttctttctttcttaaatctacacctctgacttcatagcaagtgattaagtgcattttgtagtctatattaggatcctggatctaccgcttacttatgtgtgaccttagtcttgttgcttaacctcacttatcttcagtttctttctatgaggataatgaagcctcactgtagttcttcataggatcgttagagaattgtttaaataatgaaggtcaactctttttacttattatatgctttagttgctaataagcaactcattacaagcaaataaatattttcctaatcttgggatgatattttcattcagcagttagcctctttaacacgaatgtattaaaagttaacaataaaggttataaaaccatctcactgtagaaagcataggcccattacaacatctgtagtaaatatttttactgcttccggcaattaaatcagagagctaaatgatacatagaaaggggcaatgtgtttttggctgcgaaagatgtacactcaggcttcacataacagagcctgattgttagaattacatatattaattgttaattcctttcacagccgactccaccagcacccctgcaatgagcccatctctgctatttacatatgtaattatttggctctaccagactctgctaaagcagttacaactggtttaggagattcatctaaaaaaattctccaatactctacaattcaagtgtataccctttattctacaaatttatacagaggcccataggcataaacctcattatcggcttctattggttcaatcaataagtgtccgtattgttgattttccaaccttttgtttttatatagtttatttctcgagaaccttttctgagttaccaatcactagtgtacaagattcacagtagtgacagactgaagtcagttgggctcataataatga

SEQ ID NO: 72819 - DNA, 1073 bp, Homo sapiens
tcaggtttggactgctggtatcagtgattcccctctggctagggctggttgagatgccttcttgtgggtggacatcagcttagtttggtcaggttttcctttatgctatagcaagatggccccaggttcagtgcctcacaattgctctgttctcccttcaccagcacccagagatgctcttggcaccaagccatgctgctggagtcagggaggggtggcgtcagagactcagaactgttttctatcttttcagtgtctctttcagtgatacgaggttaaaaccaggttctgtgggtgctcacatgatttttagctcttatgaagaagcttttttctgtgtagttgtttgttaacttagtgtccttgcggtagggttagagggacgatctgtggagttttctgttctgccatcttgcctcacctccctcctaaaaaatattcttatatgagattgtaatgtttatatgaacttgcatgaagacagaattcttgtgtttggatcctgagtctcttacccattttgtaacattcttcaacatacttttaactctgtgcctatgattccttatctgtaaaatgaagataataatagtgtcataatagatgtaaaacatgtaaaacaatactaaatgccatgtaaggttaagtggtggtattattactatttatcctatttacatcatattctgtggtcatctgtcagtatttgtgaatacctttcagtgacaggaaattaattttacttcttgatcctaattctactccctgtctgttcctaatcttgttttgcctttgcttcctcttttctcatctactcatattttatgtcttccttcatgctttatataacttttagccaccttcaatgttttttggaataaagtaatgtatgcatacatacatatacatctttgttcctagaatttagcactgttagtgcatggtttttatcttggacattcatatattctagttccagaacagtaacttctagaacttaataatttattaaggaatcaatgacttcaaatttgtcagacgttgtatatgattattattttattcctaaatct

SEQ ID NO: 72820 - DNA, 1037 bp, Homo sapiens
ctgtatcatttatcaaacttgactctgaccaagtttttttttctttttctttttaatttctaagctattttcaaaggtataccagaattagagagcaggttgttatttaaaatgtgaactttgtgtaaatgtgttctgtatttgctgattgcaaatggtccttaaagtctacttggtggtaggcttttgttggcaattaatttgtttttaagtatttctgagattttagattgaaatactaaaagctgtcatagtcttttatttcctagtttaaatttcttatatttacttataactaaccttttatatttttgtttagtttttatttgacacatattaaactgcttctactgtacagggaaataagttttatttttataagaatgtttaatagccattaggtgtttagttctttttatcagaggatattatactattctcagttgtctttgcagttttcgtactagcaaaggagttggttactctgctcattttgttggcaactgtttaatagtcacatcattgaagtccaaaggaaaaggttttcagcattgtgtgaaatatgattttcaaccacgcaaggtaggtaaaagtaaatatttttataactcacctgttatgacagaattcttaactctccttttatgagctctgtagtattctctttcacgggttttcctatgcttttaattgttttctcttatccttgtctgcatttcctttttacttttatgtctaatttttgtcttctgtaagatcagtgttttgatatcttgtggtgtatttctcttacactctctcattatctcagtctgatctgttttatggcattctttcaatagatacttattatctactgagtattggataccattgtaggcactagggattaataaatatttgcctttttttaaaaaagttaaatgttaaacccccagattaagcaatgcacagacacattttttttgtgggagattaacctaatcctagtagttctgaatattgtttcctgagattgaaggttttgttaatttgtg

SEQ ID NO: 72821 - DNA, 1016 bp, Homo sapiens
tcattaaaaataatgcatttttctttattacttttaaaaatagagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataaggtagtaataactgtaattttataaattctatggagagttttagatgtaaaatgtggtgtaatatcatttttagtgaaaatctttaatacggtttaagagtcatttctattttttggaatgtagtcaagttttattatatgtttctttttggttcaaagatgcttcttaaccattttataaacttttattcttcagaatattttctaatattcatggcatgccttttgttaacaattctgaaataatagatcttataaaactgttttgcttaatgtagtatttaaaatacaaaaatttgaaatatacatattacttaatgaacataataaagaacttgttaatattactggtaacttggaaagaagagttaaagatttagaaggaaactaagataatatatttcatgggcctaaaattattcaattttagcttatagttttgctttaattgcactaagtgaggaagtaggtacagtagtgagtatactaatttagcaaaactaattaatgtaatttatcatattctttttgttttttaaactttaaaaacaaagactctaggtaagatagagcgtgcacatatatgagttagttttaagtgtgtagtacatctggctaggggagtatataagggttctatttaaatcacattgggaattgtaaagtctcaaactacttcgagctgaaagagaattacacattatagtcaaagtgtttataattctgaaggagtacttgtcttgtatggaagtgtggttttttattgaactcaatttaaataattaatgtgaagattgtgtaatggaaaggagtagtaaatattaaaa

SEQ ID NO: 72822 - DNA, 1054 bp, Homo sapiens
attggtagcttgaacttgaaatcagattattattaatatgatagaaatcagaagtacataaatgctcaaaatcaggacctcatccctccactctgcagataattcctttaccagcataccaatggttgacgggtttccctgtcaggctactgtcagtgttcaatttcttgaccaaagaagtgtttatacaggtgttcatttcatgataattcgttaagttgttcatgtatgttttctgtacattggcaatattttacaatgaaaagtttttttaaagtaataccaagtgtcaataggaggggaagagtactttgtgcatcttggtggcagtggggcaataaaaggtggagagcagtctgggaaatagggaagatatttcttttattataataggcgggatggattttttggataataacttgcttgcagatataataatcttcatgtaaatattaagtgaataagcagatgctatacattatacatgaagggattatgcttttaaaacttgtaaagcagtagataaatactggttgctacaagaaaggcttaatgttacaggatttttatgaatctagcttcattttttaaaagtattctgtattgtatattatgcatattagaatatattatattttcatttttattagtaattaaatattttgaaattactttaaaatttgtacgttatgatagaactgatatgcacattttaatattttatactcattttcacttattgacgcagcataaatgcccactataatatgtattttctgtatacaagtgacatagaagaaataggctgcaaaacaaataattgcaataaaacagagtgtcattttttctgtgctttgttaaataatgtgtggggtgaaaatggagagagtccttaaatgaagacaagtttaattgagagtggaagacatattgggaaacctattaatgtaataaaaacagaaaaaaaagcattaatataaatacttggggattatacatttataaatggatattaatatataacaactttttaaaaagttcttttttccacaaa

SEQ ID NO: 72823 - DNA, 2007 bp, Homo sapiens
aacctgggcaacaagagtgaaactccgtcttgaaagaaagaaagaaaaaagtccctttagaagagatgtttcttttggtttggactgcattgacatttcttttgcaggttcattgtatatctatattttgcaattattatttaaattgttttctaaatgaagttcaaattcttcatttttcagatcttgacagaacaagtatgtactcaggtcgtacacaaaccacatccagagccagattctacagtgaaaattcagaatccaagtgagcaaatggcagttctttactgtattgtggtaggcgcatggcaacatatgagactaaatcaaaacttttcctaaccccttaaatcattatggtgtttacctagttcatgacagttttaactcaccttttatagtgttaagtatttatttgaaagttggtaatactttttgagttgaacataggatatggttacaaatctacaagttttttttctttgtttacagtgattcttaaagtggtggcaactttgttaaaaaactctacaccaagtgcagagctgatggaagttcgtcgtttatttttatctgatatgataaaacttttcagtaacagccgtgaaaatagaaggtaagcagtttggatactgtaacaacactttattccataattaatattttctctcttttagattttcaattcatttcaaatcttttccatattgctaaatacttttaatcatcagaaaaggcattttatgtttctttgacataatctgtattcggtattcttctatttatttttatattatttttattttgttacgtggatattatattttaattgtatatatgaatatacatataaacaaactcttatttagaatgtaatatcccttttagtggtacctatctatcaccaatggaactttcagttgtaattgtgttggatttccccattttcatctatgctttccaccccatatttcttatggccgaatgttgtgcatttttaagctagttagcttgaacatggggtaaagtctgaggccatgaactctggggtagtcattgcctgagtctataatttaacaaatattgattgagtgcctactgtgttcagtgtaagactttgtgctacacaagatagtcttagtacacagtctcagtacattccagtgggaaaccataaagcaatgattaatgtataatgtgttaagtacattgtgagtgctaaaggtggtgagaaagtagagaagcaataagtaaatctgactgtgaaagttaggaaaatgattttgaatgataattaggatttttcctggtagagaaataagagaaagtcattccaagtatagaatatataacgtgcagcatgactgtacaccttgctttactgaggtcagatcatattttcactattttatttatcaaagtttcaaaatagtaaattctaacttaatttggatatttttaatgagatcaaatttttttctccctagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtaacacgggatttaacattttaacatcatcagagttattgcagtggattaaatggctacaaacatgcatctggtgccatcttgtgggcatcttagattttgacagattcctgtatctcagttttgtatttttccctcattgttcatagactgttagaacttgaaagtggcttatagatgaattaattcaaaccccaaatttataaatcaggagttttatacccaaagctgacatacatctgttttatagcaaatctgggaactttaatctgagccacttgctctttcaactggttcttggaagaatattttatgaaatagtctctg

SEQ ID NO: 72824 - DNA, 1049 bp, Homo sapiens
tatgtacaaaatgccttaatgttttctttacttattcctaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactac

SEQ ID NO: 72825 - DNA, 1109 bp, Homo sapiens
cctcttttcttcttttttttaaaggaagcccgtcaagaaatttcccccttatatctcgtgagccagcaggatcacatcctctttcaaaatcaatcatcagaaaaagaaaatgggattataatgactggcttttagagactaatactggttaattaactagtaactagggttaggctagtctttcctatacccagtcaagctcaataataaaacaaaatataaaatgtgtgttagcagggaaaaagttatgactgttgtggaagaagtcaataaagtctgccatagaaagattttacttttgattttatttgatcaatttgttcttagactactcatatactttcattgctaattgttatatgataaattacctagagatggtaactgaggaaacctaaataccatgaaatacattgctattaacatgaagaccaatgtatggagataaattatgtaatttgataattataatatcagtagcctccaagtgagtgatactcagctttttttccaaccacctactctgtgtttttgttttctttaatgggctctcatgaaattacccaggtagaatttaatgtaatttaaattttttaaaggtaacactttatttttaggacagagagaaacatcttgaaatttaagatacacagtgatagataataattcacaactctaaaagggtgagaattattgactcaattttgaccatgaagtaatttcttttttttaatcttatttttttcccattaaaaaacagttcaggctaggtgtggtggctcacacctataatcccagcactttgggaggccaaggcgggaggatagctggagctcaggagttcgagaccagggcaagaccctgtttttacaaacattaactaggcgtggtggtgtccacctgtagtcccagctactcgggaatctcctgggcccagggaggttgaggatgcactaagccatgatcccaccactacactctagcctgggtgacagcagagatcctttctcaaaaaaaaaaaaaaaattatattcttgactgacaccaaacgaaagcagggtatttttttgacatctacattgtatgttttgtatgagaacactgtacta

SEQ ID NO: 72826 - DNA, 1019 bp, Homo sapiens
ttcttcagctggctggtggtatatgggtattttgttttatttttaactatatgtatattttgtaggtactttcactactgtatttcataattttgaaaattattgatctagttgattttaagattaatagtttatgaagcaaggggaaagaaagggaagaagaaataaacttgcaactttttccaggatatcaaagtcaacaatttatattaacaatatgtttttgaatttttaaatagtttgttgtgttgctgtgagaaactgtttagaatgtcggcaaagacagagagacaggggaaataaatcttcccatggaagcagtaaacctcaggaagttcctcaaagtgtgactgctacagcagcttcgaaggtaagtaaactttttttcttggccaaatataatttacctgaaaaaaatcttttttaagttgatgagaacaaagtgccatggtattgctcagtgatagagagcaaggacattgtcattaggcagctctaggctgcttaacaattttgttaccaagattacttaacttctctgagatttgtgtgttttggttattaaatgaagttactaacaatttctacttaataaagttcttacaaatattataattagcactaaaaactgttatttctatttttaatagtcatatattttcacagaatttaatgtatgaataattctccttttaaatgggtaggcataatagtcaacaaaaactcactgaatgcccattcaatgaatggagtattttgaaatatactattagttttctttctaaattagctttctttatcatatgcttaactggcccttggcgtcacatccagtttcattaacatgctttttgaggttctgtgcctggtccttgcttacttctccagcagcagctctcagccctttacccttgcttgtgctgttttagtcataccatagacttcattctgttcatcaaaagaagctatttcccctaacttctcagacttttatatgatttcctttccataaagtattc

SEQ ID NO: 72827 - DNA, 1009 bp, Homo sapiens
tgtagaatatggacagaaaagcccagtgggaaggaaattggtagtaacttacttgagctaatcagtatttatctggcaagaactttggcagtgaaaaatgggtaagtagcgatgaatgtaaaaatactaggggaagatttgacatttcacaacaatgaatggatctgagtggtgtttctttttttttccttcctgtgttatgtgtttcttatgtgacattttaggaagtaaatcgagtaatttttgaatgcagtgggaaagtttcttgcaagtttcttgcatgaatcccataccttcatgtgacctcatttttatactgtgtgaaaaggaacaattacacaagcttctcctatcatgttgtctttataaggatcaaattagattaggggtagagaaatatagaaaagaaaatatttctaatcttaaaatctatgttataaattcatttatgctgtaaattatgtattattttctttaaccatcctgtagtaaatattattagtctgttattcagatgatgtagctgaagttcagagaggttaacttctcaccgatggtcatatagccagaagttttggaattgtaatggaaaccaaatactatcaacctttaaatactatgctctttttactatggcgtgctgccaaggaatcaaacattttaattttgggctagaatatcatgattgacattcattgagaaatagaaggtaccctgtttatttttcattgttagagtaacaacaagtgcatacctattatgggctggaattgtattttgcattatacatattatctaatttaatccatacaatttttaacacactgtataagtgagaaagtacttgattgagtttcagggaccctagttcacttagtagtctactatgtgactacattacctgaaatatgtagatgtttttcctccaactataaaatgttttgttggtaacaatctttaatgtctttcagctttaatgggctgtgactgattctttttaatcttaccg

SEQ ID NO: 72828 - DNA, 1049 bp, Homo sapiens
agaacttatacttcaaaaagtttgagtgttaaaactgtcttttcatttttcataggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacaggtacttaacattgtataattatttgaattttcaccatgatgtatctcctttttttcacctttacatctagatttaaactggacctcttcataatcacctcaaatatttatgaatggttggtatagaaatgctaatttagtattccttaattcaacaaaaatgtatgaatggtatttttatatagttgctacattctcattttatcagtatagctttggtttcagtgtttctcatttattaatacaaatcattaatttataccactatttaatatgcaagtaactcatatattgttaaatatattacttttttaacatttataaacatgaaagtagaaagtcattatagagttgttcaatgccaagggtaagccaaaatacaaatctttgtagccaagctcaaaagttggatttttttcttttttagctgtatacagttaattcagtatctaaatattctatcagtgatttataatcaaacatgtgttctaaactttataccaaagtggcctcaactaaaatcaaagacttgtggaaagttaacatggacaacaatgaaccaccttgggtcatgctgccttttttcatttgcaaaaaatgctcatgttgcagcagttcttgcattactagctttgcccactctacttgaacagcataaacacagtttctggcaactaacattttaatattggacaccttctatcattatcatttccttccaggtgtttatatcaaggttgtttctctattgtttgcagtgaaaccttgataacctaatggttatttcatgtaccactggattaatttgtagttgaaattttctttc

SEQ ID NO: 72829 - DNA, 1554 bp, Homo sapiens
gatttttactttcaaagcttttttctaacctagtttctttcattacagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggtaggtactgaacttattattcacagggctttatacataaaaggaaaattagactttgttaattttaaaatataaggaagatcttgaaaactttattaacgtagattcttattacaaagacaatcaaaatgatggctcaacctaatcttataataagacatcttaataatacatcttaaagaagaggtttcaatgtgatatgatggatagcacattgaattggaagtagggaaacatggattatggttatattccattatcaaaggactacagtacatcggggtgttatttttctctttggacttagtcgtttcatgtacataatggggaaggggatgggtcacatctgtccaaggtttatcctggctctgaaattccattataatattataaaatactataataattgttggagattatatgacatgctttaagtgataatatttaaatttgaaccttaaatggaagtatatggaaaaattttaaaattgtttgtggtcatcttctttatgagatttccaataccaatgtaaaagctgtattttgaagcatgtatttaaaagtaaatatttttgaaaggtattttggcattttaggtatcgaaactatttataacatggcccatatgtcatatatctacattcaaatgttaaatcatgcaaggaatttttttaaggaacaattaactttttattccagtatacattcaataaaaatgatagttcacagaagcagaataagatattttagaacctaataccctagtcatctaatatcttccactatttaaaaacatgtgcaagattagaagaatattttagtcactaattactaacagtagtacttaacattgatcactggggttaatgcctattccaaataatgtttgcgtgttaatgtattaactgaaaaatgtgatggcttaccttttaaagtaaatcattgttattgatgttttaaaacatcttttcataccaaaaatttatgtatatgtatgaggtgattgacaagcaagtgttttttttgttttagaaagacaagatcaaattaggaaataaaatgtttct

SEQ ID NO: 72830 - DNA, 1938 bp, Homo sapiens
tataagtttgtataaacatatgcatgtaagtatatgtacttgtgtatttctataagcctataaggtaatatatagtaatttaagttttgtattctagttaattttaaattatatctttaaatgttggtaaaatacaaaccaataaatacagatgattattgtgatttacatatgaaaatccaatgaaataaacattaagtaaaattttttgttttaatttggattattgttagaatgagttttttaattaaaactttaaaaagcagtcacctgagtgctaatattcttagctactcaaaatttattatacttttgagaatattgctttaagaaaaatacagctttttatgttcctatagcatttgtacaaaatgcagtaggagtggaatcattattctaaattgcataagtacaaatgaaatggaagagcacaaagcatatttcagttctttttaggaaaagagtctctagtgtagttaatatatgcaatagctcaagtactatcaaatgtaaatgatgaggtgatattgatgaaaggaggggattgaggtctcgggggcgctgatgacggattgaacagaagcggccttgcactgcacgtaactcaagtctgtcgtcttcactactcaaagccataatgggaggtggcagtttgaaatgagttgccacggcaaagagtattatttttgaaatgctttcacacaaatcactaggccctgcatacaacttagtttcatgctttaatgtcatcaggaggcacaaattggtgtgtctaattgtttgccacctgccagcaaaatgagctgccagccagccagacgggtttgattgtctgtcagccattcaatagattgagagtgacaacatcaaaaatttaacttcaaactctgaagctttgagcagcttttcagagacatcatccccacaagtgcttctggaccagtgcatttttcaattatacttccagggtattgctaccatttgccttatctgtcttaaggtagctataattacattatgaggtatataaacatgtttctgaagcactaatgtctgaaatccaagttatgacatgtcttttaacatcagattgaattcgttgaaaatgagatccaggatgacaggctttagaatgaaagtcctgaatgctaccggtttcaaacacagaatctatcatgggtcttactttaccaataacgtgtttttcattttaatctttagttgaaaagtagatataaactcagttggtcgcttctttgtaactaaatcacactcctaataatattgtacagtctcaatagaattcatgtaggattttacttttgttaaccagttgtttattgattatattgcagacatgctaacaatgatttccttatacttatcctggattttaaatttggaaataatttcctagaacaactgggataatttgagttatgttaacttgtgttctacgtcgagtgtatctcaccccttaggatggagcattggtgaatttcagtgttttgaagtttataataaaaaattgcaacatcaaattcttagaaacatttagacttaattaaaataaaccttttttctttactattacatatttcatcagattatgaaatattacataaatgttctgtacatataaggaaagtactgattctttttctatttccttcagtcatctgtgcagattaagtatatatctttgattatactcagtgatccgaacagatgtgtactcatgaagtattaaaatgctagagatcctctagtactgttctataatgagcaaacactgtatgtaaagaggaaatacaatcataaaactataacaattttttcaaagttctgttactgtgaggcagagagaaatatttatgatggttttatttttaacagaaaagcttaataatctcattttagaattcttaaatcaagttg

SEQ ID NO: 72831 - DNA, 1005 bp, Homo sapiens
agaaatctttacctaccacaaagtcatgtagatattctactatattttcttctaaaataaaagttttgtagttttatctttattaggtttctgatctgttttgacttagtttttgtgtctgtggtgaggtaaaggttgggatttggctctgtctttatgtatattaatgttttagtaccattcaattaccttggaattgatttaaaatcaattgaccacctatgtgtagatctatttctagactccattctgtcccatgaactatatgtcactactgcactatcttcctgtatcgtagctttatattaagttttgaaagagatgatgtaatgtaagtcctgtaactattttttttttacttttctgggttaattcgcattttcatgtaaattttagaagtgacttgtcaattctaaagcaacaaaaaaagaaattctgctgaaattttaattacaactctgttgaaccttttaatttgaggagactcttcatcataatactgagtattcaaacttttgaaattgtcattcattgggatctttaatttttttcagcaacttattgtagttttcattgtaaaactcttgtacttatttttatgtctttttaaatttttatgtttttctaaattttcatgtgtttgatgatattatattagattttttgctgtaaatttccaattgggagttagaagccagaccaaaaagagtacatagtgtatgattccatttttatgaaattataggaaatgcaaattaatttatcttaaaaaatagcaaatcagtgattgcctgtgtcaattttacctcaataaaactgaaaaaaggggataattttgtattagtacattgatttttatatattgattttatattttataatcttgccacttacttttagtaaacgtggtaagttgtttagaactttctaaactcacataatcgatctaacactttctgtagtttccttattattttctatgcatgagataatgtcacttgtagc

SEQ ID NO: 72832 - DNA, 1013 bp, Homo sapiens
acaaggaattgttctacatcttttttttttttttttttactttcgtaattagcacactccaaaaaacttttctaagttggggatgtctaagggcatccccaaaaaagcattacataatgtctattcacagatgcgatcatggcacacaacagctctgaattcctgggctcaagtgattttcctgcctcagcttcctaagttgttgggactagaggtttgcatcatcatgctcacgtaggcattacacatcttaaaacttgaaaaatgtttacttggaattttgtttacgatataaagcagtaaactttttacttataaaaatattctatttagcttcaatttcttagtcttctatagctttatctacttttttaaccttttcatcatgcacttgaaaataattctgtttaggagtaataaagacaaaatgccagttttaaatttataagatcacagggaagtaaaataagtaagcattttttttttcaatatcatgttttccgtagcggccacaaccttagaaagctgtaacttaataaaattgtcagtaggtaattatgtcacaggtttgcagatctaggatacatttactcatcagctattttagtatgttaaattatatttaatattagaaatttagtgacaacagacacagtatttgagttgtgtcaattcctagtcataatatatagctgataagaatttaactttacaatgtgtgtttattctatcattaatactctcttaatcttgtcttttcatctgtgtttacctaaacccaatcagttcacttaccgatgcctacatttcctcatttacataggagcattcaattaataaaaatctactatagaattcactagtataataatttcttttatgtctgagtaaatcttttaggtacaatacttaagggtatgtaattatttctttttgttctatgttttcttattataaactacctattttatatgatttaagaaatgaattaggaaatttaagcactctaatct

SEQ ID NO: 72833 - DNA, 1737 bp, Homo sapiens
gttcaccttttaagaccattcattaacagtagctatttttaggtagcttttgatgtgtgttttctcttagcaataattaaggatttttgaagacagtaatttgaagcttactgaattttaagaaaattatgggttttcaatttataaactaatgcataaaaactacttagaataggtatgtatgcaagtatcaaaacctaccagccaaagataacaaagctgcctaagaatccagtttatgttctgtgagcattgtttatgttctattgggagctcacagaaatattcagagtaacttagttatgatgcggatatagcagaaagtctcatatgtgtccaaggacaggaaataaaatatagttgatcttcaggcagcctggaaatgggagagaaaagtcagtaacaaagactactccctttgattcgcaaagcaactttatagcctcctgtcttttattctctctgtgtatctactcagtgtttttactttcctcccagaccaacttctcttgcttagtcatcagaacatctcttagcatagcaccttagccctgaatcttaatgcatttttaatgtaaatatcctgcatcatctaactatagtcacttaacttatcaacagagaatctgaatggcttagccaggcctattactttgttcctcctgggttaggtgtctgaccctgtcataatcagctaagcctgaggtgggatagaggtgtctgagatacatgaggctctcccttttaggctctatatacaagttgaaacattttagaaagagatgttagcagtgcaggaaatttcactgaagggtccactctacttttggtggcatcaataaatattttattaaaatcatataatactcaagaatatttatggtttccacgactagcattttttaaaagtatataaatatagcatgaaatttctaccttcaccaaagaggatatcactgacatattctaaaatgaatgagcctagtcaagaagctccatatcattcacagatcatttgtagtagcattataggcacataatcagaaaaacttgccgtatttttatttaaaaattatagactaaaatataatttcagaattattgtttttaaattacaataatacaaaaaaatgtacacaagaaaattgggtaaatggaaaatgctggcataatttttaaatattcctgatttcctccataaaaaatggatggaagaatagataatgaaacaataactacaagaacaatgaatggacatttacaacaaaactaggtgacaggtatctcattggaccccaaaatatgcctaggtggggaccatctagcttatagctacatgatatacatgatatcagcttatttgtggcaaggactcatggtggccatcaaatatagatctatttggagaattaactaaatgagggttatataggagaaattaaaggatatgactgcttattctgaaaaatttgaaaaatggggcagtaattatgttggtagtaatattatcgatattacaaaactgttatgtaatgttggataaagctgcttggtaattattaatattctaattattttatcccgtgttcttgaaaatcaggattctggctgaagaaaggcgatccagatataaaataggagagtttaagtaaaagcttttaatttggaatttgaattggacattttcatgtaaacttatgcatacatatgcatgtacatgcacacatacacgcatac

SEQ ID NO: 72834 - DNA, 1024 bp, Homo sapiens
atataggaagaacctgtagcttaaaagagatttttttttaatttcaaaaatcaccaaaactaagttgtttgtagaaataactctatgatttaggtattaaaaactataatcaaaggcaaagtgattatcataaaaatcagaataatggtttgttataagtagggagagggttagaatgggaaacatggagtactcctgggatacgtggtaataatttatttctttagctatttagtggttgcaaggatgttcacttcataatagtttattaactgatgttttctgcagtttacttattaatattttgtaataaaatattttaatgttctctggagaagatataaaaattcttgaatgacgttaaagacctaaataatggtgaactatatcatattcatggtaggaaaactcatcacaaaaaagttatttcagtccatgttaatatatcaattttaataaaaatttgatttaaaataatttttaaattattttcatggaatttaataagctttatcttaaatttctgagcagaataaagggatgaaaaaatcgagtaattttggaaattaacaagctattatagttaaaacagcatagcagtagcacagagatagatcagtgtgtcagaataaatctccaagaacagatcccacatacatatggtaacattatgagacagagctccattgtagactggggagaaatacgtgaacagtggatctagatcaattggattcccttttgttaatttaaaagacaaaacaaagtggatctcttcctccctgaacaaacaaaagacactaccactgtggttgaaaatcaaatatcaaatgtttcaggagaaaaaaacataggaaaatatctgtaataccaaaggtattatgtaaactagatacaaaagcgtaaagtgtagagggtaaaaaaatcaccatattaaaactgttttgttttatcaaaacaacattaaaaagtgaaaagattgagagtaacatgagcaatatagtgactacaaaccttgaagtcc

SEQ ID NO: 72835 - DNA, 1049 bp, Homo sapiens
tattactctgtttatcttcctactgtatgttgatgcccattatgtgcgaagcacaaattaaatattttatacatgcttttatcccatttgcatgcacatataacatttttacaactttttcatatggcttaatatgaaatatttaaaaattcactttatttgggttgttagaatatcagtctttaatttgtccttatgggaatgaagataaaaatctttaagtagaaattattataaatgtttatcctacttaacagctacacttttgaatacaattcatcaatcatagctggagaaagcaattgtgcagttgtctacaattaacaggacaaaaacagttgataaatgtgcatctgaattaaagtactccctgggaccggctgaaattatacactggatcatttaaaggaatctaacaaaggatctttataattaaaacaaagcaaggttaatgggatgtaaaattgcctgtaatatcttggcaataatgattggaatttgaattattaaaatatgcattgaagaataaggcaaataggaagtacttatttaaaatacagaatttgagtgatctttttaaataaattaatcatttgcctgaaataaacctttgtcactcttttaaaagaatatagaatttaatttttgaatattcatcagaaaagaacagataatatttatgtttagcactgaatttaagctagagctctcaagattctgattttttgttttgtcctttagaataggggaaaatatacaccatgcatttcttaggtttttaagaggagaagcatattgcatccaagtataattttttagtgattgtatggcaccaatttgaatgtattctttaatttaacaaatgctagttaatattttaaccaacaagcattggtttgcttgagtttatttctcttatgtctttgatttggcaaaaactgtatttaaaaataaaacaaaccaaaaaaaacttccaaatctgtaaaataagaaactatttcctaaagtagatattctggtttaatttggagccaataatctctggaagc

SEQ ID NO: 72836 - DNA, 1023 bp, Homo sapiens
cctggtgatgtaggcacccaagaaaatctcctggtctgtgggttgcaaacactgtgggaaaagtgtagtatctgggccggagtccaccgttccccatggcacagtccctcacggcttcccttggctagggtagggagttccctgaccccttgtgcttcccaggtgaggcgatgccccaccctgcttcagctcacccaccgtggactgcacccacagtctaaccagtccaatcacccactgcctagtcatcccaatgagatgagctgggtacctcagttggaaatgcagaaatcaaccgccttctgggtttatctcgctaggagctgcagactggagctgttcttattcggcaagatggccagccaacgccccatgctccttttttgccactcttttattcactttatacatctaattagttaataaacatactgagtttcatacgtgaaacatgacttttacaaaattacctgcatacatcttaaatagtatttcttatttatacatataaccttagacattgatgataaataaaatgttatttatctaaaactaaagtcccatttaataatggttagattttaagtaataaggaaatatatttcaaaatttgtgatcataaattgtatttgaattatattttgttttttgagacagggtctcactctgtcatccaggttggagtgcagtggcatgatctcggctcactgcaacctccatttccaaggctcaagcaatcctcccaactcagcctcccaagtagctgggactataggcacgagccaccatgcccagctgcattttgtattttttgtagagatggggttctgccatgttgcccagtctggtctcgaactcctgaaattaagtgatccacctgcctcagcctcccaaagtgctgggattacacgcataagccaccatgcccagcctaaatcacatttttaaccatgtttaaaatatatctacaatttgacccagccatcccattactgggtatatacccaaaggactataaatcat

SEQ ID NO: 72837 - DNA, 1032 bp, Homo sapiens
tgaaatatctcttggatttttagtattggtttagagtataaaagacagtgatggccaatgttggccgtggctattaatggtttatattagttgaaagctgtagaatcatccaagaactctattagcattagagtaacaatttaccaagacaattaccacatactggaaatttttgcagctctaattcagtattattaataatggataaaattgcatttttctcaggttgctgtgggcagcggggaattatttcaatgaatatttcagcacattattttaatcatttttccaccaaatccaagtgggcaatattttatacttcttaattcagcctactaagaaaccatggtcattaaattgtaaactatttgtagtgaggtctattccgtgatttacaacccttgttaaaaacagtgtaaaagaaagcaaactgtaccattactacggtgtaatttgatgttgcctttgttactaaactccacatgattaatgcttttagtagaaagaagaaagttttaaaaaataaaaagcagagctgagtggtataatacctgaaatatgagaatgttattattttaagtctttttcacttgtagaggaaatatatatatatatgtatatatatacacaaatacaagtgtaaaatataagtatctccaaaattatcttaatttttcaatgagaccaacaaaataacttcaattttatagaaaaatgtatttccagctatgcattgttattaatagggattactttttttccctctactcttagccaattgcatgatttctggcgtttggattactgggaagatgatcttcgtcgaaggagacgatttgttcgcaatgcatttggctccactcatgctgaagcattgctgaaagctgcaatagaatatggttagtaccaatgcttcttccacaaaaatacttctggatgtgaggtgactccttgtgtttgagaattccttctttttttttcgctagtatttaatgttctccatgtcttgagtcagaaatattttgttctgct

SEQ ID NO: 72838 - DNA, 1045 bp, Homo sapiens
aatcatgttggggcagagatccggattgtacaccggagtctcgcagtaagctgtgggatccaatgcggctgctagagctggagccaacttcggtggagaaacgggccgcaacactcagaaatggatcaaaaatgcctttcggaagtgctgcagcgttggtttccctgctgctgctgctgctgctgctgctgctgctgctgctgctgctgctgctgctgctgcttttcccttccttttatctttgagcccagccgttcttaaagtgaaagactgtcctcccccctctgcttgtctctcttcctcttttaaagaatccttgtgtgagagaaccgcatggagagatcaccttctcaggaataaaaaacaaaagttgcgctgagacccagcaaagctcttccagtagtcaaaataagcacccctttccgtatttatttgcgctttcccgtaatcattgtgtgtgcagcactgttaatcaaatggaggaaaagtgtgctgagtgtgtgtccggggtgagtgtgcgtgtgtatatgtcagaagaagctgctgttggtttgtctaagagcccagatgcactcgtgtggaaattataaaggcagggccaggcaggcgggcggccaatcgccactgggctcgtcacgacagcctccttcagctccaacccggctaattaatccccactcatggatataggcacacaaactaaaggtaggaggctgctgccggcggaaaaccactcaggccacctagacagtttggaaatcaagaggaatctctcagctttggtattacttgaagcatattgacgttttgaaaagacttggcaaagcggctctcttctgtgccgaaaacctgcttgtcttttaccgctgaaatgcaaatacaggtgtattaatgggcatccatcaattagtgatcttgacggggttttctaaaacaaaatcactaacttgcatttagagtaagataattaacgtctgttaatccttggggtcttcttaaatgcaggttgaaagtttgttctttcatgcagactactggcatatgg

SEQ ID NO: 72839 - DNA, 1044 bp, Homo sapiens
ttctattacactgaacacgtgaaatgaattgccttctgtagctgaatcctttcagtgatcgtagacgcccctcattgttgaagcgagaattaagctattcggagaagcgtgttttccatccccgaaatttttttatggaaatgacctatagagagggattgcaaataacagtacatttttgtgcagttcagccgattttaatctaggcttgggggatatatttattttatgggagtaatatatttaactatttttcagtgaattttaaaaaaatatcatttgacctattaaactagttatgtcaaatgattatgtagtacatagagatggcttaatatacatttatgtattaatgtgaaaagtttttttaaaaaactccagttataccagtcttgcaatattttttgttgtaaatatactcagtgctactagaataaaattgtgtgtgtgtcatgctttaggatgtaaatacttaattgttttcagtggtaggcatgcagacatctttgacatgagctaataatagaatgataattgaggaaaactggcctaattgaaggaaaaaaatctcaagaatctcatgatttaatgatagtttgaaatgcttatattgaatggtatttagaattttaatgcctaactgacttttacattgcatttacttagtttatgaggcaggctcgatttaaaatgtaccagttaggaaaaaaaaaaaaaaaagcaataaggacatagcacaccattatcataaatgttagtagtattagtgaatataaaataattaaatattgtgatccttaacacttcgaagcgttcgaaataacagtggcaaaacaactttgcctcaagtagtatttcctaaataacttgtctccacttctgcagacctgcttacttatatgggatatacaaagtaattcataaatagtgtcattattaagcttaaagaaaaaccctgttatgttgagaaatacaagaatgcaatatttctttgttttcgaaaaaaacctgatttaaatttgaattgcatgttcacaaatctca

SEQ ID NO: 72840 - DNA, 1008 bp, Homo sapiens
tctatttagaataaaaaccacttgaatggattatttatattaagagcttactaaacattctttgtaatattggctattattttttaccttgaatgtgttgcttaaatttggactttttctcaaacactattggtattttagtggcaaaattatttaatggtagatgtttaacattggagatcttagcatgtattgatttgcacaaaaattctattctttaaaggtcatatgtaccaaatttcataaaggaaatgcattggagatgcttagtagacattttcttaggcactaagtattacttgcttataaggatattttactgtttatgtataggttaaatacttcacttgtaatgtccatcttgtaaagaaagtcctctctgtgttgaaaatctctcattgctaatcttgtttttttatatgtccagtaagagttaccaatatatctttcatgagctatggcaaatcattgataattactgttcaatttattcctccctaggcaaatgggttcctttgtagtacctaggacaagggatccacaggcaggagtcctctggcattgatgactgatggaataagccatagtgacacatagctactataccacatgagagcatcatgatttgtttattttagaactggttgtagcaatattagaggatgaaatgattttcttaaagcactaggagagtggggactacatcatcaggataacttaaagaaaagctgctcaaaaacaaagtgtcccagtctcttcaataaattgtattctctccttgactatttaatttatgcaaatgcacaatgaaaatatttttgcttcatatctgaatcttcataagaaaatgtatatttaaaaataataaaatcatatttttcagttatctacattaaatcttttattcatgttatagtttaattacatgatatctgtcttcaccaatggaaatgtaatgtgctaaatgctccattaattttttccccttataccttatgctcagttatg

SEQ ID NO: 72841 - DNA, 1025 bp, Homo sapiens
gtgaggtgggatgtggaattttctacctgtggcctcatgttagcactcaaaaagtttctgatttttgaacattttggattttgtgttcccacattagagatgctcaaggtgtacttttaatattagtactcatcgtggttcaatccagggtggtggcataattggtaataaacatggtacaaaggaacttttcagaagagggtgtcacccatgttccatctagtccataacaaattgggaatcactctggaatgttttaatatagctggttttaatcattatagaccatgtagattaataattcttttgcatatgtttcttattaaataaaaatcaagaaaagtattcataattcattagtgtgttaaattactgccatgtgctaggctctgtgctaagtatgaagaatgcagagacatacagaattcctgccctcagtgagtcaataggttagtgggagacaccaagaagtcaaccaacaattatagtttggtaagtattataaaaaggtgggtacagggttcccagtgggagcagcaggatctcctagcttaatcattagtagaagttaatcagaagaacaaaatcagaagggatctgccagtcagaagaaatatcatttgcaggggcacaaaagtgtgacagaacacggcacactggggagcagagaagtgttcaggatggttagaatttaagagctaggaagaatgcacattgtggctaaataggggattttatactactattaataataacatttgccactttttaaatacctactatgtaccatagtatatatgcttcatatgcataaattgtactatgattttgattttcatgacattaggatgcaaatttttaaaaaatgtttgaagctataatggattaaaattaaaaagtgcactagggccgggcggggtggctcacgcctgtaataccagcactttgggaggctgaggcgggcggatcacgaggtcaggagatcgagaccatcctggctaacacggtgaaaccccgtctctact

SEQ ID NO: 72842 - DNA, 1038 bp, Homo sapiens
tgaatataaaatacaattcacatagatttgaaacagtattgcacttctctagtccaaatagcgtctaccttgcagccacagcagtgatttctaaagtgccagtttcattgtctcacctctttctttgttaaaaatcttatagcagctctccattattctcagaccagagtccaaactctaatgtgagttatgagatctcgccccacatcctgctgcccactcaccctttgttgttctaattttatttttcacctctctgcttcttacaatatatgcacacacagtctgtgtccgttgcccccccacccccagcactgtgtttatgtatctttacatacatgtttacatatgtgttgttccttctgcttggtacttcctttttccccactcccctgccttttcccattatttgtgattttccaccaaactgtgaactcctagagatcagggactctgcttctcctgttcaccattggttcctaatggtcagctgataaatatttgttaaattaaaggaacggaagaaaaataaaattgataaaccatgaggacacttggtagaaaagagctgacctaattatgggctgtttataaaataggaagccttcttgcagtttatcactgcttatagtgagactggtagctggtgtcccaaatagttgggcttcgtagttaagagttaagtgctatgattccaataatgtctaggatacaaactaccactaaagaaacaataaatgtggcttttagttcagtaaaaggctatgtgctgtggtccagattttctacatctgttttggtgatgtcatcaacaaagattagaaccagaggtctgcatgggtgtgtgtgtgtgtgtgtgtgtgtgtgtgtgtgtgtatgtgtttgtgtctgtacacatgcacaaaaaggtagggagtaattgcagtagtaggctgacatttgttaagcatttcctgtgtgccaggcactgtgctgagcattttttgaaaagagctattaatatctcattcaatcgcacaatgaccccatgaagttagg

SEQ ID NO: 72843 - DNA, 1009 bp, Homo sapiens
tatatatcataaaattcacttgttttcagtgtacaatttaatgatttttagtaaattttaacagttatatgaccatcaccacagtctaatcttagaatattttcaccaccccagaaagattccctgcccacctccagcccaaggcaactgctaatcaactttttatctccaaaggtttgccttttctgtgtatttcatataaaaggaattatacaatatgtggtctttgagtttgacttctttgagtagtttttgagattcacccatgttgtagcatgtattggtactttgcccaactttttacataatactaccacattgtgtggaatatcacattttgttcacccattcatcagttgatgaacatttgatttgtttctactttttggcaattttgagtaatgctgctatgaacagtcatatacaaatttctatgtgaacatacatttttatttatttggggtatagacctaggagtagaattgctgggtcatatggtaaatttatgtttaacttcttaagaaactgcccagctgtttctcaaaatgaccttgcattccccagcaatgtatgacagttccagttcctccatagcctcactcccacttgttattacctgttttttttttttattacagccattctagtgaatgtgaggtaatatctcattacaatatttttttttcttttttttttgagacagagtctcgctctgtcgcccaggctggagtgcagtggcaccatctcggctcactacaagctctgcctcctgggttcacgccattctcctgccacagcctcctgagtagctgggactacaggcgctcgccaccacgcccggctaattttttgtatttttagtagagatggggtttcaccgtgttagccagagtggtctcgatctcctgacctcatgatctgcccacgttgacctcccaaagtgctgggattacaggcgtgagccacggcgcctggcctacaattttaatatatattccctagtgactaa

SEQ ID NO: 72844 - DNA, 1274 bp, Homo sapiens
ataaattacatataatatttcagaaaaagatttttgttagtctagcttaatatatggaaatattttgcctatagaatttatgtatcgaggaaatacttaagtttcttttaagatgatctctttgacacacacaagaaaggtatattgtacagtccagacagtttgagggctaaaattatttctattccttggaggctataaaatctcatttccagctacacaggctttaatgaaatattgtatagcttaggatacaggaagatttatttcttttttgggtgagttctctctaaaatttcagggaaaatttttgagaaaatgaatttataccttaaaaataatattccagaattcatcttaaaatagcatagaaagctaaaatatatttttgtaacaaaagttttgttatatttaataattctataaaatcttggtgttctttctgctgatcaccctctgaattaattggaacctataactttctgaattttattttgtataattggtagacttcatgtctcattcttttttttccccattaagattccagaagcttatttcattagagacccccacactttccttcttacaaaggactttattaaggtatatgttctgtatttagtgtggaaagtgttctttggtctttagctgcatgcatgtattcacaggttagattttccacatttaaccccagcttctgggaataagaatagtgactgggttaactgaagcatgtttggaaggagaagcaaagcttgtctacaaaatactaacacttggatgattctgcaccctgagaaaagagcacccgttgaattttctggactttttttcatggctgacttgggatacacttgcgttgtcaaagagtgtgttggcctctctctttgatgcatattgattatgacaatcaccctccttcccctgcaggccatggaggcacagatacagaactttggacagacgccatctcagttgcttattgagccacatccgcctcggagctctgccatgcacctggtaagacatatcagcatgttgagatttttttttctttcctttttacctgggaatagagcaaataaaattgtgattttaacagcatattttaaaaggcttctcgatttattggttaactcttcagcctaagtacaaactaataccccagggagagacagagaaggaagtgtaaatctacctttaagtcctacttaagctgtcccacttttggattcacaaaaatagccatcttctctatgtatgactctaca

SEQ ID NO: 72845 - DNA, 1064 bp, Homo sapiens
gcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggacttggcgcatttaaacaagtttctgaaaggtttcaatttgactcaagaaaaaaattcaatatttcttttgaaaatactgaatttatcacttgctgcatggatcagatggcataggttaatctttgattttcagaatcctaatgaaataactttcaaacaatttgtgtccttaattaaaggtggaatgagatccaatttttccccctaatccttcagtttaagctgatacatgtaggttaatgtggaatgaaatcatctgtgatatattatgttcatttatcaactgagcttttttgatgttgcctgtttttatgtaaaacatgttcttaaagttaataaaataatagtacttggtgtatgaactactacataataccttagctgaagggtacgctcctcagttcatttgccatattggagtaaaatttcaccttagttcaattcacaattgacacattcagttcacgaaggaatagcccagctgtgttcttagggggaattctctc

SEQ ID NO: 72846 - DNA, 1050 bp, Homo sapiens
aacaaaaataaattccaataattttaacttccctgcactgtcaatcttatggacaactactgctagaaaggtccaataaatgctatttgttctaagtggtagatattgccaattgatatagagcccatggctttgtttagacagggcaaaaagaaactggacttgtactaattgccgatagatatcatggccaactttccattcaagcagttccaagggaagtgctttccacagcatttaatctcttgaacatatgacttctattaaaggactgttcaggggctatatatatcatttactttttgaaagtaaagtccctcagagattgaaacagcacaccatttatagtctttgagatctctttttatgcaaaacataattctattaaactaaagcagaaataaaaatttcttagcaacaaacacagaagttttcagttcattggtggaacagaattggtgatttataggcacttatgattgagttacttatagaattctttataaaaaaaattcggcaatgaatttttaaattgttctactgagcggggaatgcttcagcaaaagccacgcagttttgtcctaatgataatccttaaatgcgctctgaagacatcgtgctgtagttcaaagttcgatactttttcacttgcactcacttttttcttagatgtagacattgtagaaaaagatattaggaatatttccctgctttcagcattttagaagtgcaaaagttaaaaatatataaagtatgaagttcagtgtgaactcaaaagactatagtgctgaaagccacatggtgtgtttttgtcttgtttaatcaactaggcagggggaaaaatctagacagtttctgtactgccatagaattttaagaagtgtcaggttctctcatctgtatacatccctgtgcgcatatattggctcatctaaatattaagaacccaaaaaacattttctaaaaccatttgaaccagcgctgatgtactatatatatatataccctacataaccagccggggaatttccaacacatgccctgaagatc

SEQ ID NO: 72847 - DNA, 1025 bp, Homo sapiens
atgtggtcacttgacttgacttgactttcacctgttctacacaggagtggtctcactccaacactgcagatgtgtgttaatgcatagcatctatattatacacatatatacatattatcagttgtatgcatttaggaactacaattctttcatttaaaaatgacttagaggatgggcatggtggctcacacctgtaaccccagcactttgggaggccaaggtgggcagaccatttgagcttaggagtttgagactagcctgggcaacatggcgaaaccctgtttctacaaaaattagctgggcatggtggtgcacgcctgcagtcctagctgttcaggaggctgagatagacagatcatctaagcccagggaagtcaagggtgcagtgagccctgattgtgccactgtacttggtctgggcgatagagcaagaccctgtcccccaaaaaaatgacttagagtgtgtagggagggataagaatttttaaaattgcccctttctcatgaaaacttcagatgcccaataagaatataaatagatgtgtcatgtgaagagatttattttggttcaaggaccataactagacaagtggtttggcatccctttttctctaaataagttgactcaaatacattccatctttatttctgacctacgtgccctttgaggcacagatttttgtaaatatatcacaagtatagtgtcctcagggaaggtcccccccacgccaccattttaagaacagctttgccattgtgtagaacaggtgaaagtcaagagtcagacagaagagttgacagcacggttttgagaaaaataaactgccctaactttccatttaaagaaaatagctgcttgtgatagaatggtttggcagaccagatgcattctgaaatgaaagtctgtttgttgctttgatatagaaaacagcctgtcaaactcgacctggaatacatgtctttttcaaaccagcaagcagagttggccacagcttccaaactctggggtctctatctaggcccca

SEQ ID NO: 72848 - DNA, 1044 bp, Homo sapiens
aaagaaatagtctgccaattctgcttgcaattggagtgcttagcccattaattaatgtaattactgataaactagaatttctttctgccattttgctatttgtttttatacattttaaggcttttctggttatcttactccattactactttttttttcaattaaataagtgttttctagtacataattttaaacctcttattgtttcttttactttttttttttattatttttatagtggctatcccgaggaatacaattatcatcataagacaatctagtttggtataatgccaatgtaatttcagttatataccaagactttgctccaatatagctctttctccttcctcctcttttgtgctattattgtcacacaaattatacctttatacatgaaggcggtgttataattgtagctttatgcagttgcactttgaatcagatagaagaaaagtgttacaaaccaaaatatatttttactgtatttcacatttacatacttatatatttgcctatgtacttggttacctttgccagtgctccttagttctttatgtggaattaagttaatgtcttgtgtcctttcatttcagcctgaaagagtctctagtgtttcctgtaaggcatgactgctagtgacagattttctctgtttggggtttttctttgtttttgtttttgaaggatagtttagctggatatagaatatttagttgatagttttttttttctttcagcaccttaaatatgtcattctgctgccttctggtcaccaccgtttccaacaagaagtcagattttaatcttttttagactcttattaagttgtatgcttgctgatatcttgcaggtcactgagggactgttcatttttcttcattgttttttcttttttcgttcttcagactggataatcccagttgacctggagacaaacaaatgggaataggggaagaaaaatgccacaaagctgactcttcttccttagagtcagctgtttaataaatgctcctcaaattggtgcaagcctttggttcattt

SEQ ID NO: 72849 - DNA, 1052 bp, Homo sapiens
aaccacttatgtgctttgaacagcagctacctatctaatcttctaattttagaaaagggagtaaatatttgtctttagatactttatttttacttatcataaaaatacatgtgtaatggggtatgtttttcttctcgaatgtgctggggcttacttcaaggctgtaactcgaaattggccatagatgagaagaaatgccagttctcagtttaagaaagccagagtggggttacttcattccctgttgctccaaatgcactgtttttgtgcccggctgattgcagttttaagaattctatccaggctcatggtttcacaactcctccctcaactcccccatcatcgccatcaccacatgcttcctctgagtcttttaaaagatctgtgtgaccccatcccccttacctgagaccaggattgtgttctgatcagttccatatgcttccatcctcatatggctgtgtacagttttgcacacattgttcctaaccaggtgttgcattcatcacatctgacataatgatcactttttcttccagcctatggatcattcctgcagacacggcattctgggggctgttggggcacagaataaatactctatgggtcttcctgtctgcatccttggttgtctgagttatggccacaactgcacagttctttgattggtatcttatctttagcagtttatgttactaaattttttgagagaaagttttgttgcagtctggtttttaaccagacatctttttttattaactcatttaattcattattaactatttgttggttattttgctgctgtatgcacttgcagagtgcatactgaagtatgatgcagcaagatttttaaaaatctctgccagtcaacacacacgctaggacacacaacagcatgtaaatcaaaattaatgattatgtatttatcagtcaagtataatacggaatgtctgtgtttgataaacatctgtacatctatttgcatactcacagaagactccattaatcgttctgatcatgaggctgatataattggaaaaagtatgctttct

SEQ ID NO: 72850 - DNA, 1053 bp, Homo sapiens
gtggtggcatcggggtccatatgctgccaacaagatgccaccctaagattacttgtcccacctttttaaaaaatagtttaactgaaccctcacatcaactccataaacaatatgggaattccagtgcccagtaaagaatttcatgtttttgggttgaggaaatagaattgtttaaaaaatgaattgcttgagtgctttgagtaaatgcgtagagaggaagatggttttgtagattgccttggggcagcctacagatgtatccatggcatgaaaactgttgacgctgggattttggacaatggaaccatgaaagccggagcctgctgtttaatatcttacccagaggagacggacaccggagggcacagaccacatgctgttctcacttgtttctaccaccactccttgctcagttgcctctcgggtttgtgttagccctaagcaaagagttcattgaacagtactttttttgatgtttttagactgagataaggaaataaacgttttggaaatgctgcacaatctagaaaagattttgcaggaagctgcaattggccaagatgaccgttgtggttcataagcagcctatgtgtgagcaaaccctttctaatgatttcaactccattctttattcaggggcactgaagcttcagcaaatggttgccccgaccttcctcctcttccttgcaactttcagggtgactgctcaccaggtcatcagtccttttgctggcatggctggcagttcaaggaagcacttaccatgccttaatttcagtgatgcattttttttttttttaaatctgggccttggttaaagacctccaaagaagaaaaagggacattttctagctaacagttaaaatcatgtcccctgaacccatgtccaaggggaggatctgcaggatcttagagtctgagagtctcttcctcttgcccaagtccaagctctggatgttggaactttgctgtgggttattcacttaacctgccaagcagttactcccagaggccatttggagtataactattttttaagtgcttaaaataaga

SEQ ID NO: 72851 - DNA, 1032 bp, Homo sapiens
gaaagggtttgctgagatgggttcccgaaactgctttggtaagttagaaggatgaataggtagtacagttgggaaactcaaaggcgggagtgaaccccatgaattttgagtaggtattcccaagaagagtgaaaaccagaaaagtgaggtggggtttcactcattttggtttatctagatggcaatggaaactgcatgaagaggtggttctgaatttttatcaaagctttcatattttgtgaagttactctaaaggtattgttaaaaacagaatgccacttttgaaaaaaaaaaaaaaaaacattggaaaggatctgtcattgaatggcattgacataacaaagtcttaagacctgaacctgaacctcctggtatttttctacccacctatcagacatgctaccggtttccccttttcttctgtgcatctccctgttacatggaactaggaagcaggaagcccacagatcaccttgattaatctggtatcaggagctgttttcatcaccatggaaacatgacactcctatggaaaatggagaaacctctgatctttgtattttaaaaatttttttaaaaaacaccctagaataatgttctttctgaaaacaacaagatacatgtacaaacacacgattatattacacatcttgtatgtggttgaattttactcatcatgcttgtaaaaatattaatttatgctcaaagcaaaggtttctagacataagattatacaatgagagggcttaagtgccactggaagaaacttcagggtaatagacttctaaaatgcacagattgttctaagaagaacatgtatcccaagaagtctttgcaaacggatattcctttatgcttatttcttacccaggtaatatcaagggtatgtaagggtgtcgggagtggcacatttcataaaacactgaatttttcctcctttcaatctgcatcaagctatttctttttgtccttcaaaataatagccaaacgtttaaaaattctctgcttaggacttctaagactccatgctgt

SEQ ID NO: 72852 - DNA, 1032 bp, Homo sapiens; identical to SEQ ID NO: 72851

SEQ ID NO: 72853 - DNA, 1024 bp, Homo sapiens
agtcctggcagatgggtcagcatatgaaacagtcatacctgcattgtttggaagaactgtctagtgctagaggaagactcaaactaaattggcctacttaaaatggacttctgttaactttaatatagttgctaatacttttgcatattaacaatagctaacatgttttgagcactcaataactaatagtgccaaatactctgtgtacttaatgtgcatgatcttatgagaatccctgaagtgatcctttgacggtagatactgttacaatcttcatatgacatctataaaatgggaataatagtgaccttccaaaagatatttgtaagaaaaatattctaaagagaattgcgaagaaatgttaaaatatgtagtgtctacagatatcgtaatgttgctaatgatcattagtattccaataggaaggctagggtaaatgaaagcaaagattacaatattatcattttttaattgttgacctatacttactctgggtgggttttgttgaattgttgtgagaaaataattacttttaataagaatatatatttaaaaacctgtaagcttattcacctgaggatttaacatagttttgcaaatcatttcagattgttttaggatatagaaaatacaatcatgacattatgagtaagagtgggtgaggattcaattaatgtgggtttttcccccttctttgcagcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaa

SEQ ID NO: 72854 - DNA, 1011 bp, Homo sapiens
attgatggtattatttgagattacattgttaatattatatattcaattttttttcttctagttaccatgtagaatatagctatatgatgatataaaccattctgctgaatggagttgttctttccaaccttcttccttgcttcagagagagtcaattttgattgacgtgcacattcacatacatcagaaggcacagggatcttctgcttctataaaacctgtcttttaatgtacatgaacactaatttatagtgtgtgtattgcactaaatgtcacaattagaaagttcactttgtttttccatcagcattcgggtgtagcaggtagtacagatttgtaatgtgaggaaatgaaatagcgggcagtttatgtcgaataacagtcgttctgaattacagaattgtggatactgacccatatttgttttctttctcattaaagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctggtaagtttccaggggtccatggatcagattggaccctttcactccagccagcagaaacccctgacctgcatttgttgttgctactctggttggaaggctgggacctaagagcttgattctgagtctctctaccctgatgagtgaaaaggaggtgcagtcaacccatgctctcgctcctcatgctgcagggctggtgtctcgatatccagaaccagtgaagctgaatgggactgtgctagtttgacggtgaccaggtggaatctgatctcccctagcactgattgcccacccctctgcttctactcagagcttc

SEQ ID NO: 72855 - DNA, 1024 bp, Homo sapiens
actcagcagtgtccacattgttttccttgaaaaatgtgcaaataattttttctgtcctttcaagggaaaacagtgtgatgagcacttactcccctgagagagggctccaattcctgactaatacgtgctggaatgggtgctccactcctgatgcagagagctccttggatgaagctgtgagaggtgagcttctcctagcatctgtgccacttagagggggacctgccctgccctgcaaacccccaggctcctgtgcattcaccaccataaccagggaatccaggagagctgatgagtccttctggtattgtcagcctcaggtacacaaggtggctacagttgtttaaatagtgttatgccagaaactgggctcaaaattgaccgtaattaccagaaagctcattctgttgatagatgataagcacactggtgactttgtttataatatgaatagaatctcaggggaggggaagtattcgtataatttcaggactgactgtgtcctgagcatttaacatatttatttacctccttcatgcctttgcttgcatgtcacctctcaaagagatcttctcagccactttctctgctgtatttgtcttgatagcactcactgccttctgctattctttacttgtgtgttttgtttgttgcctatcttccattagaatgtcacctccatgaaggcagggaattttttggctggttttattcattgctgtatttctagtacctagaacaatgaccaacatacaggaggggctcaagaaatctcattatgtgaatattcattgtggaacaaatgctttcccgctgggaggcatttttgttatatgtgccgtataagcctagacatgcccgtgtacctgaaataacaagatggaaaaaaatagaggaaaagaacacagctagcagtttgtgacttttagtattcctgaagataaagttactctccgtctagaaaccaggaaggtatggacctcttgacctaaatgttagacgctagatgacaggactgcctctc

SEQ ID NO: 72856 - DNA, 1049 bp, Homo sapiens
aacattttaatcttaaagaggcttgccgtattaacccttatctaggatatggggttgggaaaggttttggaaggtcttaattttcttatattacttgcaactgcttttctttttaaaaaagtttttatgactacatagtatgcatgtgctttttgatctctactcatcttgaatccttctgtcttccctcagtatcctaccactgtaaataaaattttcaaatcaagttatatctcttaggatagaggaaataggattagtttgcaagtttcttagattaatgtatttttaaatcaatcagaatgcctgaagaagttctgcaaaaatagtagagccagaaaatgtccattaaatgacaaattttaaaatggagggaacctgcgctttgctggttgggttggcctagggtgtatcttgtccttctaatcctttatgcttttttcctgtaatgtacctttccttctgaagggtgcatagtcatataatatggtgtagtcataattgataaggtcagaatgttttaatcctgcttgtatgtattgttaacaatttattttagaattttgatcagtcattgaatttaggatgattttgataatatattcttttgaaattttgaaataaacattctgcaccaaatgtctaagatatggtgttttgacacttattgcccctttgtatgaagcaagagacttagagaagcatcctttgtttagtgtattggtgcgtattatttaattttgcccgacaattttcccctttaatgtatggtgtgattttctcttgtttctagctctgaatctttaaggaatggcaatgggcttgaattaaatgcttcgttgtcagagttcgagaaaaacaaaaagatctctcttcttcattcaagcaaggaaaaactaagaaggtgaattttaatatagcactttttaagcattattcttttgtagggagaaattaatgaattttataattttttgtagtattattaaaagtataagtgaaactagtaaacttagcaaacaaatagatgccactcactcattcagcct

SEQ ID NO: 72857 - DNA, 1757 bp, Homo sapiens
aggacagactccaattacggaaattaaattctactggaatcattattggtcagtgactatttttggtctttctcggcctgggatactaaataagaaatcttttaaaattaagatgatgttaaattgggactattgttggtcaaggggtacaaggttttggttatataagatgaacaaattctgggggtctaatatacacagtgtgactatagttaacaatactgtattgtctacttgaaatttgctgagagggtagatcttacgtgttctcatcaccagaaaaggtaacgatgtgacgtgatagatatgtcaattaacttgattgtggtgattatttcacaatatatatgtatattatcaactcaagttgtacaccttaaatatgtacaatttcgaattgtcaattatactttaataaagctggcaaaattaagatgattttttcttaaaatgggcctgaaagacattttctggattctcctgataatgattatatgagatttactttaacagtccttttttaatgttctttttaaatattcagatgagtgagtctgtttgtgacattccagtggctcccagcccttgtggttcttcctggaaatggctaactttggtgaccgagggcttttgcaacctcttcttatttggttctcagtgaaatagagcagctgctcgtcacctgcccatgcccctctgttggtcatgaccatgtctgcttccagttgtctcgtctttgctctaaggatgagcagctgcaaaaaaggaaaaaatttttttcagatgctatatttcgacagtgcagctgcttgttgaagactcatgcgtgttttttgtctcctgacatttacctataaataggaacttgataaataactcagtcgaatgtgttttaagcacacctgtcactaagtgactagaatctggcttaaaggtatcccggggtaaataatatagagtattttagtttttgctttctaacctaggtggttttatatttcacagaaatctataaattgctttcagttttaaaaatactgctttgtaaaatctattgagtaaaagacaactgcattaaggattggggcttgtgtgtttgattagcgtcatctccttaagtgacttcagaaataaatagttcccctctcaaaactttcagttaagactgaaaacgcaactgggcctgaagaacttggattgcccctgcagaggtcctacagcgaacacctgggatattttcctactgatctatttgcctggttagttttttgttctttttcataatagcaatatttttagagaacttattgattgtggctattttgtggaagaggggtgcagcatttgctgtacttaagaatcctgagctggcactgtgggtacacattacagaagtattcaacttaatataaggaaatacttcataaacaattagacttgaccacaggggaacaggtcaaattgtaaggtagtgagttccccatcattggggaatatgatcagtattagagtctatgttatcactaagcaaagttaaatagcgcagtggtatttaaacttcataaaaacagtgaaattcctcaaacaaaaattttacatggaaccccaatatttaaacagacaagagcagcctcacctgttatacacctactactctgcttcttcccattgtctttctcgaactcatgaacctatccacccagttattgaaaatctccctttaaaaaggatttagtatcttttacgtacctcatgta

SEQ ID NO: 72858 - DNA, 1528 bp, Homo sapiens
gaagccccacggggccacttacaccagcatcctgccctgtggagttgcttctttgccaagctgcctttctctttgtacaagtatttccagccccttccctcactcttagcttcaactctaatcacctcccaaatctgttttctcatacagatgtctatggcctggcatttccaattgtcttctatttccattaatttaagcatccccattctttggcattttcagtgggttgagttcattagctgtagagaataaaacatacagaaataaaacatgaagttgggaatgctctttttcctaattgaatatacttgaaaatatctccaaatgcaaatggcctttttggttcctaatattgaggtttgaatagcacatatattccattgaaaggactttatttcagtgtttcttatgatttaggaatttaaatctttctctgttccctggaatgtgtgtttcaccaaaataaatcatgtgggagagtcatgactttgatcctttcagcaataaacagattttccagcaggaaagacttttggaaaactgagtcataagaactctatcatttaataggatgagagagaaatttgcagaaaaactgaagtagaatagcattggtaggcaaaatgtttaaaaacagggtgaccttcagatctaatcactagtctaggtactgaagatgtgaaattagtagttcctgtccttgagctgcttatagttgaccatctagccagtcagactagatatggagtcaattgttgtgttatttgtgagctttatttatcttatcctctcatacatgacattttccctatgcctaggcaataattatgtgacgcctctgcttccttctctttcaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattaggtaaacttcaaaagccttgatgctgtatctttagaatcatttttttaaaaacccattttttaaaaactcctaaaaagatgatatatttctattttacttttcaaattgaggggccagggattggctcatgcgtgtaatcctggcactttgagaggccgatgtgggatgattgctttaacccgggagttccagacctgcctgggcaacatagtgagacctctgtctctacaaaaaattttaaaaaattagccgggcatggtgacatgcacctatagttccagttactgggaggactgaggtgggaggattgttcaggagtttaaggctgcaatgaactatgatcatgtcactgtactctaacctggacgacagagtgagatgctatttctaaaaaaaaaaaatgagggatattttcatggggagagtctatgtacatgttgtttttatttccag

SEQ ID NO: 72859 - DNA, 1013 bp, Homo sapiens
cttattttcagtttgggcactggcgtggcatcccaaagtgtccttcgtggagcttccccccaaacaggcaactttgtgtggaaccaaagccgtggtgggaacgggacctgctctgcacgcatttgccacctccatggaaatcaaaaagcccgctggcctctcttgaaagcaccttatttttcagcccctttagcaaagcacaaaatcacttttgtaactgttttcgataaaagtgaaaggtgatgattaccccactaggaggaaagcgtaggcgaaacctccccacgccagaaagcaaggccagctggggaggggggctttcatcttagtattttccgcatcttgataaataggagagagcaatcttttgtgctgagtgtagtcttattacctcttagaatgctctgcaaacttaatttcatctcttcttaagagcaagctttctgaaatggaattaggatcactttgaagtggacccgtttaacaggttttcttaatttttcaagatagaggaacctatttaaactctaaggaaaaatagtattttatggtgcaggattaggcaaagctgcacaaaatgaattctgaatgaaatatctgattatctagtagaacataaataattgtggtttcctccccttaagagagtgtgaagccccaactgacccctttgtgtgcctttgtgagaaaagccgcttgctcagtttctccagatagagctgtttaaatcccttgactcctgaggaaactgaaggcccgcaattgccccatgagagcctcagccctgcagctgctgctgattgtgggctgctctgctcctggtgataagagtgacataaataacaactcactaaaatgtaggagtgatttgctttaagcacttcagcacctgctgttactaattaagggtttagcctgccacagattgcaaatggaaatccagtgttttaaaaattgtagagactagagtgccctgcatgttactgtgatcacagaaatgaaacagtggatga

SEQ ID NO: 72860 - DNA, 1021 bp, Homo sapiens
tccctcatatttctagaaagggaggattaaaaaaagaaataatgactgattaatgacctgtattataatttacacttttatttttacttgacagtctttattacatcattctcagctagtctgagtttattttcacacactgtttttactaaaggagaaaatactgctttgtcacagagtgtgatttcattctctactgtgttttaagttattaattaaattgaaacctaagctttaattttgctttcaggggtaacacagtaatcatttgacttatttaatactaattcagaagaccttattttatatttattgtttcattgtatgtcctctaatctttcttttaaagatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttata

SEQ ID NO: 72861 - DNA, 1049 bp, Homo sapiens
ctgtcaaaaccagtttatgaattcatctttgcttactgattgagtcatttaacaaaaatcttttaatcttactgagtaccatgtgcacactaatatctagggatgatatctgtttgaaggaaatcagtctagtccagaaaagaaaaaagtcaatttaaatgatttgttaaatgccatattggacttatattggtatttaaatcttaccagtcaagatttatatggaccagaacagttttcaacttcatggcagttctggtattgtactttataagaccatactggtaactaggttggctggagatatttttcattaattttatctagtatttgttggcttcatatttgttatataatgcttacagttttccccctcttagtactaactcttcacattttgaaacatttttactgtttaggctaaagatacttcaagtgaagaagttaacctgagtcacattgtaccatgtgagccagttccagaagaaaagccaaaagaattacctgaatggagtgaaaaagtggctcacaacattttgtcaggtattacagtaatgttaatttttttccctgtatgacattaagcctttggaaccaaataaagatattgtttattagggaatactgagaaagataatattttgtattttggttttaaatgatcaatttagaaataaatgtagaaggaactagtcttttgaaacatcagatattgtcatataagtataaattcttcctggcctattattctgttctactattgggaaaatggatagtgaaaagcttcaggaatcttcaaattcttaatagttctgaatctaaaattagttatgttcgtttcccctttgaagctccctcttaacctccccctacccctgtccctcagctgtggtctgaatgtgtcccttcaaaattcatatattgaaatcctaacccctgaggtgatggttttaggaggtggggcctttggaaggtgattaggtcatgagggaggagccctcatcaatgggattagtcccttataaaagagatcccaaagagctgccttg

SEQ ID NO: 72862 - DNA, 1048 bp, Homo sapiens
ggctggagtgcagtggcacaatcttggctcactgcaacttccacctcccaggttcaggtgattcccctgcctcagcctcccaaggagctggagctaggattacaggcatgcactaccacccccagctaatttttgtagttttagtagagatgggggtttcaccatgttgtccaggcaggtcttgaactcctgacctcaaataatccccccacctctccttggcctcccagagtgttgggattataggtgtgagccactgtgcccggcctgtgagtgctgggtttctaattaaaatacttgttcagcttctctggtccagactatatgtgttaaaatccaagctccactttttagttgttggttctgggcgacttaattgacctctctgtgcctcaattttcttgtacataaaatgacaataatagtaactgatttcataggattgttaggaggattaaatcagtaaatactattatttcagtaaatatttcaagtaaataatatctgaaaatagtttatttaccacaaaaggaatatctgatttcaataacgaaaaccttaatttactttgattattatttatttaaagctggagtcattattggttaacactaggctagttaaggccatcagctttaagattgtataattagtggagccatggcacatttagcacagtccttattgcagaaagatcagactagcaaatgattaattttcttggggatttgttgatgttgatgtttcttaaagccttttaaaatatgtttccaactttgaagtgtttattttctagtataacaattttattaaaacataaatgaaaatctagtttcatttatttatatgtatattttttttcttctaatgaatcctttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatct

SEQ ID NO: 72863 - DNA, 1019 bp, Homo sapiens
tctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtaagcgaaagaaaaatgaaagcataatttgaaatacgtgtagactacatcatttttatttgttaatgtttatgtgtccagtataagtgcaaaaagataacgacaaattctactttgtttttaaatatattccatgaaattatgagccttgaacatgtttgtgtttgtctttttctttttttaaaaaagatatattaatagttttattttggtattaagtttgtgatgataaaacttgagaagagtggtcatccttacatttttaattctttatctgaagaagaaatctaataagtttaatttcgaaagggatttatgtaattcctgtggatgtatagctgtaaatattcacaaatgttgtcaagactcagctgagggtctgaactgggagagaccgagcccatggtccagaacagttgttctca

SEQ ID NO: 72864 - DNA, 1132 bp, Homo sapiens
ctcactatgttgcccaggctggtctcaaactcctgggctcaagcagtcatcccaacttggcctcccaaactgctgggattacatgcctgagccactgcgtccagcctgtggccttcatttttatctcctgcaacatacagtgccctctcacggcttgtttgaaaggaaatatctgtatgtctcacccaggcagtgaatggtacacactccaggaaaaaaaaaagtgattctgtttatgagacttgaagcaggaaggagtggatttactcatgctgctgtgtttgaagggagagaagacatatcaaagctgctttaaagaaagcagaagtcaagttatctctaaagagctttattccttcaaagtctaaaatataccacaggtttcttgttttgtttttttatttttccttttcagaatagtgggtggaaatgctcttggaatagcagtgagtcacatcagggtgcaggtaggagaaaaacgttaatgccatggatgcatcttttcatggggtacgagccccatcaatgtctgtgtggccagatgacgcactgcgtgttataaatcaatgatgagcaacgtgaagagcagacggggagcttcatgcatcctccacagctctgtcttgtgactggctcaggtccatgtgcaattttgaagaggatgtttgaaaaggatattcatcattttaaattgctctgtgggagctttgcagttcataatgtgccacttaggtacttctcaaagatcagttttccttgacgtggtttacaatttaataacagcaaaagggcaacttggggtgttaggacagaaaactaactttgaaggaattaataagaaatgtggagtggagtggagaagagctaaataggtttgagatattggagcccaaaatgtctggcactggtaacttccattgtctggcaagagcgttgtcatcctttcctcagcttaaccctcaaatatatggggaaagtctgcttacagctttcagcatgactaaaatatgctttctcttgtggaaaaagagttaaaaacccagcaatgttatttaaccatactagtattgatgatcttgaagaaaatagaagattgttattgagatagttctgagccaaactcatctgctat

SEQ ID NO: 72865 - DNA, 1034 bp, Homo sapiens
taatcaaagcactttgggaggccaaggtgggaggattgcttgagcccaggagttcaaaaccagcctggcaacataatgagatcccatctctacaaaaaatgcaaaattagctgtgtgtggtaacacatgcctgtgatctcagctacttgggaggctgaggcaggaggattgcttgagcccagaaggttgcggcttagcgagctgtgatcacatcactgcacttcagcctgagcgacagagtaagactcagtttcaaaacaaaataaaaatgctattcttcatacacaatgaccacattacccatctaaattattgcatcaaatttgagatactaaatgtggcattcatataggaaaaaagaacagtgtcaagattacagtaaaataatcccacatattgtagttatattttggaacagaggtagtaagaaaaagctattccatcaccaatgcaaaactgatcattctaaatgattttgaaaaatttatatctgatagttagctctgtcacaaatcatttcaacatgcatattgatttcacaaatgaatttcctccttcagcactttctcatgacaatgtaattgaaaatcaaatcctatggagagacttttatagattggagtatgaatgtctctaagaccttagctttgctgggattactggtcaagacagtttgaagtagccagggtgcagaagaataagccagcaggcattgctgactctgaacacagcctagaacttgttcctggaagaaaagttgaagacaccaggggaaattttggagaagaggaactttgggactttggggctaatgaagcataacatcagaaggaaggggtagagtgcaacaaattattctcataagtcaaagggagcccaaaccaggaggcagccaaacctttaaaggggaaaaaaagaattcagacagaactgtggatttcatacagccttgtaaacagtgtgggataaattgtctgcagggtcactgaagcagagagtacaaacaagcttgaaatacttccatatttatatag

SEQ ID NO: 72866 - DNA, 1052 bp, Homo sapiens
ccctctccgctccactattttcaaataagccacctctgccttcatggactgcgagctagtgactctaggctgtgacaccactgcatcccagcttcaaatctccccttgcaggcagtttgtgggggaaataataaaattagcatcctaacactacaagtcgtgagaccgctcaggaacaatcctaatttgcatactggaactcctgtagaagatactttgaaccgctttagatacaataggatcaggtaaaacggcgctgccttgccagccactgcaggttttcacctgacacagcccccagaccctgtctacgaatcccccagctggccgaaggggccgcggccgcacatgcgcagtcagtcccgttggttgtgcgctcagccccgcccccagaggcgccgcgctccctgacagcccgcgggcgtacacacgctgacgcgcaggctgcggtcgcgcaggcgcagtcggggcgccttcccggtataggcgccttttaccccagcgtgtcctgagtctttggttcgcgaagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcaccctgctagtgatgcaaccctgtgctgggcaggacgaggctgcggcccccgggggcagcgttggggcgggcaagcccgttaggtacctgtgcgaaggggccggggatggcgaagaggaggctggggaggacgaggcggacctgttagacacttcggaccctccggggggaggcgagagcgcggctagtttggaggatctagaggacgaggagactcactcggggggcgagggcagcagcgggggcgcccggaggcggggcagcggtgggggcagcatgagcaagacctgcacctacgaaggctgcagcgagaccacgagccaggtgg

SEQ ID NO: 72867 - DNA, 1850 bp, Homo sapiens
ttggtagaaccgccagtgaaattttggttcaggacctcaaaaccacggcaaaactgaaatctgttttctgaaagatgataaggtcttggcctaacacgaactccctcaggctataaaacagtggtaggaagggcagcttccttaccccaagagagagccaattctttgcatttgccatatacccagcataaaaccagactgtggtctttgaagctgttcctgaagtgacagtggagagaaccgggcagcccagaaaccccaggcaaggagattgatcctgcaagagaagggggttcatcatggcggatgacctaaagcgattcatgtatcaaatgttacaaagtgttgaagggctccatgctattgttgtgtcagagttggagtacctgttattaaagtggccattgataatgctccagagcatgctttgagacctggtttcttacctacttttgcccttgcaacagaccacgggagcaaacttggactttcaaaaaataaaagtatcatctgttactgttacacctacctggtgattcagttaaatcatttacctttggtggtgagtttcatagccagcagcaatgccaatacagaactaattgtcagcctagaaaagaaacttactccattatttgaagaattgagacaagttgtggaagtttcttaatcagacagtggtttcaatgtgtaccttatctttattataacaacacaatatcgatccagcaatctttagaccataatacttttatccatgtcctcaagaaagggcctctttttccaacttatactgaagagcaagcatatagataaaatttatggacggattgattgttatattttctggtgtagggtcttttcttatttagtgagatctggggataccacaaaaatagttcagtctgtcacagcacccatggagttagtccagccaccaaatatggatgagattctattccgtggatcagaatcaaactggtacattgatccatttgagccattaagtgctctctattgtacaatctgcccaggcctgcagaatgaagcagattttttattgcgaataataatgagatatttttcttcagattatgttttatttcttctcattgagtgtgaggaacataaaatggcttagtaaaagcaataaaatcagtacagtcactagctttcctttgtacttattactttatgatatagatgaatattactgattggtttgattcttctcagagggtgctgctctttaatgaaaataaaaattatagctaatggtttttcctcaaactctgctttctataactaatcagtgttttaatgtttgtgtgttctttataaaatttaaatgtaattggttactgaattctgtttccaatattagtattatgtaaacatgatagtataaccattttttcatgtgagtatacataaaatagtattaaaaaataaaaaaataacagattgtaacaaagtctgtagtcatccatggatgcaaagattctgctttgtacgtctcttgtaccttaagtttgagctagcatgataatggttccactcagagtaataactaggaatcatagcctccacactcctcccacctcaagtctcctttctaaattttatctgtaactctgtcctgatgctgcagtttttctgcctcccattcggactttccttgaaagtcatctttcattccataatcactattgaatgctttcctaagtaccaggcacccgaattaactatatgaacacagagcactggcccttagtaaaggcagcctaagagagagatacatctaccaacgattatcacacaactttgtgtgtcaccgtaggggagtgggc

SEQ ID NO: 72868 - DNA, 1059 bp, Homo sapiens
tttatgtagaaataatcatatttatctgttgtgctgtatctttagttgtttcatatgtaattattttcagtaatgagcactcagtgagtagtttttttattagacttctagagccctcaccatatgtagtccttcctttctatagtagggccgtatgaaattttcactatttagatcctctcaagtttcatttcacttcaagatgttctgtttttgtttttagagaaaaccactccactcacttcagctttgaaattgtttaactttttggtccatgatttaaaaaattaaggtgctaaaggctcacaacgatcatgtagactgactttaaactgatacgttttctgctgagtttatttaagctaatttgtttttaattatttttaaatcacaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtctgccttttgataattttaaagaaataactttccataagtaaaaaattatatatctctttggatataaatgatttttaaaagatgtttatttaaaaagtcagattttcttttgtttgtttagcttcattatcattataattctgagaaacataatttttgtagacagaagctattcttaccctaaagtgcctgcataactctcatgaacttaactataaactacaatcatgtaacagttttcagagatttaaaaataaagctagggtataagtttaaatgtacataaatttatccaaatcaaagaaacctatttcagcctatgaaactttaggaaattatatgttaaaggcaagaatacagacttagtcacaaaggtgttcatttccttatagtcttactcatctctagcactggaggccaaggtgggaggatcacctgagcccag

SEQ ID NO: 72869 - DNA, 1050 bp, Homo sapiens
aggaaggccctggggacactattagaaaagtaatctggatcctctgatggtagaagaaaataggcaaccaactctaaagtaatgtaaaacagtctcaactagagcatctcagagttttgttttatcagctgtctgaatcagttgaaaatgtcagttctttaccttgagctagtccagttaaggttaggattgaaaaccatcaatcttgaaattttccaggattaaattttttcttggaacccatgaggctagttttacctctgtgagtttctgagttgtaatagagatacaatattatgcaatgatattctaaattattatttgacttgaaacttctgaactactcagctttgaattatttgatttctgtgaatctgatcttcagatttatggtataagctttatatctgccatgtaagcttctttaaaacatgccaaggtagagatgtagttgtgttctatttgtctttaaaaataaatatcaatatattttctattttagggcatttgatgtagaactactgtacatagcacagttctttaaaattccaatagcagaaattgctgtcaactggacagaaattgaaggtgagtatattgtttattgtatgattgtcttgagtcagataatacagttgtttagtaaagtcagctggctttaatgttctccttgctcccctcatcaagcccttctcagctgtcttgactcaaagatccagttccaaggagaatagtacctactaataccttccatctggcttgctgccttttatattttttgtctgttcatggggccttcagtaggcctactaccttgtcgaagaaacttcaataaaacttcctacaatagacaaagtcatggtgatctgaaattagaaggttgatagtcttttgagatagataaatttattttttgcatcaccatttcctatattttttttatcactaggtggatattaattaggtacctgcaaaccactatgcaaagctaaataagaaataaaaattttttttatggccgagcaccatgcctcatgcctgtaatcccag

SEQ ID NO: 72870 - DNA, 1035 bp, Homo sapiens
tgagccgagatcgcgccactgcactccagcctggacgacagagcgagactctgtctcaaaaaaaaaaaaaaaaaaagttcaggtttctcatgtgttggagcacggagcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagtcacagcaccagctcttttataaagagggagacccgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcggcgcaggcgcagacgcgcgggcgggaagatggcggctgggttcaagtgagtgttggcgggtggcgggtagagttctgtaccctggcggacggcagcttcctttaactcttagctgggattctctcacctggaggccgaccccgttggggtgccatttccttcctcgtcgaggcagacgatgggcgggaggacctggaggttgtcacagtgaaaagaaagggcttcttcctcagtgagacgggagatgaaaggactctgtagagttccatacccgctgcgagcgctcgtgagcgtggtgtgtagtgaacgtgcagtcccaggagacatagttgtaatcttttaaagattgtggccgggcgcggcggttcacgcctgtaatcccagcactttggaggacgaggcgggcggatcacctgacgtcaggagttcgagaccagcctggtgtacatggtgaaacactgtctctaataaaaatataaaaattagccgggcgtggtggcgggcgcctgtagtcccagctactcaggaggctgaggcaggagaat

SEQ ID NO: 72871 - DNA, 1020 bp, Homo sapiens
tgtggtctccgtggttgttaaagttgcaggtactgctaatgttactatggcttattgcttacagtcataattgaagaatatgctaaatttcacttacagtgaaaataaagatgtacctttttgtttcctgagttatctagtaagaggttaactattcatgatcactagattattaaaataatcttttttcatgatcactagatcactctgaatccttgtttcagagcaagaacgacatgattcttttgacacagattgagcttttaaagagctcactcaaagggcttttagacgccaatcttctaatcgtttatggcagagttaaggacagcaattgaatgtgattgctactacaaggatttttactttctagaattacttttagttaaaaagttgtggagatttatgctgcatcaccacacttaagatctttgccaatttctggatttatgttaagattcatcagtttatctcagatatatttttaacacgtgtttcagaaccgtggaacctctggagtattacaggagatttctggtgagtaaaggttatgtacatgttatgcgttttgataacgagctgcttttaaagatgaatttcaagtaatttaaattaatccatttgaagtaacatttaatgtgtgtgtaaaacttgtgatagatgtgtaaaatatgtaataggtataatctatttttatataaacatatttatttagaaagagaactgccgtcctgatggaagagaacttggtgaattcagaaccacaactgtcaacatcggtaaggatgtattttccactttcaactgtatgatattcccaagttttagtctatgaaccagccaaacagtttttcacccaaattctttgtctaaaggatttgatgattttttttgtcaagagatttttatccgtacaaaagccctgtaactaaatgaaaaatgattaacacaaattcaaggacaggtgaataattatttaaacactaatttaaaatagttatgtaaaaatcaattattcta

SEQ ID NO: 72872 - DNA, 1046 bp, Homo sapiens
catcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaatgtggtggctgtttatttgggtttcatactcttaattacttcatccatcagttttttaacttctttgtgtcttgtaactgctcggctcatacagtcctgaagtttagctccagttagcccacttccacctgaaaaattattttgccaatacttttaatctcagttatcattccttttcaaaaaacattaatgtcatgtcaaattataaaacaaaaaaattggataatgtaaatcagggtacagtctcaagatctacaagttagtttcacaagacctccaagtgattctaatgtatgtcttaagtttaagaaccactgacatataccattaagatggaagaacattttaggtagctaagaaactatactaaaattaggtaaataaaatatcccatattctatttggccctccctaatttaaggctcacactgagttttcatctacatatgtttaggactgaagtggcgggaacatgcctggtttgtgaagacaacagagtttgccttcctcatccattactattgttaaggttcctgttgccagatgttcctcctctccagtagggtcaactataagcaaagtgctataaaaagaaaaaaatataagttatc

SEQ ID NO: 72873 - DNA, 1025 bp, Homo sapiens
ggaacatctggcaacaggaaccttaacaatagtaatggatgaggaaggcaaactctgttgtcttcacaaaccaggcatgttcccgccacttcagtcctaaacatatgtagatgaaaactcagtgtgagccttaaattagggagggccaaatagaatatgggatattttatttacctaattttagtatagtttcttagctacctaaaatgttcttccatcttaatggtatatgtcagtggttcttaaacttaagacatacattagaatcacttggaggtcttgtgaaactaacttgtagatcttgagactgtaccctgatttacattatccaatttttttgttttataatttgacatgacattaatgttttttgaaaaggaatgataactgagattaaaagtattggcaaaataatttttcaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaggaacaaaaagtaatgcaagactcaaaattttggagtggttggcgtgcctctcttcattttactttttgactggctgcctgtatgccgatgatgatgtagctgagctgtttgtgctgctgctgctgccatagccatt

SEQ ID NO: 72874 - DNA, 1485 bp, Homo sapiens
cataagctgcttgtttgtactttctaatgtatttagtgctcttttgtattgatgtataaaaagagtgaaatgaaaaatagcatgtgaattggaatagctaactactagcttgaagcagaaaaatttatgtttaagagtattagcatacttgggagcccaaagtaataggacttaaaaacagtttctaaataggtcttttttttaagggcagccaacttgttttttctttacctgtttcttcaataactagaagagtgacacatagcaaatgatccaaaaatatttgtagaataaatttaaatatttgatataaaatcatgtgaaattggttaatttttgtttaaattcttaatagcttccaggtggttcacttatttttaacactctgcagcagcagcaacagcagctctcccagtttacaccacaacaacctcagcagcccacaacttgtagtcctcaacagccaggggagcaggtatggattttctagccttccatatgcttttacatcgaatttataacattttttggtatattccaagcatacttcatttgctttgttagtgtaaacatttcctgtactgtttttattaacaatagtagcaatcagctattgggtgtgtattcctaataaaacagtcataccatactgaatagatggtatcacctgcatcttgcatagatgattgagatccagataaatggcttgctcttagccatacagtgagtggcagagccagagattcaaacctaggtctttgtgcccctatcactcatgtattttctaccccatcattatctttctgtttttaggattttgttgctattggaataaagatatccctattatcataaaatgtagggcagtgggaacacagacaaaaacaaatgtgtacactgccaaagggaaagaaattgaataagaattgcaataaatgacagtagaagaaggaagtacaagtgtttctaaactttgggtacactggagtcatctgggaaattaaaaaaatattgattcctgagtcccaaatccagagtttctctatctcacaaattatatgaaatattcaccattagtccttttgcccagtttcccccagtcaggtcttggttggataaagctcatcctctaatagagtcctcaggaagggcacattaaaaacttactgttttttcattctaaacacattaaagattgcttggctagatataaaatctttgattttcttttaaaaaaattaattttaaggtacacataaaatttaccattttaactttttttttttttttgagacagagtctcgcgctgttgcccaggctggagtgcaatggcacaatcttggctcactgcaacctccacctcctgggttgaagcgattctcctgcctcagcctcccgagtagctgtcgctacagacatgtgccaccacgcccgactaattttttttttgtatttttagtagagacggagtttcaccatgttagg

SEQ ID NO: 72875 - DNA, 1032 bp, Homo sapiens
tacaaggcttcgctagtgttacatgtgcatttcttcccttaaatctttaaaaaaaaaaaatgatatgatagagaactagatacatttttaaatagtgttcaaattagtatattttgttagcaaaatatatacataccttgagaccaggatcaacaaactacagcacacagcctaagctagaaatggttactacatttttataggattatgaaaagaaaatgcagcagaggccatttgtgctcacaaagcccacatgatggccctttattgaaaacgtttgtcacccccagctttaagatatgctctgtgttaatgtaacagattttttaggaataagtttaaattaacagagcactgtttcctgactctgttttgatctttatacacaaattgcaacattctttagcattctgattaacatttttagttaaaaaaaaatagcataaagcacaccggttcttagagatatgattattatagtatactatgtagcattgagaaatgtaaatagatgccaatacctggaatgtatttgcacagcagtgatagttttgttatattcatggtgttcacataattcttgattactctttgttcagccaacagtcagaagaatgaaaaagaagtcccagtttctgaaatatagaatataatgtgcatctggtgcttcacaactttgaataaaatctcagtattgataaatattgaagacaatcttttgtttttaagatatttttgaagtatggaaaataagcacatctatgcagagaatacataaaattattgtacttatatatactaaagtataaattattttcatgtgtaataaactttcaattctgttataaccatgagttttatttaacaggtgttccatttggtttaaaaaatacttcaagtctcaggcccttaaatctactccaggtaaacctgaaatactgcttttgattaaattttttgtacattgactttttttctaaacaatgtatatctatatgtatcagcacttgaaattctgaggtctgtttagat

SEQ ID NO: 72876 - DNA, 5061 bp, Homo sapiens
tagctaaggaagatgatttctagatagtactttaatcagaatctaagaaaggaattgagtattttctttggctgcttattacttaagtaatccctgtaatttctgtattagaaataagatattgaaagtatatctttagattgttatttagcacaatgttttggacaatttgtcattgaacagtttaaaaatatgtacttttaatacaaagataaattgcctaatttttaatatttatgttaattttgatagaactttctttttgccattaatagtcattattctttcctataaaataaatttgtgtttaaaacaggttttctaatctttacctgttttctcctgatattttagggtagtcaatcagtaccaagaattagtccagaatgaagccaaatgtccggtcaagatgtcacacagctccagtggctcagccagtctgagtcaggtttctccagggaaagaaacagatgtgtgtttcattaatgttacttctttgtgcccagttgtttcacaagtaatctgagaaatgttaagaatcatttttggaggctaggcacagtggctcatgcctgtaatcccaacactttgggaggccaaggtgggtggatcacctgaggtcgggagttcgagaccagcctgaccaatagtgtgaaaccccatctctactaaaaacacaaaaattagctgggcatggtggcacacacctgtaatcccagccactcgggaggctgagacaggagaatctcttgaaccccggaggtggaggtttcagtgagccgagatagcgccactgcactccagcctgggcaacagagcaagactccatctcaaaaaaaaaaaagaatcattttttgaggagcgggggtacagtttagttttgtttctacttttacctttttttaaaattatttaactctttataacatgatttttaaatgtacacaaagataaaaggaaaattacagtgaacacctgtgttctagtcatttggcttcaacagctgttattttcctttaatagataagtatggaagagtggaagcttgctttcatcttactcctctgcctttctccctaaaactctctcttcccaccctattactcagaaatcttttcctcattctttatgtgtactgtaatatatttcatgaatctcatgtgaaattttctctgtaatacatatagtattcaatctgtaaccactaagagcactttgcagagttaaaaatctgggatttatagcagtattaattttatttaataaactatgaagttaaatataaatatcatctggggtttatagcagtattaattttaacaagtaagcttaatgtcattgtcttttagcaaactgaaaccgtgtcagttcagtcttcggtattggggaagggtgtaaaacatcgacccccaccaatcaaacttccctcaagctcaggaaatagttcctcaggtattacatttcttagttttttgcagtctagaataacaaatattatataatcataatctctttttaaaactttgccccattttgatttctacagttcacagaagtttgaattataaatttaggaaataacttttatgttcttctaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttcttaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatacattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaatttttatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttggtaagtttgcattgatgttcggattttttttttataaagatagtttcaccaatctaaataaattcttaatgtgtgaaattaagaacaaaccgcatattactcagactgaaaaggaatagtttagatatggacagaagctgcctgaccatgtatgttttaattttaaataatacatctgttaactgcactaagatgatatctcatcttatcgtttttgttttttgatacttcatcttgacagcagcttagaatttcctatttatcttctgcattactttctttgatatttaagacagataaataactagttgtgtttgcttagtagttttgttttttaatctgaggaattgtgtggctgattttttccttttacagtgaagtttaatgctttgtcttattctcctgcagtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtcagaatgttggaaataataacctctaaaaaaaattaaagtatatgctaaagtaaaaatgtaattttaagagtaatgctaaaggcatttaatgtcattatttcatgaagtgttgtatcacatatatttcacttaaaaagcctttaaaagttctggcatttgaattaaaagtcttctagcagtcaacttctgtggaaaacttggtaagcctgtgagtctgtgcaaatctttcttctgctttccaaataacaaaattaattttggtagccttattgtcattgtagttatattccagggaaaataagtgtattttgaaaatatacattgtgtacaagaggcaactgcatcgcagttaagagcctggattctggagccagactacctcagcttgaatcccagttgtacagcttaccatttgtgtcatcttgagaaagttacctttgtgtttaattttcctcataaataaaatgggaatagcaataaaaacttacctcatagtcgtgaggattaaatgaaatataatacaaattatgtgtttaaactgtgcctgagacatgataagcattcttttatttaggagtagttattacctatacaggaaaacagttataataacttgtgcttatttttttgatgctctttaaaataatgtattataatatcttgaaacgattcagtttcacttgaagaaaaatgtaataggaaaaacaatctaga

SEQ ID NO: 72877 - DNA, 1054 bp, Homo sapiens
gaggtgggatcttggctcactgcaacctcttccacttcccaggtccaagcaattctcctgcctcagcctcctgagtagctaggattacaggcacctgccaccacacctggctaatttttgtatttttagtagagacagggtttcgccatgttggccaggctggtctcgaactcccgatctcaggtgatccgcccaccttggcctcccaaagtactgggattacaggcatgagccactgcgcccagccttaaagagcaattttaatgaagaacttcatttttacttttggtttgcgtattggtagttctgatttgttttgtttctaattaataaattcttctaaggctggcttttaacagaagtgttctttataagttttcctaattgcaataataacgtcttaaaaagagaggaataggtgtaatatttaaattaggtgaactctgggagtgaaatgatgacagatgttttttgtgtgtgatagcaaaagcagacaaatgataaatagatctgcttttgaaagttttatccttttaatattatttaatatttgcaattcatatatctagtatgaaattctgccatattaagcttgattaaacatgccatttaaactctcattcccagagtaccatgtaaaaaagaatcctgtactgccctcctgagcataaacaggcacggcagcatgaggatcaggggtgcaagcttagggacagactgctaactccctgtgtgaccctaggcaattcatttaacctctctttgcttaattccctgacttctaatacggaggtaataacagtgccaaccatgaaaatatggtggagctttcagtccctgtagagtgctgagaacagtgtttgattaatgttcattgttattatatgtatatcaatatgtctaataatgtatttaatgatgtattaatattgttacatatgtgttcatacttcatagtatatgttaatgctttactaaatgcatgctgagtgcccatatagtttttaggaaaagaaccgtgctgtgctttattctcataggcagacttaaatat

SEQ ID NO: 72878 - DNA, 1169 bp, Homo sapiens
ctctccccattccttccctaatgttgccctccttatcccatactctccacagtactcttttgcttctcttactgcttcttggtgtctgaaatctgaaattattttatctgtttacttgtgaatgtctcctccccctctggacttgatagctctgtggtgatgggaattttgtttgtcctattcatttttatttcacctagtcctagttcctaggactgtgcttggcatgtggcagtgttctataaacacgatttgtacatattcagcactgactagtttcaactcacatatattatgagtttcttttattagtgccgtttagttcaaatttcttaatatttcaggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaatgtaagtatatatattttaaatgaagcttattatgcccaaaagcctgtcttatttagcattttcagtatatttatattgtttttaatttttcagtatattgtttttaatttttcagtgtgtagatatgtggaaacggagtccctgtaatttggccataccttctgaagtagatgtaagtcagttcatgaattactttttttcatataaagtttctcagttttactattcggttgcttataccttgagaaaacaaaaaaaaaacttactttaaaaacaaagtgatttagatcatactctaaacaagttttttaaaaacaatatgatttatttcaaaaaacatcgaaaaatgatttttagaagctgtgtattgttcttttttcacattaagttgaaagaacataaccccttaatatagttttttggagcaggaatagtaaaacaattttaaaattggaaaaatacagtgtatattacataatcacgtgaaatctctctttttttgataatatttcatcaaaatttcctaatagtgcttgtttactcaaactggttaaatttgaagattaataatattatttgacataaaataaaataaagattaataatactagagaagtaaccaagattaggaacattgggttgtattctttattgatccataatataca

SEQ ID NO: 72879 - DNA, 1049 bp, Homo sapiens
caggcagtccagtaacatgaaatctcctggttaccaaagtcggcacattctcttacgtccaacaatgcaggtaaggatgtttaattaagaaatactattttagattttagttgggagttttatttatcgaattcttcatatgtttgtgcatagattaataagttttttaaatttttatttcttctagactttaatttgtgatgtacattcaataacaagtgataaccacaaatggacccaggttagttgttttgttttttaatctcaaacaggcaaaatataggatgaaaaaaaattatcattaagcaaaagtgattttctgcttatttttattcaataattaagtttgatgctttatgtgaaaagctggtattcctttataagatctagaagttaagggtctctttatatgtgtagtaatccctcaagttgcctaagatcattttaaggtcaagctggcctaatatattcaatgagataaaacttagttctttatctcctctcaaacagaagaaaaatgttttgtttttaccatggttacaaatagatactggttttttttttcaaataattcaagtttctaaaccctagcctagcctatctttctttgccatttatactggttgccttgaaatgaggggaactctcttacccctgagaataaccagttaacccctccagttctggctcagtgttatatgaggggacttcagaaagtttgtggaaaactggaattaaaagataataataaaaaatataaacttttcttctcaatataagctccatcaagttcaagatgcttgtaaatgatatcaaccatttatttagtccacccctgaagaactgagggtcctgggaactgaaccatatcaatgcaatcttttctacattattaactgaagaaaaatgggtactttttaaactttttttttttaagattaggaaacaaaaagaagtcagaaggagccaaatctggactgtaaggtgcatacctaatggtttcccatcaaaactcttacaaaatttctcttttttgatgagaggaatga

SEQ ID NO: 72880 - DNA, 1002 bp, Homo sapiens
tataagcatttttaaaatcatggactttgttgtggtttttaaggagctgttgaattggatttatagaaaatgtccaaattgcttacttcgtcttaccaattagatatttttaggttcaacatttcagcttagagctgttgaacttgtttgtatcttatttagcctataaaatatttaagaaatgtgcacttcttagatacaaccaaagagaatgccccaaattctttaggttagacttctacttagtggaaactgtatgcttctgtgttttatatatttgcatttaatggttttatatactacttatttaaatatttttatttcttaagtattcaaaagtacttgttttatatttaagtgcttttattgtgttataggtcacccatttttaaaatatgaattaatttgcataaaacatagtagtaaataaaaattaagtttacatagctgtcccatacgtagtggctatagttttgtgagccttctccatttattcagaatcataatgcagaaagagcaccaaaaggttaattcaagcctgattttgttaaatcatagcattatttgttaaggttatactggattattttcatgagctctgcctctttttaaagcagaaattaagaagaaatgtgaacttgttagagaagcttgttatgcaagagactttgtcatgtttagtggtcaatctatacccaggaaatgagggatattctctgatgctcaggggaaaaaacggatcaggtaagaccctctagagcacagctgccacaaaatacttttgctaggcaggatgtgcggtttttttaaagtagttttttaacctgctaaagcatttgtccttcagatagtgatgacctagtgataaaaacagattttgatcccagttttcttccttatgatatgttttggtagaatattagaaattatctctcttacaattatctttcctgaatgtgcattttagaagtattctaattgatatgtctttcaagtccaatt

SEQ ID NO: 72881 - DNA, 1010 bp, Homo sapiens
gaaggcggttttcttggtgtccatattgcataaaggcttgtcgctcctctgtggagatgacggttgtacaggtaaagcctaagttgtgacaaaagctcctgcaatgggaagactctggtcgatcagggaaatcagtagaattgatagcaacgcgtagaattgatagcaacgcttagaattggattaattactggccatggttacccggcgctcagaaatgaacttggagaacagttgccctggaagccatctcccgtagccactgcgtagtgggggccgcgtcttcttgagtgcaattcatcaaagtctctagtaggactcaaaatataaagtgacgagcaggattttcggagtcgagtacagtgtacttgggttgatcaccatgttataaagttagatccaaattaagaaatacatattcgtctctgagcagaattgggtcctttttttaattgctttgctttttttaaagaaatgtaaaaacagatgccggtttgattagtttgcaggttgtaatattggaagggacctaagattggacacagagttctgaattctgatctaggtctgtgatgttaggaaagtcagttgttctgattgccttattctgtaaaacggaaatgataatgattacagtttcctcacaggttctagtaaattctgtgtatagacagaatgtttgctttgtgagagatatgaagttattagtttttgtctgaagtacttaaataatttaaagttagtaagcccccatccccaatttagtgacaagaaatcttaaagtcatcacattttgtccgaaaagtacatagtgtatcttcatcttcaaattcagtggtcagaaaattttcacgttcacctaaattcaacttaaacctcctacgagcttttcaagggtaggagtaatatcttactcattgtaaatgatcgtaaatcatttacagttgtatggtgcttgtgtttgtgttgtattaggaggttagtccattttttaaagtttcagacggagt

SEQ ID NO: 72882 - DNA, 1046 bp, Homo sapiens
atttgtattatatttgatatacatgactattaaatatatatgtttagtgaaatgctttatgagaaaatacaaattaaaatctcagatataagaggctggtcagtcattgtacacatacatacgtgtgtgcacacacacatgttaagaagatattatttaaagctagaaaattgcttaagagattttaatcagtgacaaataccatgaagatatcctttttcacttcgtcatcaatgtatattagaaaacatgcataataaaggccagccagtataactcattgatcttgtatccccaacaaaggctaacagatgcttgcaaattcaataatctgtgtggtcattttcacttaaggtgcttgctgtaaatataattgtcaatccgtctatatctatctatctatctatctatctatctatctatctatctatctatctatctacagaattgtgcactttagcatatctcaaattatgctggtgacaactttaagagtttattttgcttctcagacagttgtcctataaataatggtgcaatctgctgtagtgtaatctatattattggcagaattcttcatgtttgtgcatcaagtatcagcaaaaatacattccacattttcatattgagtaaaacattaacctttgaatctcttaggatgcactttataaatataagcagaaataaaaaagaaatattcacaggttttacatatagacaaaatggggctcactagtacttcaaaattaaaagcactagatcatagacttaaagacatatggcaccattatttagtccttgtcaaaattttcaattaaattattgtaaaagtaatatatattctgtcacaagaactatgagttttgccttaacaaccttctttttattgttttgacaaaatttgccattgctttaatttgtctttatttgcgtaagtctctaagcccaccctttttaaaattatagatgtcaaaacctctttagttttaaataataaaaaaatgcatattgaatttggtgttatttttggttattaatttcataag

SEQ ID NO: 72883 - DNA, 1332 bp, Homo sapiens
caaagtgtgagtagctcggccgagatgggccttttggggccggacaagacggggctgggttggggatgatccgagcttttccaacaactaccccacgcagtcttcatctcttcacttcatctactttcctggctcgcgcccttccaggagcctttcccaccggagcctgcgaggagaggtccgtacttgctcgctaagtgtcagcttggcagcttggccccgtcacgagggtgtgggtgtgtttctgattagtgacctcccctcggaattcatttggtgggcaggtggcgcgggaggacaggtggaccaggttctggtaatttgttgggattcttaaacagtccccatctgctggatattagaaaagcgtttcaccgctttggccagctggttgaggaagttaaggaagacattccatcttgatagtcaagactttgaaattacttgaacatttgttattccgcggcttctgagtttcgttgtgtatgagtaactcagcagtcgggcatcacaaagtaatgagactcagatcacacccttcctatgctgggatttaatagagtatttggtaggaatgggaaatgcagataggggatagtttatccatgtggggcctttacttatccttcgcagttgagtgatagattttaagtaaacactcttgaggttattgcagttggaagtagcatgaaatgtagcaaagaacaggattacaatagaattttttgcataattaattagtaccttggcctacctagctgactgataaatttcaatgatttaccaatccatgatccgtacaacctctcagccttttcctcccttgatcttttcatctccaaaatatccctgttacactttatctcaggtgttcatggttgcagcctagaaccttaagattccaataattgctccatctctgagatgtcgtttacaggcactcttatggataaatacattctctcctacatgatttactataatttctcatctacaacgtttcatttaatccattaatcacagtgattttttatctgtagctatccccacttctattccttaccttactccttatatagttaagagtccattggtccacctttaaatcattctcatgcaaacaccctcaactctggtggccctgtctctcctctcagcatattttggttagtgaaacaccaactctgaaaccagctgtttgtattatctgtacatagctgactgcccctggagaaaataacagactggagggtttacattaaattcatgactacaattaatagtacctagtacttaatacattcttcaagtttgctcattttcctccttatt

SEQ ID NO: 72884 - DNA, 1119 bp, Homo sapiens
ggaagtattcatgattaaattattcacagttacttgatgaaagtattcgtcagagttttcatggctggtgttattttaaattttaagcgtatgttggattgtgaagataggagaataggaacaagacttaaaaagcttggaattggggtctcatgatgcttgagcttttgtacccattttactgtttactaaatcatttattatatttaataattgtcagaatattaagataacttgatttttagatatctaactttatgttttgtttgtttgtataggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttgtgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttg

SEQ ID NO: 72885 - DNA, 1083 bp, Homo sapiens
caccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaaatgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgtttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttt

SEQ ID NO: 72886 - DNA, 1125 bp, Homo sapiens
ggggtagtaatgcatacatcatattgattagtccccagtcatcagctcaagtttccaacagaggctgaaaggttgtgctctggagatttcttagccatgtatgttctatgtacacaaacacaccattcaaacaattgaagttgcttgcttacttatttctagtagccatattgctttccattgcctacactacttaacaaagatacaaagagttctgctcagcattcaataatccttttgatacagaaaagtgtgggcacctaaaataccttctaaaagaacaaagtgtaagcaggaagaagctattaacatagaggaaaatgggaaatggaagcagcagagccaattataggtacatttctgcctgttgaagagacctcaaaatagaagatttaaaaatctgtctccaaaagctttttttaaagtaaaaattttaaaaaggtatcataggccatatataaaaaagaatatccatcctgtctaccaaagtaagtgctttcttcctcttccttgattgaaggcacaagataattgtctcttcctgatgctttgtttaaggattctaaataaaccagtctcaggtggcccccttaagagcagtccccctaggaatctgccactgaatctcgaaactataatttgttccagacactctgtacaaaatacatttctttcccaatctctaaacttgataattagatgtgtttagtcagaattaaaaataaaatcaagtggaaagttattcaggtgcaagttattaacctacagtgatggcagaacagaaggggacttcaccaagtaaactcacatttttggtgcaagtcacatgttttaggtactttgctaagctctttattgaacataccgctttattcttgatgataatctattaatataatattttgattttgtagatgttgagagttaagaaatgacatatagaaataaatggtagaagtagattcaaacccatgtttgtttgactccaaagcttatatttcttcctctcagttccagaaactgaggcatagggaaagaatgctcagagcatgccaaactcatttcttaccttctcatcatatgccttagtatgtgtattgggccgctgtaacaaaatactatggg

SEQ ID NO: 72887 - DNA, 2115 bp, Homo sapiens
gcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagggactggatacccatggtggtggagctgcgttcacgaggggctcctgtgggcagccctgctttgaaacgcgagcacttccaggttctggtgaggatccgaggaggggccgagaacactgcacccaagcccagtttcgtggccatgatgatgatggaggtggaccagtttgtactgacggccctgaccccagacatgctggcagccgaggatgctgagtctccctctgacctgttgatcttcaaccttacttctccattccagcctggccagggctacttggtgagcaccgatgatcgcagcctgcccctttcctccttcactcagagggatctgcggctcctgaagattgcctaccagcccccttctgaagactctgaccaggagcgcctctttgaactggaattggaggtagtggatctagaaggagcagcttcagacccttttgccttcatggtagtggtgaagcccatgaacacaatggctccggtggtcacccggaataccggtcttattctctatgagggtcagtctcggcccctcacaggccctgcaggcagtggtccgcaaaacttggtcatcagcgatgaggatgacctagaagcagtgcggctagaggtggtggctgggctccggcatggtcaccttgtcattctgggtgcttccagtggcagctctgctcccaagagctttacagtggctgagctggcagccggccaggtggtctaccagcatgatgacagagacggctcgctgagcgacaacctggtgcttcgcatggtggatggaggaggcaggcaccaggtacagtttctgttccccatcaccttagtgcctgtggatgaccagccacctgttctcaatgccaacacggggctgacactggcagagggtgaaacagtgcccatcctgcccctttccctgagtgcaactgacatggattcagatgattctctgctgctttttgtgctggagtcacccttcttaactacggggcatctgcttctccgccaaactcaccctccccatgagaagcaggaacttctcagaggcctttggaggaaggagggggcattttatgagcgaacagtgacagagtggcagcagcaggacataacagagggcaggctgttctatagacactctgggccccatagtcctgggccagtcacagaccagttcacatttagagtccaggataaccatgaccctcctaatcagtccgggctacagcggtttgtgattcgtatccatcctgtggatcgcctccctccggagctgggcagtggctgtccccttcgtatggtggtacaggaatcccagctcacaccactgaggaagaagtggctgcgctacactgacctggacacagatgaccgagaactacgttacacagtgactcagtcccccacagacacagacgaaaatcacctgccagccccactgggtaccttggtcttgactgacaacccctcagtcgtggtgacccattttacccaagcccagatcaaccatcataaaattgcttacagacccccgggtcaagaactgggcgtggctactcgagtggcccagttccagttccaggtggaagaccgagctgggaatgtggctccaggtacctttaccctttacttgcatcccgtggacaaccagccacctgagatcctcaacaccggcttcactattcaggagaagggtcaccacatcctgagtgagacagagttgcacgtgaatgatgtagacactgatgttgcccatatctctttcactctcactcaggcacccaaacatggccacatgagagtgtctggacagatcctgcatgtagggggtctcttccacttggaggacataaaacagggccgagtttcctatgcccataatggggacaagtccctgactgatagctgctccttggaagtcagtgacagac

SEQ ID NO: 72888 - DNA, 1318 bp, Homo sapiens
tggaacctgtggaggaccgatttgtatttcgttgttctgatggcattaacttttcagagagacagttcttccccattgtaatcattcccaccaatgatgaacagccagagatgtttatgagagaatttatggtgatggaaggcatgagtctggtaattgatacacccattctcaatgctgctgatgctgatgttcccctggatgatttaactttcactattacccaattccccactcatggtcacatcatgaatcagctgataaatggcacggttttggtcgaaagcttcaccttggatcagatcatagagagttccagcattatttatgagcatgatgactccgagacccaggaagacagttttgtgattaaactaacagatgggaagcactctgtggaaaagacggtcctcattatagttatccctgttgatgatgagacgcccagaatgactatcaataatggactagaaatagaaattggggataccaagattatcaacaacaaaatattaatggcaacagatttagattcagaagacaaatctttggtttatattattcgttatgggccaggacatggcttattacagagacgaaaacctactggtgcctttgaaaatatcacactgggcatgaattttacccaggatgaagtagacagaaacttaattcagtatgtccatttggggcaagagggcattcgggacctaattaaatttgatgtgactgatggaataaatcccctcatagatcgttacttttatgtgtccatcgggagcattgacattgtcttccctgatgtgataagtaagggagtgtccttgaaagaaggtggcaaagtcactcttacaacagacctactaagcactagtgacttgaacagtcctgatgaaaacttggtttttaccatcaccagggctcccatgcgaggtcacctggaatgcacggatcagcctggtgtgtccatcacgtctttcactcagctgcaactggctggaaacaaaatctactacatccacacagctgatgatgaagtgaaaatggacagttttgagtttcaagtcaccgatggacgtaaccctgtctttcggacattccgtatctccattagcgatgtggacaataaaaagccagtggtcaccatccacaagctggttgtcagtgaaagtgaaaacaagctgattactccttttgagctcactgtcgaagacagagatactcctgacaagctcctgaaattcactatcacccaggtgcctattcatggccatctcctattcaacaataccagacctgtcatggtttttaccaagca

SEQ ID NO: 72889 - DNA, 1989 bp, Homo sapiens
atgtcatttttgttgatttatatgaagaaacctcagcctcacgacactgtcccttttatgaagaattttatcatcatgctatatttaatgattagaaattgaatttcacccttatatagaaaatattaaaatcatcccgtttatagcaatcctcatattgcaaattataaatgtaccctttaggttagaaattatgtgattgagtttagatacatagaagcctatgacagaaacatgcacagccggtaatgtctatatttgaaagtgaagttcattaaagaaaggaattatctgctctcttttatggttctctctgattatatctgtgaaaaggataactactgctttgtcatttcagtttcaatttttattcttagtaaaaaaatcatttattgaaatagtaattacttgaattactttttatcatcacagcaggaaattatagcaagcgcttaaaaaaaatgcatactcaggaactacttaaaaaaacgtaaatggtttttgctgaaaagcttagcatacaataatgaggagtccaaaaatgtttttgttactcctaaaacagagtggcttttcaagtaggcctagcagctgaggttctgttgtctgaaatctgctccaggcagtgagcatgggaggagtcaggagtacctgcaagattagataataataatgactgtttcctctgcctccctatctgaggagccatcgccaccagtatttccaggcaattaatgtgggaataagcaggagttagttcaaatgactcctcacagtcacagaggtgctgttcgtgtaaaatctgacatccccatgtctttaggaaaaggaagagccttcagtggcagaaggaggagcataatcttccaggagggaggccttgtgcagaactgagatcccttaggctgtgcgaaagggcttcagtgtatcctaaccgcccctagacctagtagcacagtactagactagattgcgctgtttattcagcccagcttttctttgcctcagaggctcacttaatgatacaaggtatctcaaaccttgaaagataatttttaactagaaagtaacctatttgtaagaatgatttttagcaagtggttctaactggcatgtgttttctggccttagggagctacaaaattgtttcaaaaggaaacaaatggacctaaaaacaaatgactggtaattgtggctgagaggcttacgtatgaagggaacttgtttaaaagtgccatgattttattaactgatagatcatcaaaacctctctgtaaccatggaacaggtattgtttttaaaaagctagaaaaaaagtacttatatttcattataagattttatgttattttaacatgtgaaacctttttgacggtttacaacaaaatgtttctatttttacacacaaatgtttatttaatatggcattttctttctatccactgtcaggtatgcagcaagatcttatatagtaagactgttttgaacatgaggattatggaagaaggagacccacagttcatggttaaacctcatctattagaaaaataaagaaaaaattaatgggtagtcctagtttaaataaatactgaaaatcatcatgtaaagaaatttatattgatgctaaaaagtaaacatttccctttggtggaaatttaaattacccagcagacagtgttaacttttagtgaaagatgcacagatacataactcaaatgcaaaccgtttgttttttttttctgctttctttttttttctttctgttttcttctttaaagctcactttgagtggccttgcatttggcagtctccctggctcaaatgttcctaccccctttccctacttaaacgaatttctccatgtttggagacttggattgagcacattctcatcatgggaaccattactgactaatatgaagccacttcgtgctcccctacccaccagaatcctgtgagtgtatcatgtgtggggatttcagtagtgtg

SEQ ID NO: 72890 - DNA, 1080 bp, Homo sapiens
ttatgcttaagaacagtatttgagattacagcctgttaaatggaaagaccactaaaccaggagtgaaatccctgggaatttaaaatgctttgtaatcttattcacatcccaccctttctgaatcttagtgaaatggagcattgagaaaagatggaatccagcattcattctgctctaaaatgcttggcatccgtttatattattcacacacataatcatttcttgagttagtttgtgttcttatttagaatacagtgttatacttgcattttcaggaacaaataattctcagccactcatatcacagtgttaaaatgacaaaattagcttgtaatttagactccaaatgataatccaataacctgaatgttgtaaatgagagttcatgttgcagttatgtatttgctttgtcctttgtcctctgtaggtgtacacctgaattccttatcctaggcatgcataccagcagtacagacattcattccactaagtgtaagctcccaattaggaaagtacagtgttacccaattaaatcaggtttgatgaaggaaatatgcttaaactctaggtgaggggatgtaaattcatgtttcttccttccttttcccccctttttgttgcaggggatcaaaattaacacattctttttattttattttattttttattttattttattttatttttgaatggagctgggggagggggctgtgcttagagaaatgcagaggatccctgcaggctcaggcttgcagattcccattccaacctggctgtggcctgatgatgcacattagtcagcctggaaggaggattttccttctagcttccctggattttggctttggctccaaattaattcatcaaaccagagggtcttaaatcctagcttgcgttaattttttataaatccatctcaaatatttattaaccggctttcataccctttgctttgtcacataatacttatcatttgagggcctcactattcactagaatgagagctgatagtagagggaaactcactcggatgacagttttgcttctttccaatagcactaatttataaattaagttaag

SEQ ID NO: 72891 - DNA, 1030 bp, Homo sapiens
ccacttggccatttatgacttagattgtgagtcagagaattctttcatggaggagtttcttattggcttatattttatagttagagaatgtttcttattttttttataatatccaggaacacatgcaaaagtaaatgtgaagagttttaagattgtataacttgtaggagtaaggatattgaacaatgtgaatatacatttacttggtcttgtttgacaagaagttctaatccaaatgtagcttaaagcatatatagcaaaaccataattgaggcaaaagcagaacagaatcacaaactacccaacacctacagtgaaacactttcatcatcagacccattcccaattttccatttcatgaggtcaaagcaggatcaactttgcttttcaggataaaatgacatgcaaaaagttaacaaggaaaatcttaataatccaagcgaaaatgaaactaagaaaatgatattatgtttttgtgaaggtattggcacaagagacagaactgcagaaaaagacaaagacttcaagggcaaagcacagaaacaagtgcagttcaacccaggccagaccagggccacatggcgagtgcggatcctgagtgatggggagcatgagcagtctgaaacctttcaggtggtactctcagagcccgtgctggctgccttggaattccccacagtcgccactgttgagatcgttgatccaggagatggtaagagccatcgtcaactggtttatgttgttgctgttgggctgctatgacaaaataccttgtaggggtatagcttacagttttaaattcaatgtttgaaatttccatagagagaaccttctagattaatgattcattattctcagatgtgttgacaggaaaatggaaactaaaaagtaacgaaagaatgctatatatgtataatatgtataatatataaatatttatatagtatatataaattgtattaatagattttatgtatatataaacataattatattttccagctagtacaattttcatattaccagaaaa

SEQ ID NO: 72892 - DNA, 1036 bp, Homo sapiens
aaaactaaccattttgtataatttacactgaagaatgacctttctccccacaagaaagtgagcacagggagctgtggcaggacatagggctggttcacccagaaatgagccctcaaattcatggagtgtaaatttacagatatgtagtctgctagagtggttttaggatatcaaggttgtggtaccgattaggatcatgctgttcacaatattaaattaacttatgtctttattttttagggctttgtagatatcatatatttttatataatcatagctatcatgaacaccttccaagatgtgctaaatcttttacctgaattatttaatacacatatgcacatacacaaattatgagccaagttttattatgcctgggttttatcatctgtgagtggttggataacttgcccaaggtcaaacagccggtaagcatttagccagcctgactaaagagactatggcattaacaactacgcagcacacttcatattatactagcagtaagtatatttaatatacacaatgaccttctgattctacaatgtaatactcaaagttattattagttatcctaatagggaagtttacaagatgaaacaagctatatatacttttatagacatatagcacctgaatattgataattgaaatgtcatagataatagaataacttgtaaatgaactattcttgttgatcttttatcaattataactccccttggatctttagcaaagcttattagtgcagtctcaatctggtacttcaattggacaaggaatagcactgctttttccacatcatctagcaaatgacccggtgaaaatggttgcctttctgaaagattgcattttggctctcttgtcaagtcctcgtggataaatattgtcttgagtttgttttgtctttttcccagtaacactatctgcctgattcccatctcttccaaacagaaaagtgaatgctggccatgcaatactatcttacagacatcaaagaatacatatttctgatttattaccactaaaaccctgg

SEQ ID NO: 72893 - DNA, 1055 bp, Homo sapiens
ctgcattttactagccagcaggaaaacagagttaatagtgcacctcaaatgtaaatctactctcttaagtggattaaaacctatttatgctctgttcattttgttgttgtctttttttctccatgtttcattttgaatagtttctattttagagctatgtgacaggtaatatgataaccctgagttatgattccaaattatttcaaatgttttaagtccgtgtcttgttttagaagatgtatatttaagttaatcttaatgaggatttttctgtggttcccaacctccacataggatctcttgtttccatctgatttctggagccaaattttatcaaactgctaaatttcttgggaaagcttcagaggtttctttaagtctataaaattaggaataattctggataactcaaacctatttctatttacatgtccgaatctccatcattttgacaattttgtcatgcctctcaatttacagcttcatttttataaactcagattttaaaaaaacttggtctattgtaagtaatctgtgtatttcatagtgacttcactcatgttacttaataattcattttggctcccttttctgcttagaaaagaaaatgaagatacttctgcctctgttattcagaattcttctgataataccctttgcccagaatgtttaaagacaagtcaaacctgaattaatttttggaaggaatctgtacataaggggtctctggctacatatattttcattcttggtactctccccattataggttctctctatccaaccagcatgcgcatcggtgatgaggggcgcttggccgtgcacttcaagacagaggctcagttccatggcttatttgtgctgtcacatcccggtaagccccgttatcttttaacaaccactcctcacacaaaaaggaggtagattttccatcttcacacatttcagcgtgcttctctgttaccactgaagcccttaatctcaaatgaattgtacatgtgggattatctccatgagagcttgataattgttcagcttcacctcataatccacaa

SEQ ID NO: 72894 - DNA, 1058 bp, Homo sapiens
ttctaataaactgaatctttgtgtagccatgattgcaggcaatctaactaaaatcagactccattcataaattgggtttgcccagctgtgtggatactaatagactattttaagttcagctcgtaacttcagtgcacaataaatgcattcacatcaccctttattgtgctgctgtgactccccagaaagtagctctgaacaatttgagcatttctgtacaattatcttttgacaaaactatagagcagaaacagtactgaagtaggaatcagaaagtcacatcctagctgtgtgatctttggaaagtcacacagtcactcacagcccagtttcttcatctgccagaggaggataattatactaaccatgactgctttgcagccttcttataaaaacagaagcaaataatgtatgatcatttattttgaaaactctaaactgttatgcactcttttaattgaaccactatatcattattataattactggcactttcctagcatcctttacaagctcagtgatcatgtcagctgatcatccaggcctgacattttccctccgcctcataaggagtgaaccaacctataaccagccagtacagcagtggagctttgtctctgactttgccgtaagtgactaagactcttaattaattttcttctgctgctgccatctgattacacctcagatttttaaatgtaatatatcaatatcttctcctcaaaggtacgtgactactcagggacctatactgtgaagctggtgccatgcactgccccatcacatcaggaataccgcctgccagtcacctgcaaccccagagaacctgtcacctttgaccttgacatccgattccaacaggtgtggcttatagaattactatcttatgacttgcagaatcccactttgtttttcatttattagtaaaaaaaaaaaaaatccacacgtgaatgactttaattcttgcatgctgaaaagaaaagaaatcagacagttaaggaagctagggataaaagaatgaggagagatttgccctttatctgttgttagtacaggat

SEQ ID NO: 72895 - DNA, 1005 bp, Homo sapiens
ggatcacttgaagccaggatttcaagaccagcctgggcaacatagtgagaccccatctctacaaaaaattttaaaaaattagccgagcatcgtggcacatgcctggagtcccagctacttgggaggctgaggtgggaagattgcttaagtcaggaagttcaatctatgatcatgctactgcactctagcctgggtgacagagaaggtccccgtctcttaaaaaaaatagaaaaaccaacaaaatgatcatttttagtaaaccaaatggtgacattttatagtaatttgtacttgcacaaaacaaatagagaaacatgctgtcctggcaaaagccgtggcattatctacagcaatcaccactttccttactgcttaaaggacaaagctcagccagagacacaagcgaccagttttggaaatgtcctatttaatgccaaactagcagtggatgaccctgaagccattctcttagtgaatcagcctggatctgatggatttaaagtcgactcaacaccactctttcaggtaggccaaaaacaagctcatttgtagtagttgtgtacccacatgcaagttatggaacatttatatgcctcagatgtctcatatgtaaatagcagtaatagtaatattgcatacagttaatgggaacattgaataagatatggcaaataaactacataaccctatgctgggcatatggtgagcactccataaacccagcgtttattatttttgttagcaatatatctggctttcatagctcttatcacttttattaatgtattaatattattttaagactatgtgtaatgaagagtcttatttagcccagaatataaatctgtgtctgacagttgagtaatctgcttttcttattcaaaacttccttcctgctgacttttcaccaatatcttaattagagtgatcttgtgtgaactgctgaactcaggaaagcaattgtgcacagctccactctcaaagatttcagaaaccaagatacaa

SEQ ID NO: 72896 - DNA, 1702 bp, Homo sapiens
gatctatacagtgagatcgaaagacaatgccaatcgaggtattggcaaaagaagtgtggagtaccattctctggtgagtcaaggaaagccccaatccaccaccaagagccggaagaagagagagatcaggagcacaccctcactggcatgggagattggtgctgaaaacagtcgaggaacaaacatccagcacattgccctggaccgcaccaagaggcagatcccccatgggagagcacctccagatggcatcctcccctgggagctcaacagccccagctctgcagtcagcctggtcactgtggtgggaggcaccacggtagggttactcaccatctgcctcactgtcattgcagtgctgatgtgcaggggcaaggaaagtttcagggggaaggatgccccgaaaggctccagcagcagtgagcccatggtgcccccacagagccatcacaatgacagctcagaagtttgatgactgcaggtagaattcaaccttttccgtaagtgcctcggaaaagatcacaatggaaccttaaatacttctggtaaaccatagagaatggaggatggctgtgatgaagctgcttagagaatatgactgtactaatggagtttgatttgaattctccatactcttttttgcatcaaaggacaaattaaggcatctttcctcttgccccaaaggcagcaacaacgtactcatatgtacacagagccatgatgtgaggaatgtactcctcattttagacatattctctatgcagtggagataaatctattaaaaggtgctaacagactctcttacaagtgtaagaggaatctactgttgctatgttagtgtgaatgttgaaggtgcaattatcacattgtttattaattgtataacagattattactagaaaggtttttgttgctagtctggaaaactggtgaacacactgtttattatgacaagttttcaaataggtgaagacagcatagaattatgaccagggtggctcaacccacaaatcaactgatctactacttgggagacagtggaaggaaagatagagggaaggaagttcactcacttgaatttgaattgcttctcattctcatcagactctccttgttttgtttgcatatttaattttaaattaaaccaaagaatatgttaattctgaaagagatttttaagagatgctgctctgttttggcatatagtgagtaatggtagagctcttgcatggtaatataccttattggtgctcaacatttgtgggaaattagagggttggtgagattttggtgatgaataaatgccatagagttagagtcactacaagacaatgttctctaagaactgagcctagatgtttgcagtattgaacccataaatgataataagaaacattgttacagatggtgaagggagaaagtggtatttattaatataatgtgtataatcagagtgcctcttatacatactttatagaataaaggaacattttgacagatgaggttatccctcggagtagcgtaatcacacaataacatttagaacttaaattggctacaggacattttattagctttctatccagcatctggtccaaacgatgggactctctgcaactatcattccagaaatggtcttggaggtggccagaatcattgaccatatttttatttggttcaagaagacatcgctctggcatcc

SEQ ID NO: 72897 - DNA, 1130 bp, Homo sapiens
acttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaatattctgtgttttactaagtgcttggataggctttctaattttgtatacgtgctagagttaattattgaacatttttatccaaatttagttgtaactctgtttatactactgattgctcattcgtttaaatgatattttaatgtaaaagtcataaccaacatatgaacagacagatttatgtctttaaacacagaatgtaagctatagtttaatctgataccagttgctggaagttgccatttgtttttcttaaatctatacccataaaacttcttttaagattatattgtgttttttatatatgttgaccattcattcagaaaataattattgaatgagtagtcttgatacaatgtgatgccacaacaaggtgtatttctgctatcctatgagccccttgaaaagag

SEQ ID NO: 72898 - DNA, 2233 bp, Homo sapiens
cgcaagcttctcaaaacttcctgtgatttggagggctattttgagcagagtctagacgaaaactggatctgactggctccagagtaaagatctgagaaatggaacccagcaatttagatattacaagagcctgttatacttgtcattttttatttggtatttgttaaatattacaaaaatggttatgctttttaattcaaaatttgacgtttcagcatgatgatacattcttgccttttttcccccttccatatagcattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccgggtatgtggatagtttggaaataggataaaattattcttcacctaacttgtagttcacatttcatttcaagtcatcaaaatgaatgtcaaaatctaaatgatgtttttctgggtgaaaactttagcactctgaaatgttttatgaaccatgttaagataaatgtataaaatattaatgcctgttgatacaat

SEQ ID NO: 72899 - DNA, 1495 bp, Homo sapiens
gtacctttgcatgtgatatgagagttccatagcataggaggattgaggaccttatcagggtcatgccgccagccagtgcagaactgaaatgggaatgcaagtctttacactcttaccaagtccttttcttcagtgtaatacagtgaggttggttattgttactggtttgagggttttttttttaagtttcaattaccttttttttttttttttaatagggaactcctttgaaaaaagatggtgaagaatgtactaacgaaggcaaaggaatagctgcacgaattcttgggccatccaaaccagtatgtttagaaaatgatgaaacaagcccaaactccttcctacataaagtttcctttttactcaaagcataaattttatttttgtgttgcaaagtttgaagtattctagaaattgtaggagagtgagagagtgaatggatgagggaaacataaatatttaacagtagtaagagcccctttgagattgagctttttattttaaagtagaatcagtgaaattgctttcagtttttttctcgagatgcattcagctgctcagttggagatacggagtgtggagagcttgttttaactaagtttgtagtttagctgaattagtgttagtgaaaccacagtgaagtcacaggttgaaagtatttacaagatagtgattataatgattgcaatgtaaacaggacaggagaagacaaccccatgggttgaaggatctttggagttgaagtactagaggcctgcatacaaccaccttgcaaaacctgcctgtccacatgacaagaactccagtggagttgtttatggcagaatagtaacagatcatggttcttgcacaagacttcagatagggccacaattatgggagctggaaagaatctggctcccttaccaccagtgggtcctttcccctgcctcacaggcatgcacatgctctctctgtaggtaaaaagtacagcatctggcttagcttcagatacttccagttttctaaagaccagtgctttgaatgctttttgttacttaggtaagctccatcaactgtaaaataagtattggtggatttatggatttcaaaaggcagaacaactaacatactgaattcctgattccagtctatgttctactggagttgtcagaatgccaaatgctaacgcaaacagtgcttttttcttctaaaaggaggaaagagggtgggaatgagaggatgaattcctatcagtttaggaggatgttgccattgggagttcttgcgtaatttgagattgtaaaacctagaaggtttcttgtctttgttatgtaggaggaaacaggaattcttggtttaacttaggctgggcctgggaggagtttgctgtttacaatgagatctaaccccttattggagatgattttaaaaatctctggccacctctatggccatctttggcaagatctgcatttggaatttaatagcaaccacatttattaaagcaaagaaa

SEQ ID NO: 72900 - DNA, 1139 bp, Homo sapiens
attcaggacttcttgcattcttatgtccctatagaaatactgagagcctcaactagaccttgtcttattcttgcttctctgtcacttagcacatagtagatattcaataattgatgaatgagtaacatctgatatgtttaatcttaaaaatgacaatttggatttggaatgttttgaaactctttaattacatatttaggaattctaaatgttgtgtatactgatgttgaatcatatctattacaattttattccctttctttgtagaagttggtagggaagcccagcagatcttcctgcttgctcagtgtgtccctcacagtatggaacctggaaagatggaaggaagggcctctcaccacagtgaccttagttcctctgaatgacagggctgaagtagacctgccactgttgagttgcttgggcagttttgatagatgtatattactgtgctgcttacgtatattaatgctgttttactctgtgtgtgtgtgttttttttttttaggctgttttgacagaatacaaattaaaagcaattgaatatgtgcatggatacttttctagtgaacaggtattcctcattatttgtttaaacaaagctttctttttataccaatgttctggttaatgtctgtctgctggccgaattcagaattggttttacctttttgctgtatttattcaagaactcgagaagctctcagttttggcagaaaactctacagaatttataattcagggactaagcacctctccactttcaccccaattcatgttttaaaatgattttaaatatagggtcttaaagcaattcaaagtgtttatggttctgggcacaatatcaaagatttagagactcgtaatggcaaatttacccaaatttttatagttacatgtaagacaattacaaaattcgtcatgtaatataaaagaaaatgtgaacaaataatgaaatatgtttttatatgaagccactaaataaaaatttcaacagtaagaaaaatacacagtgttatttaataagtagtttctgtaactgccagaatactaacattttaagcatgatagtttagtgaaaacttcattccaccttaggggcagtttgctaattaaaatatatgtgtgtcacacacaca

SEQ ID NO: 72901 - DNA, 1873 bp, Homo sapiens
ccttttttttttgagaaaattttttattggtagtcttttttgctagtttttagaaacttggaggcttatgtgttttttattgctatgaactttagctcaactgtctaaaagtgtaatagtaaataaattatttaacatagaattgtaatgcaagctgattcactttctttctggtaagctcaatgtatccagtttgtcttttgaatacctatcaattaatttggcatatgtaccttcaaattgatttctgttcactgctttatgatattcccttattagtagtctgctttatgctcttgcttgtaagataattttaacttaaagaaattttaacgtgagaaaataagatactcatgatttacaaagattattttcttcttagcaaagaaaagttgggttgaattttgaatgtctccacaaggtgaaaatgcagttaaaaaaaaaatctgtaccatagagaacgtttttgttgacttactgaaatttaaggtctgtatgtgagtgattgaaataacagtttcaaatataagttgttccctttacattttcttcttgatttcctttcataagcaatgcttattcaaggtcataagattaaaaaagaaaatggtgcaccaatactttgttagcattctgagtttcctgtataatgagtcaattatggggatgttatttatttgaatttagaatccgcttattttggactaatggagattttaattcgtgatcaaatttggctgtaatttacgaagaagctatagtgcttgtcaattatatgtaatttcctaagcctatcacctatttgttattatttacttctatcaaatttttgctcttagcttacttgaaaaatctgaatgtttgtatagtggttttatttgtgagatgtacatatctatctttataggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaaggtacattacttgtttatggtattataaaaatattataaattgattttaatttgttcgatatttggtataatgttttaagtgttgtgtatgaagcggtgtgtaaagagctaagtgtattactacgagaaaactgaaaaacagatgggtatgattgcccacaataaatgatcctgataacaggcccacttattcttcaccaaaggccaggagattcctccaaaagtaactggcaacagtatgagaatttctagtgggctcaggagataagtgtgtatcctatttaattaagcatgtagaaattagaaacctagaatcccagactcaagtatcctacaggctgattaatcagcaagcattttattgagtgccctttctgtgtcctctctagtatcaggaggtgcagatctattatgtattgaaacaatgaaatgtagtctatgctattgattcttaaagcaaaatggacttaggaggagaaactaaattgcctggagaaatagaacaagatatcatgaaggaagtagttattgaactaaactagttttggtgggaggagaggggaggatggatggaacattcatggagggtttatcatgcatggtctacaggcatttattagcaggaaagaaggtgaagatgcactttttcagcagcagaaaatacaatttgggatgtttctgaagtcttatttgaggattattaaagccatgtttttgcctataacatttttgaggttttcctagtagaaaagtgatgttacaacag

SEQ ID NO: 72902 - DNA, 1289 bp, Homo sapiens
caacataaatttattctcacagttttggaatccagaagttagaaatctggtagactgtgctcactctaaaggtcctgccttgccgcttctagtttctggtggctcaagcattccttggcttgtggcagcaaaactctgatgtctgtctccatattcacatggcggccccttcttctctgtgtgtttttgtgcctccagtctttcccttctttctcttaataaggatttagggcccaccctaaatccaggatgatctcatgagatccctaatttaattttatctgcaaaaactatttccaaatagcatcacattcccaggtatcaggagttaggacttggacatctttttaaaggaccacagttgaacccaccgtagtgcgtaataaaggagatagacggtaaaatcataatgtgaatttttaaggtctgtggaatactaatatcaagtaacagataagttgggaaggggaaccagttttagggagaggatggcataaaccctaaacaatgattttgaagcagtcatgaaaaattcaagtggagataataattaaagaagtagattaattccctaaagcagagaaggaactttaaaaaaaaaactgtaagaaatgggcaaatgggcatatagacaggaaagccgagaaagcatagtcaagtgaaccagcggtgtaattaaatagttctttgtaacctgtttcataaaatatgcaaatgcatgagacattctatatgttgctctgactatatatttttaccgtttatagatttcatgatcctttggctgcatggagaaaatgggacagggcctgctaagttcaacatacctcacagtgttacacttgattcagctggtcgggtacaaatacagcgtcattgtgtctgggactttgtgtctgaatatgtttgtgtgtgtgtgtgtgtgtgtgtgtgtgtgtgtgtgtgtctgggcatgtatatatagattgtggtatacatgtgtgtctgggcatgtggatacatgtgtgttagtgggtatgtctgggtaattactctggggctgggtgtgcacacatactttcttacaagtgtttgagtcctatagtgagggggttccccaaacatttagaaaggagcaaaatggatttcctgtaccatttaaaaggatagaaggcacaaataatggatctgaacataaagttacctgaaagaaaaagttgccctcttactgggaaaactccactaaaagtgtttgaatatcttttcacttctcaagaaaaaaatgtgctgatctaaagtggagtgggaga

SEQ ID NO: 72903 - DNA, 2011 bp, Homo sapiens
tagctgaaagtttaaaatatttattgttaattttgaattaggggaaaatagaaatatacagagaaatttgatatccaagattttcagatgccaggtaaagtgaaaacaagaaataacatatgctagacctctcctctagcctttatttggtaaatgtttaaacaggacaaaaatcaaacccagcctaacatcaattcttcattaatttcattttgtggactatgatattgatacttttaacaaatttaagctaatctttggctttgcttaccatcatggacatcttattccttcataaacagaattagatcaaattaaaattcttcttaaaagaatcattcagcaagtaggtgcctactgttgtttggcacagtaggggattaaaatgttgaaaaaaaatacccttatgttttttcacagacatttattatgttaaatgtctttctccttaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatgg

SEQ ID NO: 72904 - DNA, 1009 bp, Homo sapiens
tctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaagcagtctataactttttattcctttaaagaatttcagcaattatgaaatcacaagttgatgctgaaagaatatcccacttttcacacatatagcgtgtaagctgatgtgcataaatatgactagaagttgcttagaacatttaaagaatgtagcttgttttgaggtggtgggagggtacaactgacagtaataactagctaattgtctacatttctgcattaaaagtggaacatctttatacttctactttttaggtctattcttggagtggggaggggagaaagtgttctaaattagaaaaccaaaggctatagatttagctctatctttccctacctgtaccatcagattgggtctttcaagtggaatatttatcgatcagagaaaacttggatgaaatctgatggtgaacagagatttaccacgaatttttttttttttttttttttttgagacagagtctcgcttggtcgcccaggctggagcgcaggagtctcgctcgctcggtcgaccaggctggagtgcagtggcgccatctcggctcactgcaagccccgcctcccgggttcatgccattctcctgcctcagcctcccgagtagctgggactacaggcgcccgtcaccacacccggctaatttttttttttttgtatttttagcggaaatggggtttcaccgtgttagccaggatggtcttgatctcctgacctcg

SEQ ID NO: 72905 - DNA, 1457 bp, Homo sapiens
gtccttagggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaatagctagatgagtcatggagtgttaattcagtcatcggatttgcttctttaatttctccaatgtagctcttcaactactatagtcctgtaaaatttccttttctcttttaaggcctctcattaattcactcactaatcaaccaggcattgttctaggcacaagtgtattaaagatgagtaagacagtttctgctttcaacgtgaattctttgcaaccagaattctaacttcctgcttgttacatttcaatcataaccaaattctgaggacagaagaacttcaggtctg

SEQ ID NO: 72906 - DNA, 1059 bp, Homo sapiens
tattcaatcttagtttgaaattccttttttttttttttttgctactttcagaatcattgaactcttaaccattgaccttggatggacttggcaactgagtcacagatatcgtgactttaaatctttaggttaatagcactcagttttcagtgtgggctccagtggtatccacaataatgaaatcttaattgcttagatgatttggctcaatctgtatatcttatattctgtcctgaaaacaagttccatcatataaattaaaggtaaggcagtctgtttcgtcaatttaggctcattttaaatcccaaactttaaactgaatgttaactatttcacagttacaatatttttcaaatggcaaaattgtaaatctacttctgtaaataatattgtgggaaaatcataacaattgcaatgttggaaaatacttttcctatcaatactactttttcatattttcttatttcatatccattcacacccttgaccaggacaaatgaggacattttttattataacactaaccttttataaccgtataagtaaatattactttattaatttgtcagatttagaatcaggtgttaattctttggtttgccatttaagtacattttacacatatgtgtttagtgcatatttcaagtaactgtcgtgaaatgtagtgaggaatatcactggtcattcagaacagagggtcagtttacagttgatgtggacgtctgtatctgtgagtgctggaggcccatgcagccgagatgcagtggaaaagcttccctggcttgtgaggccagtagcacctcccttgccctattaaagctgcagactagcaataagtttccatttgtgcattgacatggttgaggcagttttagaaggtctgacagcattgggattagctccccagatcagatgacttctaatgcatctgctcacattgttttgccagctttcaattggccagtttccccagtaagttcctttcattgcaaatctaatcccctttacaaagtagaatattactcttagttttgtcctgaaataagcacattaagtaat

SEQ ID NO: 72907 - DNA, 1050 bp, Homo sapiens
aattaaattttgtaaggtaagttaagaaggggagggattaagatacaaagacatatatctttttttttaaagaaaagatcctcttactccacattctttgtaataattgtggaaatctagaagagttgtaaggtatgctaatatgtcaacaccagttaggatattttcaaacctatttttagtgatttcttacacatcaaaaccctgctaaaatgaggcacatttttctgaagttgtttatgtttcaggttgctggagtttttgttgttgccacaaatgattatccctaagttcacatgatcatgtttatagcttcaactttgcgggaccctcaggctgtcttgtcaggctgagttttaaaattccaaactgaattgcgaagacatgacattagggaatggggagataaataagagtgtataaccaagaaaaatgtcatatcccaaaggtttaaattcccatgggaaagaaagtcttgctttcaaggactaatattggaggatagaatggtcagtagttgtttctccttaatgttaaagtattgaaaattactgacgagtcagctaccttccagccagcccagatcctgagcagggtggaaccgcttgtggctttgtgtccctggcagctggcacagtgatcagcctgcagcatgttctcaggtttgttggaagggagaaaaagaagggaaggagagagaaaggaaaaaccatgaaatagaattaaggaaaggaaggaaaacaggaaagagtaaagaagaaagaaaagggagtgaaataagtggaactggaaaactggtttgttaacacacatacacaatacacacgaacacacacacacacacacacacacacacacacacacacacacacacattaaggaacttgtccagctattactgacagacctggaaccagaacacaggcaggtctttataatctatctccctcttgtccctgtgcttcatagtgggaagtcatttcatgggcattttgaaagccttgaagagaattattaaaatgtataaattaaaagtccttggaagggaaa

SEQ ID NO: 72908 - DNA, 1026 bp, Homo sapiens
ctggaataggtcatatactttatttctatagtaaccaaatattcaaaatgcaagtcaagacgttaggtcagacaaaaaaaaaaaaaaaagactgtgctttttcccccaatagttaaatttatctacattgagtctttcaaatgttataaaaataaaagtatatttagctacactgttagttaatagacttcatggaatagaataaaagaagtgcggatttgagcttctctacattttttgtagtggactggtattaaaatatgttttttacatgtgttctctcatggagagttaactactgtggttcattccaaattccatcttaattgtctttagtaactattcattttatgggtttatcttcagtttcatttgatttccttctctgtttagctgttttcactttgttggtctgggtcaaatatgaaatgattatcctttgctgttttatataggatctatttccatcagcacctcaatttattggtttgtatcaaaattatcattggaaagatttaattggcccccaaatatcacttctagtattatataatccacccatcctcatggagtttctatgctgtactgaagacttttttaactcatcactcttttgagtcctaattcatggactgtttaattgctgagcttatgaaaaagaaatgtaagtcacagacctacttgaaaactcacctttttgagtacctccttagtttacaatgccctctgtgccttgcatattttacttatgtagaatgtatgagttatggctccaaatttcaattctggcatagccttgtcaacagcaacacaagggctacctctgtataataagggctttcatttctaatcagcatcaatatgttaggtttgctcaatttgcatatctagaaacctgtagtgaggtgggcaggaatagcagactgtctgcagtgtgtcatatttgcagtctacaaatcagggcttgttaacttgcgtgcaaccaattatagcatgagtgtgctgcaacataatcctcagtaaatc

SEQ ID NO: 72909 - DNA, 1055 bp, Homo sapiens
cctggtcaacatggcaaaaccacgtctccacaaaaatacaaaaaaatttagccggacgtggtggtgcgctcctgtaatcccagctacctggggggctgagggaggagaatcagtcgaacctgggaggtggaggttgcagtgagctgagatcgcgtcactgcactccagcctggatggcagagcaaggctttgtctcacaaaagaaaagaaaaagaagtttggggaaaaggcaaagcctcacaatatcaccatgggaggtttttgtagttgctggtgggagatccaaggtgcatagttcatctctgtggacagagaggtagaactatggacttcactccttgcaccctttatccttgaattgttagcacagagagctggcagtgcctttttgttacctttgttaaattagatatttgggggcttgtttatctcttcctaatgtagctttacgctttgagagctgggctgtgttttggacttcccaaccacagctgcatacttgaattattcagactttcagtctctactgatcttctctccctgattttaaactttgtattaaataaatctgaacgagaaaaaggggccaatatgccttttagaattaaaaaggatcctgataccccctactgttctatgtgtagatagaaaacgtgcaaatcatttgaagtactttaacaaataggatgtgattagcttgtgtcagccaggtttagcacaaccctctacagagtaggtgcttggtaaatgctctttactttaatggagaaggtgactaggaaacaaaaaaggttttcagttgattctgagttgggcatggggtaagtccggtcttaggggaaagtcacttgttctctggaggtttaattagaaactggaccacttactttttgtggagtggtttgggagtaatcaccagaagcagagtaaaatacttggaaattaaagagatactaaaatgttaaatgtgccatatggtaataaagttttagagcaaaatggaaatgttcgatggtttttaatctcgtgactgatagggactctaggtggggtta

SEQ ID NO: 72910 - DNA, 1003 bp, Homo sapiens
tcttacacattcttggagcttgttttccaatatgtggcattacgtgggggatagagtccctgcctttagcacttcgctatttttcttctgggttttggctggctggaattaaagtttctacgtcaatcatgtccttggttggcttcttccactttgagaatattaaactctttcttttatatgtaagtgcagaaatgcattcacgttgaattcagtgttttgcttccctttccctgttcctgtttttggagctgtgctcaggttggggatgtaaccttgcccgcctctcatcccctggcactcagttaactttggctgggtaataatgcactgcccaggtggagtttggggctcacatttcttcagtgaattttgtgttcatgggtagcttggtgttcctgcctagattattgtggtgctcattcgtgactggatcagaatgataagctgcttttcagagcaggtacaatacctactgcctagggacctgtgttgatgccagagcacttttcctttattggtgtaaacagtgagtacactaatccctcatcatcaagagaacagacttccagtcattgcactgctgagctctggatgtggagaggggttggggctttcattgtgtgctttcggaagagacccttggacttagagctttgtcacttgtgaccccgcccttctctgcttgttaattcattcataaccagggaaataagaaggaattgtaaaattctgaagctctaagagactttagtcccttctgattatttagtttacatatgaagggagtgaacccagttactttagtttggccagtttaaatgatcagtagctgggactaaaccagaacatgggtctcgtgatcctcagctaaaaccttctttgactccatcactcaggttctccctgagatgagcacagtgaccaggagcagggattaggaataattgttgggtttccagagtcaagttgcagagtgggctgaggatgggctcatcaattt

SEQ ID NO: 72911 - DNA, 1036 bp, Homo sapiens
cttgctgcttgtgaacttggagctgtgacctggcaaacagatattttaccaactagataatgaaaacacattgaatgtataagttgaatggggtgaggttagtgtgtctcatttttcctttcctatgtagtgtcaaatagaaagctgaagcaggtaatcaaataggcttcatgagtggttgattacatttattctgatctctccttgcttgagttatttatttagaatgctaatggtctctgccagaccccatgctcatttatgtcctgagcttgattgtttattcactataataactaggaacaggtgattatgactctcaaaagaagaggtaaaatcacagcagaagaatgatggttttgtctctaacaaatcttcaagttaatttcttatttgctttaatttagctataaaatgtaatagcacacatgtctatgtaggtcaacttcaaccaggtaaaaaatgatagctagtaaagcagaatgtgtacactgtccctgaattcatagaacatcctggatcagtgcctgaaattcctgtttggtgatatgtgatgaccttgatttcctacaaaaatagccactttctgttcttttgaatttttatctaagtttcttccaccaaaaaatgcattttaattttttttacaatgccagccattaatctttaaaattgttgtacttaataatgtaatagttattccttaatgaaatttggaataagataagtgatcattgggatcacccagccactctgctgtgttgagcttggagcaaaaagaggagacagagaaacaagttctataaaatgttgtgtgtgatgatgtgggttatgttagtgttataggttgaattgcctctcacaaaaacatgttaaagtcctaccttcaggtacctgtgaatttgaccttgtttagatgtaatcaagttaagataaagtcattagggtgggcccttctccaatatatgatggatgtccttataagaagaaggaaatttggacagagatacgcagagaaaatgctgcatgaaaacag

SEQ ID NO: 72912 - DNA, 1034 bp, Homo sapiens
agcttgttaggcttgtagggtttggcagattgtttctgtagcattacttacagcatgggattagaataacattttccccccatgtgggatgctttaggattttacatgcagtcagattccagaaaaaactgtttcctcaagtctgtaagtaaaatgaagtgttagtacttttttcttgtattagcaagtcttaaagtaccacctttattcgtgtgttcacattactctatggccatgtgttgtcgtgcaaagcaaatgaacagaggatctggacagacagggttaaattctgctgttcatcagtttcctggttctggacaagttacagactcttggcctcaggtcctttgtttacaggatgtaatagtaatattaggtcctaatagtaatattaactctttgaatttttgtgaagtttaaaaacatgtaagttacctaatatcaggcatgataaagtagattcccaataaatggtcgctattaccaacagttggttacataaatatttattgaatcctgctctgtgccaggaaacattctagatattgggggtaacgtaatgaacagaagcagactaagaaagaacagtaaagaattataaagaactgtaaaggaagaactacaaagaaaggactttggttctattttcatctacttttagttttctattgctttcccactgcatttccttagctagctgatttttggacttgtaatattcttattagtaggtgacttcttattcaggacgtggtaaatatactgtgttactagatatatttgacctccacagatcataatttgagatgccatgcagatatccttatgcatgttctcagtgtctggacaagttttttttttaacacctgtcaccacataatgggttttcttacttctgatggcattttaaatatcatctgtcccttctgtgagaccccatctttaattccccatctctcttcccatatgctttcatgtgtttatagtctgattactacctgttcataaatttgtatttttatctcttttgcata

SEQ ID NO: 72913 - DNA, 1111 bp, Homo sapiens
atgattgcaatagaactgttggaatcaatgaatcaaaactgcagactcaaaataagtcatacacaggcattcttttacactagaagatgttaagactaaagaaattctgaaatgctgctgaatgagtacaaagagtgtctggtaatagttctgtactgtgggtgcctccgcagaccataatgcttgttaaatttatggtactctgcaattgtgaaaaattatcctaattagtttgtttggctcatgcagagagttaatgcacccttaaagggacatagaaaagttgcaacaaactatgagcatgaacttgcaagccaaaaaatggaaatcatggcatggttcattttattttaattgtttattgcccagtgaaagtgctacattacttttaatgtgagtatataatatatagaatgaattcattggcctgtcaaataaaaatcgggcgtttctttaagtaaatagctgtcagagttaatttggaaatatttacggaagataaagacatgaaaaagctttgagctggtttgacaaaaatcgagttatgaagctcatagagagaattagttcttcccacttttaaagtgttgaggcaagtctcaatgtttattaattgaaaattgtagactagctgaaacagtgttatcacttcttttaatgcctttaatttttaatgtttcctgttgttttaccagggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcaga

SEQ ID NO: 72914 - DNA, 1032 bp, Homo sapiens
attatcagaagaaatgggattttccagaggctctggtgggtggaaataaaggggaaagattgctgttccttttccagtccacaccaaggcaaggaagcttctttcttggtccttcacccctccgaagaaggcaaggtttgggatgaaggttgctcctggtcagatgccccatgaggtggtggagacggggagggagagagagcatggggatgaggactgttagtagtgcttttgtgccaggcatgtgctttctagatgatttcccatctgcatggatcagaaagcagagatactgatgcagctgcctttcattattgggcagagagagattaagtgttggaaaaaaatccttccttatggctgggtggcagggagaggagacgtgggctttggaatcagacagctcccggttctcatgctggctgttcagctcctagcctccctcctcatctgtaaaatggtggtgatgaaggaattcgtagacttgaagtgtctggcacagacgctgtcatcaccttccccacatccaggatgagttcattttggtcttttcacttcagaccccctactttccaacagaaatctttggatgaccttggattatcagacatcctccagaactgctatccgcgtgccctccttatttctgcacagaatttctgaacctctgggctggcatggtccaggtggggctcacatagacagtgggttgtaaaggaagaacaggcacaggctaagaaaagaggtggaggaggaagtcgcggttccacgatgggggaggagaagaagaggcagcttttgaaggagctccatcgcccacccccagcatcgacccccgacggggcccctgtgcctctcttaggggtggattgtggagaggagagaggcggctggttcagtttgggatccccgatactctaggacagcccccatcttccctcgcttccgtgaacacagctcccaaggcggtctctgcatttggccacagcgttgcgtcttctaagctgctgcgccctctgggagccggtggtg

SEQ ID NO: 72915 - DNA, 3514 bp, Homo sapiens
gcttacacagaaggaagcttcctttaactgctttaaagatttctttttgacagttcgatggctgcatctttttagtagctcttcaataaatgaatacatttgatataaatcaaatgctgaagggttttttgtaaagtagaattttccccattgaatgattttagagctgtttgagaaagctctagctttttgcccctaagtatgtctgtcactcttaacatgttaagttgaattgattttaatttggctatattttcattgtgtgtgtatgtgtgtgtgcgtatgtatgtgttttttcctaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagaca

SEQ ID NO: 72916 - DNA, 1051 bp, Homo sapiens
aatgtcctcttagaaaaatatgtaatatgatgttttgataagtaggagactgctgtggcttttttttttttaaagtctaaattagtatatgtcccacctgagttagtgaacgcttcttgaatgttttaaagatttccttattatgtctcctgcagtctttttaaaaatgacccccagctgggcttgccagtgatctgacaggcttatcatgaatgttagagagcttcaccccctctccccaagtcaatgcaacaaccaggaagcttctatctgggaagatctttcttccccctttatcattaactaaatgtgacagggacaggagtcaagcttcctctcctccagagatttcatcggagcttatctgtgtgtctattgtgttcaaagaacaaaactgtcatgatggaatattgtgcaaatgcctggacttccagtgtatagaaaatgtcagggtcagactgcagggctgcattccagtgctaccccaagtgcgggcctgctgatcttaaggaggaattaagaactcggttcggctggggttggtgggtacagcagacaaggctgtggctctgtgagcatacatgtgtgtgtgtggcgccttcccataggaatttggggatcttaggggaatgcaataggatgggagggaaatgtactccctggcctcttttagggattcttgtacctactctaagcccctggccctcctcacagcgtgtctcgaggtgagggtagatcttgggtgtggaggaaggtggggattcttgggaacaggagacagtcactgccatcaccacacacctgctccgttccagccgggaatctggggctccggtggtgtcttccccgctctcacacttcactgtatgctctggcaggagggcttgtcacgtagctgctgtgttgaaatctttaggcggaatgcagtacagagagtcagagggcgttttgaaatgtggatttctcagccctgactgctgggccttaccctgacttttgcatctccctttagaaagtgagacccctccattttctctcttctaccaccttt

SEQ ID NO: 72917 - DNA, 1055 bp, Homo sapiens
gatgggggagttgtggctgtctgctgtggatttggcagtacctggcctctgtgcctccctggggaggagctggtgagtgggttaaagggtccccaggggtaactgcaggctgcatcaaaactaaatcaatcctaggggaaacaagctccactttgaaatccttggtagcctacagatctctttttttatttactttttttatagtactttaagttctagggtacatgtgcacaatgtgcaggcttgttacataggtatacatgtgccatgttagtgtgctgcacccatttactcgtcatttacattaggtatatctcctaatgctatccctcccccttccccccaccccatgacaggccccggtgtgtgatgttccccttccgcctacagatctcttcaaacaaggcatttagaagaattttagctagatgaaatttagtctctggatatccaccacagggaccttattagctagggttgatgacattcatttgagagctggccttgtttgggttgtgtggtatcattaaacccaagcgtatgacagtgtgagatagtttctgttttccaggctttgcttaaataggggtccacattagcacctgatacagaggggttatagaaggaaagtgattaagatgaatgccttgtgatctggagctggtgtctaaggggattgctcgtttctgcctcacctggattgttttgggatttgtctttttggggtagtttgtttctgatagtgcatagagcccatagtattgaatggtacaggagacttccatttcacttcctgaaaattaaagggctttgcccttcctttcacaaaactgtagattcctttaatacagggttctcatgtgggacacagtgaaattttgtagtgctgctttttaattactaccttctgaaatgcaaaagctttggtatggtgtaatatcattaagtacattttctgttctgtccctgaaggggttttcttcaatcctaaatgtatgaggttattggctgaaatgttactctgaaatatttagacctttggctaataaagatca

SEQ ID NO: 72918 - DNA, 1025 bp, Homo sapiens
ttgcacacttaataggctacaatataatgcataccttttatgcacagggaaacaaaaatttgtttttactttattgtgatatttgctttattgtggtattctggaagtgaacttgaggtatctctaaggtaggcctgtatttcatacatgaagaaaggcatagagaccaatataattagtacccatattctacctctctgttttagctataaatataattcttcccctccttgtcccagaggtagccactaattccagagtttgtgtgttgaagggcacctttcctgccagaagcccgtaccctggctgtgctgatagatggggtccacaaattctttgtaggatcccctttttaaaaaaagctttacataaatgttatcatttaaggtaaacaccattctgtaacttgattttctttaataaaagtcagcatgatatttttgagatgtattgttcttacatgaccagatatggccccatacttaatagttaaatcaggaaattgaagccagacagcttgaaaaccttcttaatggaaaaaaatgcaagaagtgggtgggatagagtttctgttgaatttttgtatagaacattgtcatttgtgggaaactagttgatttgaattctgtgttattttgaatagcctaataacagcttaatgaggattaattgcatgttgtatggaaagttaattgttttaatttactatgggtgtagttactgcagtttggttcaaacaggtgaaagttaagatttgtagcataaaacaggaagcagatgggggctaattaaagttctgttgatgataaaaggatgactgatcaaggagcgagcagctggtttctcaatttaaacacaatttgtactattgtatgaagacagccctctgcaagttctcatgagtatctttcaaaggtgaaggcatgtgttccagcaacaagtgtgaaggctgttgtggccctgtttgtgctcgctccccttttttgccttcaagcagtgtcacttcaggtttttccaaaaaaggg

SEQ ID NO: 72919 - DNA, 1934 bp, Homo sapiens
acgtgcctttgggaagaaggtggtggaaaaatatggaataatgagcccttctgactttggattcagcaatttaacattggtgcagtaggtggagttattcttggagtcccagtttgaagattgctgtgcagaaacccatctgtgctgctggttgccaacatttctggtacaaatattgtcatttgctcttgaggcaatctgctatttcagtcctagatgcagttttgtaatatgctgggtaaaatagcagacaaaaaatatcttaagtggtggtataatcttcagtttaaaaacactttagcaatgtttccagtagaggattgttcaacgtgtctcctttccttggctgtaaacataatctaaattcatttttcctcgtttgcctgagccacggttcccttgtgctgactttgcatgtcagtaacttccgtacccatcagagaggaaagacagaggggcagtcttgtgcaggtaaaaggtttaagtagtaacatttccttaagattgcaccctgtagaggtttagcattccatgatcattctgttgataagcaaatgagaaatgagtaacttgctcaaaagttacttggttacaaaaattgtcaaaactgatactacacactatttcccatttggtaccttttatccctacacactatttcccatttggtgccttttattccagactgcaagagtcatatcttctgtgcaggctgctgaacagcttcacaagggggtgcctctgttgcctgtgaggagtaggtgttcttgatgggattggggtctccctggaaacccggggatgggactgtgccaccattttattgggcttttgttattaagcccttcttagagagagaaagcatatcctgtaggaagtagtatgtttccttctgtttctgtggctttctcagtttcttcccatcttgatgcatagtgagaaatccattttacagtatgactcagtgcacatatgcacacaatgatagaagagttttacaaaatagtactgtgcttagccatttatgtaagactgttttgttattatttacagaaatgctagccacaatcctctcaattggtttcactattttatggattgtgatccagagttttagcctgagggctttcccacattctttcaagacctttgtgtcatggcagcagccttgaagttaggggaaacaggtagatgaatccatatatggagaattggccatatatgggaaatgaggagggagttcacaggtcagtcacttgaacacacaatgatttgggctgagccagtttttaagtagcccctctctggattggtctcaaacatggaactagttaaacttacgtactaaatcaaacagacccaaaagacaccgtttgttttttaagtcttgctggcacagactagctaggatagggtttttcatccatctggacatcttgtcgtttagcttttgtatacaacccttgaaaatgggcagctgctgggtccactttcctggatgaggtttcttgcttctttcttttgagattaacctgagtagggctcacctgaatcaattatttccgcagaagctttcatctcatgaaagcgcattccacttttcatgtcttcagggcaaatacgaattgcacttccaccctgaagtcagaactgtaaaggaattttaggtgttatcaatgtttgataagaagtgattaccctttctctgcagagctggaacagctgaagctggtgtgatctggctgggagaaggctgtgctctggaatagtgtcctttccactgagtccctgacttgcctgttggcatatggagcagtaatcttttcaaaactccattgtgaagttggctgtgtgtgtgtgtgtgtgtgtgtgtgtgtgcgcgcgcgcagaggaaatacttacatactaaaggggaaagcgggggaggaaaattc

SEQ ID NO: 72920 - DNA, 1701 bp, Homo sapiens
ggacagtaattgcctggagtctttatgtaagaagagaccgaagagtcttagcaaggagaaggtttctgtttgcggcatttggcccatagtatagtacacattcctgttgtgttgttttgtttgcatcattgggcttagatgttattagatattactagtctaatccaattccttgttcttggagaataggtttcttgtttatctgaatggcttttctttgcgtcactatgccagaatagtcattcttggacagaaatgatggttttaaaatctctcttacattttaagacctgctctaggggttgtaaaatagtactgctgttattgggaggagttgggtaggggccacagcagcagggagagagaggctcccatcgtacaaacttgcagacttttattaaaacgtatttattgattgcaaattatgtcaacagagtgaggctttggtaactcttcaagttactagtgtttccttctttgcatagttgtttcccatcaccctttaaacatctgctgcttctggtcttgtccagtcatgcttgagtgatcagccccagaagtctgacagctcttcctgtcttgactcaggacagtccaggacagctgagctccctgcactgaaacaatgggactcctgaaaactgctctgctgttgacatgagaagcacatttcctctttcttaacttccagaaagttactgtggtggctttgaaatttgttctgaaacaataagctcaaaggattctgttaatctattctgattaatttaggaggcagcagcattcattatttgacttatgttagtggttaattaaccaaagtagaacatgttcactttttataaattaaatgctgatagagtaacaaagacgaaatattttacaacacagatccttgaatttgactctgaaatattctgttattttgcagcagtttccggttttagtgacacttacatactgtttctattattagcaagttttgaatttaagtaacttgaaatggatatgaaagttgtttctataaataatacagactgtactcatgtgagagttttttttctttaatttcattgttggccttgattggggagaagatttatattttatgccagtcttttcttgtttagaattggcaagaattggattgagttgtattaaactgtttatgtgaatagatagttacttttgagatgtctttgaatgtagaatattcttgcagccatttcttgatggtctgccttgactgtcttatggacagttggcatcagtgacactttcatttatttacttatttatttttttttagacagagtctcgctctgtcgcccaggctggaatgcagtcgttcgatctcaggctcactgcaacctctgcctgctggattcaagtgattcttgtgcctcagcctccaaagtagccgggattacaggcatgcaccactatgcctggctaatttttgcatttttaatagagatggggttttaccatgttggccaggctggtcttgaactcctgacttccagcaatctgcccacctcggcctcccaaagtgctgggattacaggagtgagtcatcactcctggtcaatcagtgacacttttaaatcacttgtgtccttgactctttttatgttgtctttatgagggacaggccctttattctaccaaggagacctccatagttgctcattctgaatt

SEQ ID NO: 72921 - DNA, 1777 bp, Homo sapiens
gattgcttgaggaaagacccctgttgattggttgtaatcatctaagatttatgatgattaggaagtctaaataaaagtctgttagatccaatttggacataaattttgaatgcccagtttattggattgccttgaaattctaattggtaatatgcaaatcgagttagagtcttgactatcaaaatcaccttaggactaaattagacagtttggaagctccattaactctttcagagtactgaactactatttagtctacccaaacagtaatttactaagtttagcatacccagacagtaatttgcaaagtaatactttgaagatgctggaaggagttaatgaagcttctgaaatattgtgttttttgggagaatctgactcagcatttgcagtagttggagttgagaaagggcgtctttaaattttggatgcctaattggcaggaattgttgctaatgctacagtctttgatttttatcatactcctacgctcttcctgtcatgttgcagactccttttactaatctatgtgagtgccccccaaggtaaagcccctgtgcacttccgtggtgatgccttctgactggttcagcctgtcaccttgacacacacacagatggtttctggaggccgatttaattccagctatcttgttcttcacctctcgtgtccatttctctccatcttttctcctgagctttggtctaatttgtcaactcagtggggaccagttggctggctgttgccttgaacttgtcttcctctttgaaatgggtttctcctcctgaagtcatcaggttttgaatagcacttaccataattttttaggtgaggatagttttcagcgctgggtcagtgggaaaaactccagttcaactctgttgcctccacagtagagcatggagttgaagcttcttggagttttcctctttctcttcccctggttggctggaaccatttcatcatttcatacttgggtcactacactggtcttttcatcggcttgctgcctccagtttcctccttcactctgctgtgggcaagatgacacatcactttaattataacatttcacctcctgaagcatcttcagacactctgctactttgaggataaaatctaaatccttttgctgggcatcaagaccactcaccatctgaaaggcccatctttccagcttcctttcctacagattcctctaccacccctccgaggccggaggaggggcactccctccctttgaggtattttacacttttctgtgctcctagcagggcatcccttttccgtacccaccctatctagaaccactcaatgaaaaaagccaggctcacaaagacacatgccacacgattccatttgtataaatttcaataaacaaaacgaacataagtgctagtaagtgacagtacctgtgagtggtggtttcacagggtccacgtacaaaacttcgtccagctgtacacagcccatttgagcctttggctgtgtgtaaattagacctcagtaaaacagtgccaatcgtgtaaggctgtggtgaggcttaaattatatagtgtagtatataaaatgctgagggcaaggcctggcatgtgggggaaatcccatctcttttagacagaagcagtcgctctcattctgaattgtatagtagataaattcttccctgacaagactaactctgcaaacagaccttggaagctttttttttttttcagcgtgtttttcacttgacttttattgccatgttttgttcagttggtatctttggtttaat

SEQ ID NO: 72922 - DNA, 1052 bp, Homo sapiens
gttgtggagtgacgtagggagtgagtgtatgagcagagcatgtgtggtgttcattcccatccatccatcactcatcctacatgaagttgcctctggattgggaccttgaactctactaattttatggtagtgtaacttgcagaagacttaccaggtaggtgagcttggtagtatgttttgttttgttttgcatttgggaccatcttcacatgtgtcaactaagaaggatttgctgctaacctatacctaaatctctgacacaaatcctggaaaagccttaaatgattggcaggtagtgttgaaaggtgctgtatcagggttttgtaaatcatgccatctagatagaatgcattgtgttggaatgaaattaaaacaaccattttaaaaaatgtaaatgaccttgggtagaaaaacacgagcattaagctgtattagcaggtgaagataaatctctcccccttcatgtttgaaataatcttttacattgtttatgtgaatttctttctttttttcgggtacattgattatgtatcttcccccaccctccacatttaatcccctaagggatcggtattaatgagttttatgctttgaattttaaaattttcttgtcctcaaaagtgagactggggaaaaagagaaaagactttaaacattttctttgaaagcttttagttatctcatatacctattccttttgaaaatttctctgtggatagccggcttagtttcttgcaaatgactaatttaaatgccatagaacatgtttagattcactgtcacatggttgttcttgctacatttcttttgctcagattcatcttcagaaagtgagggagggggaaagcatattaagcatattattcctgcaattaaggcatagattggctacttaatttgtagttagtaaaaaactactgtgatggaactcaaaatattaataaattgagaaaaccagaatgcttgtcttttgctttagtgatgggactaaggtttacatgaatctttctatgtcatgtagtttcagctagtgcctcttggctctgaaagct

SEQ ID NO: 72923 - DNA, 1058 bp, Homo sapiens
tgaggctgggaactagaggaaagggtttgtgtctaataggaaccaattgaattttagaaaggatgttaacatatagctgttttactgtctataatgttaaatgaatacacttttggcctctgtctagaaaaaaataacatcttaatctagtgtgtgattcttatacataagactttttagggatgacagtaatatttacaaataggtaaaaaaatatagagttgtctggtttagactcctgttgtcatggcatgtttaaagaagaaagcttccagccgagaaaggcttgtgatgaagtagcatcacctttcagttagttctctgtagtatagattatgtgtatgtgtctgcctggtcatagatgctggtagctaggtgtccttgcctgatgccaatatgattctgggctgaatgcatatgaatccattctaatataagtgtaaatagcacatgggaagataaacctaccaagagaaccacatacagatcatatggtttattccagaggcaagaatgataaaaaaaaaaaaagatctgacaccagactaattatgagatagttgagtgcactcagtcatatgtatgctttaaataacatgtaggtacatgcacatacatatacagtatcactatctagatttttcaaaagattgacttgtaagaacaagtgacacacatttaaagtgttaatagtgcttctaggtggcatgtcttgtcttcttttttttttttccttagtggaaattgcaaaatttaggctaattctgtcacattcaatataaatcacacagttaaaaagccactctgtagttttcccagtctttgccccattttggcacataattgttcgggataaatttctgtggcgacaccatcatctgctccagctttctcacctgatctttgcttccccagcacaccacatcaaccccagttcttaattcccttgacaaaacacacttcatgattgtatatggcactctgactgctaaagctaagctctagtacagtagttgagttatagttttcttgaaactcagttgtgctttttcagatgt

SEQ ID NO: 72924 - DNA, 1910 bp, Homo sapiens
ttactgttgacagtactgtagctgtgatgggaggagggaaataacagggctcgtgagagagtgctgagcaccgtcctctctcccaaacacagcttccgtgtgttttagatgtgttctttccctatcatgccatccatgtttaggggcacaagaagagtcaggtgaggagggaatgggcatttaagtccacgtgaacccctctagcagggttcccctctgcatcactgtttcaaggagatgggatagaattatggcgtaactgttttaatgtacgaaatcagcagaagcgatgaatatttttatcttcaaatttgtattacacactgaggaccttatatatgattctaaatttattggtcatatcctgaaatacacactgtgtgtacctagtaaccttgtattggttacagtggtgctgtcttaagtttgtttatttgtttgtttgttttaaataatgtctgaacccaccataggggtagcactctagcacagttttgggtaacaaataagattgcattctgacatggtgtcataaatcatatctaaaagccgtgaggtcacatagaacttgtttatgtaacagggtagaacaaaactcattgttctgagaatatattgctcactcattttatcctcagtcacgatgagttttacagcctatgtgcagtattgatgccactgaataagcatttatttttgatgaagatacaacttttctcctcacgttcagttgagagtttgcaacaagtaagactttgcattctggaatttatgtagatgtatgtgtatagatacatgtggtttttaaggcctggcaaccttaatgaatactggtagaagattttggctgtcttttaacagcattaccatgtggttgaccatttaaataagcagcagtttatcttgatgtagtgaatgcatttaattggttatcctggcaaagcagggtattcgttggttacaagcataattttctgagtttatattatttttccttctagatatttgtgagctattgtttttatagcctatattgaaacatgctttttctttttaaaatggattgtagtatagagctttgttaataaaaaaatttaaaataaaaatggtaaggcagaatgacttagttatttttatattttcctgtaaaaacagcctcagttaagtgagccacaatgagccatgatgtatttcctccatcaggatggaaaataagccatttattatttcaggtctgactcacagtgaacctgctgacactgggatgttttaaaatcataatcataaggaacaggttagggcagaaacttggacgctgggcctaggattacctgcttattacaatgttttacaacttggatgctttaggttttctggcacaatgtcctaaacctcacacactaaacacccccttgttgtacaattattgcttgctggttttagatggtgccaaatagacagatgcctcatcataattaccattttttaaaatttcactgttatagacatatataaataggttgttatctcctctcccttccctcagtacagtatgctcatgcttccacaaaaagcaccccggatgtccttagttaataaaaacgggcagctgaggagtgagggtgtggcaggtggatgcagcgtgtcctcagtgtcgcagggtacataatattaaattacatgtgattgcaaaggaaagcagttacgtcgaatacagttgtgaaaattgtcgtagggtaatagatgtgcttctttatcaatacattaaataatatttagtggcgggtcaccataattttgaggtggagatgaataaacaatattttgagtttttgacagcaactgtaatgtgaaggcatccgatttctattggtgtcaaagtcacaggtactgccaatactgtgatgtgt

SEQ ID NO: 72925 - DNA, 2638 bp, Homo sapiens
cctcacatgcccggtatatgccatgcaccatcccttctgctgtatgtatgtatgtatgtatgtatgtatgtatgtatgtatgtatgtatttgagatggagtctcactctgtcacccagagtgcagtggtgcgatcttggctcactgcaacctccacctcctgggttcaagcagttctgcctcagcttcccaagtagctgggattataggcgcgcacccccatgcccggttaaattgtatttttagtagagatggggtttcaccatgttggccagtctggtctccaactcctgacctcaggtgatccgcctgcctcggcctcccagagtgctagggttacaggcgtgagccactgcgtctggccccctctgctttatttctcatagcacttgttgccacctacccccagtgtgtattcttgtccatctcccccaccatagagcagaggctccacaaggacaagcatcctctgttttgttcattatcttgaacccacacggtggtaggtgctcagcggttgtttgctgcatgaatgtgcattttatctacctctgcattcactgtgtgcttttctgccttactggagtgatgggagtgatcattgggaacttcgggttttttgcatacccacctatgccatgtcttctggagcttggcaaagacttcctcttactgtgtacattgatttgcctcctagctacttcagcatggttttcaagataggaagggatgagcctttcaggagaaactttataacaaagtgtgttaagtaactggccttattttatacacagtttaaatccagcgggccctggatgaggatttgagaggatctctgtgctctgtagttctgtggattagcacttggctttcattgttttcttttagccctgactttctggttcacatttgtttaaatagtctaagtgtttcagaggccgaggggttggaaggctggccaccagataaggggagcatcactatccttgtgctttcttctctgcagggccaagagatcttccactgtgcactgtgagaaagttgctggcgttgttctcagtaacaaaatcttctacgtgaagatttgctgtcccctcagttccttagttttcctctttacaaaatgaaacgtcattgaccatgttttcaggctgcttgcaactccagtgaccttgagtcctgtaggtccctcttgctaagtagaatgttcagatgaattaaatatggtgccattgtgttgcagaatcacactttgaaaagaggtcctattccctgcagtgctcttgactttctgaagaggactgagctcatggtcagcatgtttcctggtggttaaacatatctagctttaaaatttccagctgctagaggagacgaagacgatgagaagcaagcacacagcaaactgtttggcttttagatgcatcctggcctggccgggtggacttgcacagaactgctggtgccaggttagttccctgggacttttccaacatttgtctctgtattgagttttgtccttattcctgaaatagagtagccactgaaatcaggaaccagaacttctggaaaatacctttggaaaccactgtgttgcatggtagaagaaaggcaactgccagtagttaaaataccgggttgagtgctagttttttcaccctttattttttctttttaaggagaggtctgatttactttcttctgtctgttaaagctcttcacaggttcttagaaaaacaagccatttaatggtaccagccgtgaggatccaacttcagttccatgaaagctgcctggtagttctggtcacagggtcctgatgggagaccgtgtaactgctgctaggcagtcagctggagggctctggtgtggctcacgcttgtgtttgttcaagtgacctgaatgtgcttcctctttggggacctgtttcaaatgcacatgctgacgccgtaatcatccactaaaccaagtgagagtcaggaaattcaaattcgtagtgcctgtgacttggccacactccctgtacacataaaacaaggtcttaaatcagagaaactaccatctagattaacactcaaactgcagatggggaccggagctgctcttggtgtgggaactgcaactttgaagttccagactttgatgtgattaacatttcagacttaaagtcctttctgtgtggtaacttttttttttttaaacaccaaactgaaaataaaaattgattagattaggggtgtcggagaagcagattgtaaagggaggagccctcttgcaaaccacatgtaactatgtcacatccttatgtgcctcaggaagagagagatgacagactagtgacctttcaccatatctcttttacttatagctgttcttacagagaccctgccctccaacacacacaccacctccaaaaagaggacacttttgactttgctatctcttattgaccaagtgataatcctgatggagagatggggtttacaggcatgaggtgttcttttttacccagatttcaaggttcaaatactggagatcatcttacagccttcttcaaattgtggctgattaaagtttaattcttcacctctgtcttgctggtgaaaggaatacgagggcagggaaagtggagtttgtgg

SEQ ID NO: 72926 - DNA, 1049 bp, Homo sapiens
attttcattgtagtcttagcaggttatttgtttgacaagcagattataaagctgagtaaaagcaaaactgaccaggatgatgatattttgaaaactgactcagtgatgtaaacagtgcttctacctggtccccatggatgcagtattaaactggaaattaagtccttaaaagtccttaaccttcgtgggttaaagtgttctttatcaggaacagtttttttttcccctaaatgttaagcttgtaatgattctgtgatgctgcagaattacagcattacttgtagacttagtagcatatagcaaaaaatttatcttaaatttactcctgtgtttcttcgtaggaggaataaacagtgaatgggaaccagtatttttcaaaaatttttttggttaatgaagaactaggtattacgatttctttgtctgatatctaatactttgtttcaggcaataaagaacaatgccatatgccttaccaggtagatttttatataaatgattgcttatgaattgtaaatgatatgagttgggtttagaggtttagattttaatgaatgatgctaaattgatgttgaaattgtagagggttgtttgttttgtttttaaaaattggggctggacacggtggctcatgtctgtaatcccagcactttgggaggctgaggtgggtggatccatgaggtcaggagttcgagaccagcctggccaacatggtgaaaccctatctctactaaaaatacaaaaattagctgggcggggtggtgggcacctgtaatcccagctactcggggctgaggaaggagaattgcttgagcccaggaggtggaggttgcagtaagctgagattgcgccactgcgctccagcctgggcgacagagcaagactccgtctaaaaaaaaaaaaaaagtactaaagccacctttgttgctttctttttttgttgttgtcgagacagggtcttgccctgctgcccaggctggaatgcagtggcatgatgatggctcactacagccttggcctcccaggctgaagtgattgccctgccttaa

SEQ ID NO: 72927 - DNA, 1105 bp, Homo sapiens
atgtcattaactcatatttgacttttgggaggagagaactacaaactcatgcagaaataccaaggtgtgaggtaagaagtcatagccatttcagtattctagatgtgcatgtcaccagctgttgtcattgagctaaatgcctttgtgttttcagtgttgtctcgactctgtcgccagcagtagtctggtttagtctggtttagcaaattctgcagccttcctgcctcatctgtgttgaatgctaagattagtaactttgagatgagtagtgttggctgccttcacattctgaagttcttaattttaacttctggcttagagaatatgagaccatggactggatggagaagtctcttaacattagtaaaaggagttaaattctcagggtggtttcgcttttgtgcttgaatgaggatgggagagaatactgccattctctgtgttttgggtgaataatcccaaagacattttatatgttgagagtttagaggtttgacccaatcaaaccgggaattgtataactgggatgtccaataccaaggcctctaagctcctgaaaaacactttagaagttcctgagccatcattgtatgtgtgacctggtatatcccaccggactcacgtgcaggtcttaacattgtgattttttttctctggctctggttagatttggcttttactctatctctggcttctaatcggtcctcctttcattctcccaccctacttttctctcctagtaaatttttcctttctgttagaggcagtaaagtcctcactctccttgtcagtccacatggaagctttgcctacttggctccccttggggtgcggtgaggtgagaggaggagtctagtcctgtgctaatcgcagattgttggggacatgtgtttcaatttcctttgtctcagttttcccacctgtaattttggagcatgataatgggccatccagtgctagtgtctgcaaaacttgcttcgagatcactggacaaaaggtgctggttagatatatttactggcatgccctgggaggatgtctttagatcactacagtattccaaaactcacgttggggtcacgtcagaatgatcagaattccctct

SEQ ID NO: 72928 - DNA, 1012 bp, Homo sapiens
accttaaggtttgtgatgggctttttgcacaaaagcctacttctccaggggacgtccctgctctctcaggttgctatcttgttactctggcctgaaacaagttagcagccactttcccgcagacctgcacaaggcacatcacatcaacggctgttgattagagcataatgacttgttagatcatgtttattgtgcaaatgaacctgaatgttactaggacagcatatccatgtaggcttagaaaacttaatttttaatgccccttctatctttcatcaggctaaagcttttggatttatggttattcattctagctataaatatattaatagtattttgggctggtcagatatggggcatgacctttgacatcctgcttggctatgcctgggaatttgacatccttcaatttaggtggaattcccttgttttgtttcctgtgatagtgtggggaaatacacattttggctccttcggcagaggaagacaggaaaaaagtaaaattggaatgcactaagaaagtattaatgattttatttctgctgtgtatagttgaatgcacatgctttttatggaagcctgagcctatgaaaatagtgcacaataataagaaaatgctaacaatcatatttagtttttgcattttttaatttggatttattttttgactagtttgacatttttgggtttttgaactgttttgcatctaagtatacatggtggaaagaactttttgtgatgcctttactagtattatcagtacagagtatcaacagttgggaagagctacaaaagggaactcttagccggtgtgtattttgacctgaggaagggagtgttctgttgctaccaactaaaagtttatgagtgtgcttctgtttcctgaatgtaatcagcacctccatcaataattatccctgtaggggaacacaatatggctttcctctactgtaggttctttgactgagccaataattaaattgacataaggcagactaacaagataaaaaaa

SEQ ID NO: 72929 - DNA, 1001 bp, Homo sapiens
tagaagctcttattttggcagattcttgaggtagtaacggtcacaatgtggattttattgttctattttgacatgaaaaaggttttttctcttctctaaccttcaggatagagttgcataagtaacatcaagataggcatgttcagtcaccataattttgtatcagagatgatgtgccttcatgagctgtgaggtttaatttgcagaatcatcagtttgggccggcacggtggctcacgcctgtaatcccagtactttgggaggcctaggcgggtggataacctgaggttaggagttcgataccagcctgggccacatggcgaaacctcgtgtttactaaaaatgcaaaaattagccaggcgtgttggcggaccctggggagccagaggttgcagtgagcggagatcttgccgctacactccagcctgggcgacagagactccaactcaaaaaaaaaaaaaaaaaagaatcaccagtttgttacaccagtaggtttcagcctgccatcattcatactatactgtgatttgaatacaggagaaagtgggctctcttgaattacagttacctcatctgtttgcagcagaactctctctctgcagggctacctcctaaacggggagtggggagggaggagaggggaacttgcaaaacttgtaaatatcgattggggttgtttgtgtacttggcaccaagctggttgcattggaaacttttctctctggatgggtaggtatgtaggccatcatgaaatttacatgtggtgaatgggaaagcttcctgtggatcatcctaccctgagagttcttcaatctgtatgactgaattggtctctccccttcaaccttttaggatttaattttctcttcagtggcccattatgacatttacatacgttgaatttgaaagattcccatactcccagtctcttctgttaccggtgtgcctggagcagtttgttgaatttgtgaaattttgagatagaatgaattttgtaggac

SEQ ID NO: 72930 - DNA, 1114 bp, Homo sapiens
tcaccatgttggccagactggtctcgaaatcctgacctcaactgatccacccaccttggcctcccaaagtgctgggatcactggcatgagcccccacgccctgccgaccactattgatgtttgtagatccagtgaagttcagaattacagcacatctttggtcttttaatttttgtaagtaaagatattatataaaacatcttcatccttcaacttcattctcatcttggttctaattttgaagggagggttccctgagggttcttatctccctcagggaagggaggtagatcatttctttcaagatagcctatctctgctgaccttaagtcataggagttctttaattcttagagacctctgccttctcagaggccagtaccacctctaaagtgtcgtggccccttggtctacactgcagcacccctcatctgggaagtgctgttatctccagtaagccccactgtattctttatacatctctggccagccacatatagaaatttccaggctgtcaactttttcagtgtgacttggttccagcatcttgtatacagatcttcgagacctaaaaagaaaatcttttttttctgcgttgatgtatttttctccctagatgatgtttgtctttttctttttcttctttttttttttttttgtgacagagtctcgctctgtcgcccaggctggagtgcagtgacaccatctcggttcactgcaacctccgcctccagagttcaagtagttctccgtctcagcctcctgagtagctgggattacaggcggccaccaccacgcctggctaattttttttttttttttttttttttttttttagtatttttagtagagatgaggtttcactgtcttggctaggctggtcttgaactcctgaccttgtgacctgcccacctcagcctcccaaagtgctgagattacaggcatgagccaccgagcctggtcagatgatgtttgtcttaataaagatgtcattcattctttgagcagttccagttacagagctggtcctaatgatataccccatgagcttaacagccctggaacccctacctgtcttatctgataagggcaaaactgtgatgagaaagagggt

SEQ ID NO: 72931 - DNA, 1041 bp, Homo sapiens
tatgaaaatatgattacattaaacaattttaaaatgcaactacttaggaacacacttgtgtaaatatggagacctatggaatgcaatttatagccagtgtactgcagttgattttgaaactgacatacggaatttggcaatacatagaacagattatgtaattgacttaatgtgaatagttggcatttacaatgtatttagctttttgcttgatctgttctttaaaattaacttcagtgaggcccagtgtcctggtagcagagtgattcaaagaaagaaagattactattaaattaagtcttgcttttttgaaaaatgagaaattctgaattgaagtcagcaatttcaaaatatacttaaggcaattatgagggaaggttatattggcttgaaaagatacttcaaaatgtaaatgtcagttctaatattgccttagctaaatattagatatccttgatggctttcttattgcaataattatcttcccactaacccaaatgcaagaatgaagattataatgggatatttcaatagatccagaggaggttaaatttggataggccaaatgcaaaactgacaccattacagtccaataggactgaatgtattaactgttaagtgtacttggagtgagtctgactagctcatgttgaaccaaaaggtttatgcagtaaaaatggcattgtggcacatcagaaggcacagttgtagattaaataacactcatcagccatttagaaatggcaagtgttgaggagagctgtccgggcgcggtggctcacacctgtaatcccagcactttgggaggttgaggtgggtagatcactggaagccaggagttggcctggccaatatagtgaaatcccatctctactaaaaatacaaaaaattagccagtggtgatggtgcatgcctgtggtccctgctacttgggagactgaggcacgaaaatgcctcagacctgtgaggtggaggctgtagtgagctgagattatgccacgacactccggcctgagcctgggcgacagcaagactctgcca

SEQ ID NO: 72932 - DNA, 1269 bp, Homo sapiens
catttaaaaaaaaaatcctcccccctttttttgcattcaaagtacagtgtgtacttacaccattctttagtccttggaaatggatacaacctacttcaacttgctggagtgcctttctttaaagataaaggaagtgttttgggatatttttagttttgcgtctcaaatggcattgtcagagtgttagtcttaaactaggaatatgcttacactttttaagatttaggtttttaaaaaatagattctgatgttaaatcatctttacaaccatttttatcaggttcttgttctgatttttttaaaaatgcaagaataatttagtttttttttaaatttatttgccagagctaggagacctgttaagttatctgtctggaattggaggcccttgggcagctcccagtgggagcctaatggggctttgctttggagtaggctgcctttctcaaatgagtaagtgtttcaggtgtaatgtcagttggtttaagtctgattgcagcaagtacattttcagtttgagtaaaagggtattttaagaagaaaagaaacaacctgagctgttctaactcataactagtcttttggttagtttcataaaaatgagttacttgttaaaaccaagtttcactctcagatctgaaagactcctgttctaagagtcataaaagagaaattttactatgaattttaacttaaatccagtttttaaatgcaaagcaaccaaaacttaactgttttaggaccgaggagaggttgctttggcacaaaatatttcctgtgatttactactgggaattaggctgaatctttaattaaatagtttcttgtgtgctgcttcctggggcctgcctgaaagtttgagtcatttgcataggacaaactagttggaaaactgttaatgaattcaaaaacttttaatgtcattctttagatagttaagtgctggttatatttgaaggatatgcattttgtgtttgtggggatggtatgttaaatgtcttacacttgttgtaatattggctagaattgctataaggtcacacacaaagtggaacctaagacttttggaaaacccgggatcttctaaatctagtgcagtatttataaataatgaaacttcatttccatgacctgttttttcacatagaaagccttctaaagcttgggaagtggtagtttgaactctgattttttttaataaatggcagttttgagttgactcttttgatattattaggaacactttaggttaaaagaatgactttgact

SEQ ID NO: 72933 - DNA, 1343 bp, Homo sapiens
acccccggcccgcgccgactgcttcggctgccccttccctcccggacctccgcggggggagggcgggttctctccggccgcgccgcggagctgtttccgccgggcgcggcgggggagggcgcggcgaggggccccggagcctcgctgccccgggaccgggctgcaggtggaggggacaggcagggcgcgaccggccggggacggtgcagggcctgccgggcagtttctggaggcggtgcgcattttgctttgttttggttttctccggagtggcctcgagtgccgggggcccggcgtcccgagcccgaggtggtgcctccgacacgtgcgaaggggcggccaccgcctgcggagcgccggcgcctggccgcgcggggcgagctaaagttcaagtgtgaccctcggcgggggcgggcgcgggcggtggcggtggcggtggcggtggcgtgggaggggccccgggcgcaggaagcccgcgcctttaaagggccagcgcgtcggggccgggcgccgtggggccagcgtttctccatgcggggaagcgcccgaacttggtcttgcccctggtaggaggcttttagttagaaacacagaggctgccctgaggggccgggggctgggatgtgtgagtcttttcctgccttgccaccctattcttgagcatggaggaccaggcgggggggctttgcgaccaatgttttgagggagtcggagtggcggtgcgcgtcgagggagcggtgccttgaaggaggatttttgccatttttgcctttcagagcgtggccaggagagacttagcgtgggggcaggcacttcccgactccgaggagaaggcccgggggccctcggctccggggaggcttcccgggggcggggtccagtcgtggcgcggcctccccaagctgacagtttctcactgtcaccggtggcggaattgctgtaaaggctgtctagttgagctaaacacctccctcccctcctccgagacggagtctcgctctgtcgccaggctggagtaccgtggcgcgatctcggctcactgcaacctccgactctctggttcaagcgattctcctgtctcagcctcccgagtagctgggattacaggcacgagccaccacgtcgagctaatttttgtgtttttagtagagaccgggtttcaccatgttggccaggatgttctggatctcctgacctcgtgatcggcccgcctcggcctcccaaagtgctgggattacaggcgtgagccaccgttcccggccgagctaaacacctttttaaaacatacctttcttcgcctctcatattggactccacggcataataaagattggtctttgctg

SEQ ID NO: 72934 - DNA, 1044 bp, Homo sapiens
ccagcccaccgccgcctccccgtggaaaaccgggccccacccagcccggcgcccactggctgcccgggcggcggtgccgcatgcccattggccgcgcgggctgtcggtcaggggcgggccggcgcgcgcgccgccgcgggcggggggcggcggcagatcccgtaagtcgggcggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagct

SEQ ID NO: 72935 - DNA, 1048 bp, Homo sapiens
gtgccgcgggactcggagaatctcggggttgtcggcctccttcctgcagtgcccacctggtgggaacttttgtccttgtttgcccccaagtcctgtcatttggctgcggggctccgcgcctcaggggcgccagtgctgggcagcatggagccgcttgtgaatggagacttgctggctgcccaggagtgggcggctgggcaggggcggtgaacgtttagggtccggccaagaaagttggaagtcgtctccctgacctgttccttgcgaggcccgggaggagacgcgcctggccggtccttggcggcgaaactgatttgcatctccacgctttacctaaagcccgggctctggggactggatggcgagctggcctgcggctcctttagccagaagctgggatcttcccgcagcagttcgtgttccctggtggaaaatgcagcctcatctactgactctcccttccaaaaaaaagttattttccccaagggtcgagaaaagtgggtggtcggcactgttgttcctcagttgcaccctggtgtaatttgagagaggggtcaaaggcgctgaaaagattcttttttctattccaagtgctacagcaagctcataaatcaattttaattcatgctgaacagtcttgcctcctccaagccctgtgtcttctccaagccagagctacacataatgtgaattagctgcccactccttctgagtgaatctgttagtacccatcatcgttttctatcctaataattctaatggctatttgtagaatttatttgtttgtttatttttttgagacggagtttcgctcttgttgcccaggctggagtgcaatggggcgatctcggctcaccgcaacctccgcctcctgggttcaagctattctcctccctcagcctcccgagtagctgggattacaagcatggcccaccacgccaggctaattttgtatttttaatagagacgggggtttctcatgttggtcaggctggtctcgaactcccgacctcaggtgatccgcccgccttggcctcccaaagtgctg

SEQ ID NO: 72936 - DNA, 1117 bp, Homo sapiens
gtttaccttttcctatttatgtgcatacaggtatttgggtaccacatttataatttacaagttagtttgaaagatagaaattgcaacagtatggttgggagcctggtatgtaaggcatttgctggtgggcatgttttgaacatgtattgatcccttatgtatactgacacactgtccccatcactgttggacaggtatttccccctgtgctggcgacacagggacgcccctcaccgaggtagagatgctgtgggtagtcttaacttctgaggacaacgaagcccattcctggggggacaggatagggagggggagcgagacatggtctataggttgggggctgggcagaggaggtgcctagcagtgacacagaaacctctgttctgctgtgaggcctatggaatgcaaatggaacccacttttgaggatcttggagtcttggagtgctggagctagagagacctttagacattgttggctccaatgctcgttggatatgtagaaaaaggcccacagaggagcagtagatttgttcaaggttacacagcaagatggtgtgaagacagggcaggactgtgatccctgggtcccttgtctggtgtcgttgctgtctctgctttagtactccgtaatgcatctgcagcacactggaggggagggttagtttggagcctttgggccctgcctttctggatgtggaacttgctgggctttgggaattttctgccagccattgataggagcagaggacctgttgtgttttgtggcagaggtcacccacggaagcgatccatctgtaagcacagagccagctgcagcccgaggtgatgtggatggagcttaaatgtggtgttgtgtgtgtctcttcttttcctttaaacaacgttttccccaccacacaggtttttagccagcttatctactctaaagtgctgggaagttcccatttccctatctgcaatggctgtaagacatctagatccctaaacagctaggataaaggaggatttcaagaacttaggtgattaggtaattattgaaatgggggtgcgtggatcccaaaagttaaatagccttaaagagaaacttggtaccactttaatagtcattcagcaac

SEQ ID NO: 72937 - DNA, 1035 bp, Homo sapiens
gttgttgctagcatttgtacattcattagcctcccccttctccctgttggaaatgtaactgtcccagctacacagcaaatgtgtattctagtaacctgtgatgcctgaactgttcaagatgatcaagttaaaatatgaatgtgctgaattaaatgctttattcagcttatctgcatctaggctctctgaattacgcacccacttaaaacattctgtcaccttttctcttggaataattaaattattttaatgtaattcagatttctttttatcctagcccagcattacctgggagagaatgactcaggattaatcataataaaatcatattaaattatattccactaattcagaattggggataatttggcaattaaaggcggaagtgtgtcattcctctcctgtaagaaatgaacagtaatgatgggctcacagagatcatattgcttgttgcttaaaaaagagatcaagcagttttcagactctggaattgttggcttatttgccaataaataattgagaattattcttaatgtcccttcccccaactccactttccagagtttagatggaataactgtgtataacatcaaattcaggaagttgcatttcttaaatattttctgtaagccttcttttgcattttgatgaagctttaagagctcctctcaggtccagaaggagacggtaaacactaaccactggcagttcccacgacgccaaccctactacagggtgtggggatgttgtagggtggttacagttcattcttctcttctgtttagaatttttactaaaatgatttcacgtggctgggcatggtggcttatgcctcccagcattttgggaggccaaggcaggaggatcatttgaggccaggagttagagaccaccctggccaacatggtgaaaccccatctctatgaaaagtacaaaaattagccaggcgtggtggtgggtgcctgtaatcccagctacttgggaagctgaggcacaggaattccttgaacctgggaggtggagtttgcagtgagc

SEQ ID NO: 72938 - DNA, 1076 bp, Homo sapiens
agcctgggcaacacagcaagatcctcatctctacaaaaaaataaaaattaaaaaaaatctactgttgtatggtcacaattttactggtgccttatgtggaagaacatttccttttttaaaaataactgctttccttttatttatgaagttatacattgtcatcatataaaacttagaaaccacatatgcacaccacagaggagacctgctcatcatccaccactgagaatgaaccgcccttctgtttcagttttctccaggagaatgctgttcagatgcagctggcagtgctacctctcgtcagcagacatgctgcactgaaactgtagatgctgcttatgatccaagatttagcttttctttcattagcaaaaagcagagtattggaagaggttgtctgagccagatgaacttgaggagttttaggaagggtcggaaatgtctgcgaagatgcaagggaacccacctttctctgtccaaatcttcccaaaacatcagactttgcctctttgttggtcttgccttgggtatttattatatagagactaaacagaatttggaaaccactgggatgtttagctatccctgctttgaatgttgatttattttataccacttaaaattattatataagcttcaagattgcaaagggcagtcttagttatttcagtaggagtttgaaacctgattgcagctgcaggtcccacacaactgaattcggtttcttgtgcacagcactgttctctggaggtgcctggaggtctgaaggtgtgcccttttatagacaggaattccaccatgatgggtagagcttgttttttaaaaaggcttgggactagatacgattgcccaagaagacagtgtagacagcgaggagggctgagcatgaatgggatgagcctccagcacagaaagggcaggcaggaaggcagtaaagaaacaagcagggcacaaaccaggagagtatggcatgccatgatggagactgaacagaagcaaaaactacaggcaactgtagttttgttccctgttgaaggagagacactctattagagaagacctggaattcagttcag

SEQ ID NO: 72939 - DNA, 1053 bp, Homo sapiens
tgggtgtccttaagaaagggttgggaaattacgtcacagtgtctctctcgtgaagaatcactctgggtacatttatttcatatagtgtatgtgttatttagttcattaaagatgcgtaaggctgggcacagtggctcacgcctgtagtcccagcactttgagaggctgaggtgggcagattacttgagcccaggagtttgagaccaacctgagcaacatggcaaaaccccgtcactacaaaaaatacaaaacttagctgagtgtggtagcacatgtctgtggtcccagctaccagggaggctgaggtgggaggattgcttgagctcaggaggcagaggttgcagtgagatgatgccactgcactccagcctgggcaacagagcgagactgtgtctctcaaaaaaaaaaaaaaaagaaaagaaaagaaaccatcctgattaaccttgtctaatccagcactcatcttttttgagcttgggcccgttttttttttccatcctgaggaacagtgtttgcctcttacctgttggggaaatgctctcttagagtctacaaagctctgacatgtatatcatgtctctatagccctcaccgtgatcctgtgagaagagcaaggcagatgttacctctcttagggatggaaaactgaggtgccgatgttgacctgctcaaggtcaccccgctaaggacttgaaattgtgtcctctgagctcctgcccagtctcctttccatcagaccacagttgggggtctggaatattttataagggtcagttctagagagaagattaatcaggagcagtgaaaggaaagaactgcttgtgagagcctgtggtgaatttctgcaatcacattgtaaatatttgtctgttcccggtttcaacatgacccagaatgttctagtttgacgtttggctggacagggtcttacatagcaggagtgctcaggtacatgtttgttgaacatatgacaaatggatgattcttacaaaatcccatcctatacctattactgtttcaattccagttctacacattcatactacatgcaga

SEQ ID NO: 72940 - DNA, 1034 bp, Homo sapiens
atcagtccccactcagtgagaatggggtttggaaaagtgccctattttctgcacccttgagattcattacagccaacttgaatctaatattcattgcctagaagtccaagagtgtaagtctttaaaactttttattgaaataatacacatagtatcatgaatgcacattgaagtcacagtatgcagctctataaatagtgacacaatttatgtgcctttgtaacctgtgtccagattaacaaatagaacattaacaacacccagaaagctgccctcatgttccttggaagtaattcaaggtaattaaaagatagtaatagttatatccaaaggacttaggcagatcaacaccttgaattatcagttgactttgtatttgaggtctagcagtgttcacacaaggcatggtatggtagcttggggctaagactcggattggaagggaggttaattgtgttgagctggattactttgttacattccatgtagcagtgctgcaggaagggctggctgatggggaatacctgacagtgtcttctgaagctctcagaaggaaaatagtttttaaatgtctgtggcctttattaccttgggacttgatccttcatctgtccaagccaagtctccttcttgctgagaacaaagtgaggagagagggattcactaagttgcactgagtatgtgatttcttggcctgttcttagcagggataaacctgccctggttgccctcaatcatgaaggggagtcagacaaagagtgtcctgtgttctggctgctacaggagcagggctgcttagaagaaattctcccgcatccctggtgctctgagaaataaattcttggtgcttctgcataacaggagctatataacttgttctcagaatttgtcttgtcttcagacaacatttactccttcactcatttctctgcactaaaaacagatcctgtaaacacctgaacaaatttcccaaaaacacaccagaaagattgaggaaataggaatcacagcgataagggactgggcaatacaat

SEQ ID NO: 72941 - DNA, 1050 bp, Homo sapiens
tgttactcatagtaatcctcccttacatttgtataacatgtaaagttttacaaagtacttacacctcccttatctaattcaatcttcataaccaccctgggcagtactaatactatacacaggtctccaacttcaaggttggtgttcctgccactgcccaggtgaagctgcaaagctgctgccacctctatctccatggttgcctctgtctggccatctcaggcctcagctctgccccatccatatactaagagttaaccaagcgtggaattggggtatgttacctgagcatcagtcagttttgccaggagacctgatacttgtccttgtttccattagtctatttaggaaaagctgggaatgcatccttctatgacttgttggtttttagcactgttgtctgggtttgcatgtgtaaatatacctatgctatgcagctgcgtgggtatccccaaaggagggattgttgcagtctttgaccgcccttttatttgctaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttata

SEQ ID NO: 72942 - DNA, 1082 bp, Homo sapiens
attcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaatatttgagtctgatgaatttcattgaagttctttacatccatgttgggaaacaactgtcaggaatgttaaagagttatgtatagtagtgtttcaaggcagtggttttattgcaacaagcattgttttctgtcagcaagacacctcatgtaaaataatttcacca

SEQ ID NO: 72943 - DNA, 1117 bp, Homo sapiens
ttatgtaccacattttatttttttatttttttaagtgttaaataatctttatttgatattacacataaaccacactaaaataccattcaataagtaaaaggaaccattttaaatacagggaattctaattagattggcatagttaaggccaaaaatataaagtaaacattgctaccttatcttcaaccctggcctttaagaagcaaataaacacaaaatatatgtgaatcttgcatggttttgagacagtgaaggaatttccccagtatttaaatatattcacataaccagttatataaatctaaatataaaaccactctccaataagttttaagatggcactcaccatctttgtgaaaagttgaacattattaacaaagtctaatcatatctttagaaggggtaaacagtgatagcatttactgaattaaaattacttattaaaattcaaaaaccaaactaccaaacttattcatttaatcacaagccagtcttagttttaaatcaggactgtccaacaaaatatgctctcagtcattcatgatctgaagtctggtgtatgagatctattaaattatggtacacacaaaaaagtcaggagacatttctgttttttaataaataaggcagtggaaaattgttacccactaatagcttttttgagataagctatcaagtctgcctttctgccttcttaatgccggcaaagatcatttttgttccagggatgtacttcttgggattctccacatactccatcagtgtatcctccccccaggtgatgcctttgttcttattggcatctgtgtaagagaatccaatggcctgacctgtctcctgcctgaagagaccatggagattaggcccagtcttgtgcttgcctccctttccacggtgtggcactgggcacacttctgaacaaaaatcttcttgcctttctcaacatcacccgtatttaattatctctttcatcgctggcactacaaaggtttctgctcggaagccagatgtcccattctctctatgtaccacattttcattatccaatctatcattgatggcatttagattgattccatgtctatgcatgcatgcatgtatctttataagacaatga

SEQ ID NO: 72944 - DNA, 1005 bp, Homo sapiens
gggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctcagtgtctgttttcaggcaaaagtttcttaaagaataagtgtgcagagaatattactagaacatcagcattacttaatgtttataaataaatttcattagtcagaattgcagaatatcatcctttcacttttcctttctagcaggccaaatggcaatttctaaacatcacacaatggattaccaagttgtaaaaattagacaacaataaaatattcccagcaataatattaaacacacttttgttt

SEQ ID NO: 72945 - DNA, 1136 bp, Homo sapiens
tgtctcactttaatttcatcatctcaataggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaacta

SEQ ID NO: 72946 - DNA, 1051 bp, Homo sapiens
gcatgagcttcttaaaattaggaatttaaaagcaaatctgtttgattcattcctgcttttttttttttttttttttttttagatggagtttcactcttgttgctcaggctggagtacagtggcgtgatcttggctcactgtagcttctgcctcctgggttcaagccattctcctgtcagcctcccgagtagctgggattatagtcacgtgccaccacgcccggctaatttttgtagttttaattgagatggggttttctatgttggtcaggctggtctcaaagtcctgacctcaggtgatccacccgcctcggcctcccaaagtgctgggattataggcatgagccactgtgcccggcctgctattttaatatttgagagataatgttaccaacatgctcatccacaataattaccaaaattcatataattgtattcaacctgtttttacatataaagggagaagtgcttaattaacctaaacaaaaaacctacctcagtcttaaccatatgacagaattcttagaattttaatagctcacatttcatgtcatatttagatgaaacaagccatgattataattaacctgtcagggctcttggactggtagagaaaatatggctaagctttggaaaaatacatagaagcatgttttagcagttttccaggttcaaataattttcacaaattttggtcataaagctacagtttaacataaaatcctttaatgcaaaatctagtttatgtaggttgttaatcccactcattgaagagaaagttacataaatgatattatgagtcaatctaatttaaaaagttcacagctctgaaatttatagttaaggttattgttaatatagtataaaacaaatggtgttgaaaaatctcagtatctggatgtcaactgtttcctttgaattctgtaaagttatttaatgaaagatacttgctatttcaaacagctgacagctagactagtctccataaaccaagcgttaaatattaccactagattattaaagctacattttgaaagttagttatgcagtct

SEQ ID NO: 72947 - DNA, 1030 bp, Homo sapiens
aaggtgtagtatttgacagaataatgccagtaatgtcaaaatgtaaataaagggaccagtggcataatcagaggactgacataatagtaactgctcctgaaaaatctggtaaccaagaattctagcttgaaacctttatacttttattttcatttctgaatcttgacccacttaacaaataatgtctctggtcagaaacatattgaagtgataagcatcagtagtttggttttctcacctaatactctgaacggaagaatttaatgtttcatcctgcatggtactggttctagctgcttctccctctgggacagcctgtactggctgtactacatgaacagtccggaagagctgggtaggatatggagactgcgtgggctgcactgtcctcaaaacttctgatggttgtgcaacttccacaggatctttgggttttgcagctttagaattccctggttttagaactgtagtggctcctccttttacccctggacttgaagatactctcgaccggctggtttgattcctatttgaagtggctgatgaagatagcgatggatctgaagactctatgctggaacttggatcctcatcatttatatatataagatcttttggcatttctttaaactgatacaccaagcgctgaccttccacttttgccagaatacccctttggtaatagtacctattcaaagcagacaatttcatcaatcaatcaaacatcaattaaaatattcaacaaaatcaaatttccctaatcataaacaaaactttaaagttggaatcaaactaatgagaaaagaatttctaaataaagggctgttattttatatgagataaacatacatttatgcacagatagagataagttcttattaccaactaaatctaaaactaatgctgattgggggactgttgataaactatgtggaatcctctggtctttcacttttcttcctctttctgctaacttatttacttatttatttggagacagagtcttgctctgttgcccaggctggagtgc

SEQ ID NO: 72948 - DNA, 1053 bp, Homo sapiens
taatcatcaaaacattttatttattgcttactatatgccatgcattatcacaaatgatttatttacacattattcttacaacaattccagaagatactattattcttattttgaatagatgtaggaactaaagcttagagaggctggataacttgcatgagttcaaatacccaggccatggtggagtcctaccttaaataagaacctgagtttttactgttacaccctgttcaccatgtgtgtatgtagtgcatttgctgcatggtaaggtactgtcagatcgtgttgtaatagagtaaggtgctgggtttttgttttttaaatcaaatgtaaaaggaagtgatttcaagaataattcagaagtcctcaaagcagtgtcttcataggataaggctttggggcctcagtctgatttgaaggctgggcacagggatttgtctcaaagatgtgttttcatagcaagtgcagtgtttaatttgtgtgcttattggacaggctttggagtcaggggagctgttgaagactgtgggaggagtaaggcaccagacccctcttggtgttttcttgccttgatgcaaagatgttgcgtgaactactcgaaggtgtgctcattttgcacctgtctttaaaaagtagtgtctgctttggaaaaatgctagagactaaatttaacttgctttttgttttgggaaaatattttgtaggtatttcattttaagctattttagagaggattttgatgggatgtttcacaatcaccatataccagattgagttctgctattagagaaacttggtaaacaagttatatgaaagttcttgtgctttttgatacccaaaaacttgatgaacaaaattattaatgaagttggaataatgattcatggtttctgaaatatccacataggaccttggattgtggtatgtggaacaagcaagcctagttaggggagtcacataatgtcctgcttacattggtcgctttccttctctttttaacttgatggtattgccacatacgtgatcaaccacaagtggaaactatatcgtgga

SEQ ID NO: 72949 - DNA, 1034 bp, Homo sapiens
aaagatttaaaaatacttcttactaaactttaaatgtatttgattttaaatccttatataaatcctcttaaaggtgaaaatatatacgttgtgaaattactcattgggtagcagtttctatgtatgtgctttgctgagttggtgaaaagaaggaaattgtttatatatcctttattgcgattacaaccctcattattgctggggttttttgaccttttttttttttttaatattgagtacttttaacagtagtttaactggagagtgggggagagaggcataattttcagtagtgacagatgatcttagcaggagcaaactgttcaaataaaatatgtaacttttaaaaaagagcgtatgtgcattagtcgtgtcgattttatttaaaaacgttaataataaaaaaatgctttagcgatactgccctctgtatcagttattatatcctaagtgggtgattgctttttcataactaatctgagcttttgttttttaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacaggtatgagattcagagaaaatttcattttaatgactttattatgatttttctattcatatcagaaaattatttcctttaaaagacaatgagagaaactttattgaaagtaaaaatttatagatgaaatatttggaggaaatattatactatgttttaagcaccagttaattcatgaagaataagtcttatccttagctttgatatggtaacaaggaagtaatacctttgggattcagct

SEQ ID NO: 72950 - DNA, 1038 bp, Homo sapiens
gttactttataaagactgacactttgaaaaaaacatgtttgagaactattaatacagcagagtgcttcctgactataatagataattaaggatgggtaaatttaaacaagttttaaatttactgaggacctttcaatttgttaggttagaacagaagccttttttctaatccgagtgcccatattttttttccatctaagaccgtatttgaggaattagatgatgcatttagttttggacatgttttttacacactgacttcaaggggcactgatgtagacttgtcttatagtttagtgactggatttggagctcagaagctgaacctagagatggagattttaaaaattttttacatatgcgtttacttaatctgtgttataaactgttatagcagaaaggactttggtggattttagaggcccagctgtatattacagttttagagagagtcctgatttaggaaacaagaattctagttttagttctgttttgcttgtagaccgtgagaacttgaccaccccaatttactaattaaaaatggaatcattgatttagatcttcagtcttgtctgttactgaaaaaattgtaagatacctgggctttgtaatcaaagattataagaatctttgatatctacaggtgctccctctggatcaggtatcagaaaatgtattctcaagaatcaccttgatgcagaagagtatataagtacacaggggagaggaagaggagcaggaaagatgacagagaatcaaagacatgattgagccagtaaaatgcttttctttgcttacacattttcagtttgtggacttctctatagaaataagcaaaagctacatgccagagcaaaagtgtctttttctgctgcaataagtggcttagtgattgtggggagccatttcagttttgatttattactgttagttgttagtatgtataaggtgtgggtatgttggttgcttatcctgattttttagatttctgaaagacaactgttaaagcacagtagcagtgtggaagtgctggtacga

SEQ ID NO: 72951 - DNA, 1062 bp, Homo sapiens
caagtgttacttatgtaaacagttgggtaaaatagtttgagggcctgttctgttgtttagacacttggttttttactcagtcattgtggttttcaaatcttaatttgtgtggtgtttgctcctaagaatacttcttcaaaagactataaatgagtctttgcgtgcatattgaatcttagatcccaagaccaaaatacttttttattggctctgtttgcataaacactcttcaccatttatatgtttgtgctactgtactttcatatattttcacacaaactattggactatttataaaacaagacataaagatgtaacagagaaggcaggaaatacttgacatttgtgtgccatatcttactctgtgcttcctgtcagttaaaccacgatgagaggaacagagacacagatgtacaattgctgctttaatttgccactggggagaccagttaagcataaagctagttttattaaacttttgtcacttgttgattcgagggacgttgtaggcttgtttggtattatatggattgtatgcatcatgtggtggcaattagatgtttgctacagcacctaataggaacatatatcttttacatatttaaaaggtatttacttttgtgacattttttaggccataaaaaaattggcatttgaattcatatatttgatataaattcactatgaaatattaggctaatattttgatcttgaaattttagtatctaattattaacttttatgtattagtatatcaggattctgtaaaactttcaaagcattttgtagtttaccaagtaaattcttacttggtacaacttcaagatgaaagatgaaatggaaagttatagaggttgacttatctaagaaaatacagttagtaaatgatgttcaactacaacttgaatgcaggtgttctgatggtagatcctgtatccctaatgttagggaaaaggtttgttttcattaaattcctattctacctgtttctcagtgattttaacttttagggtcacctttgcttattcttcccagaatatcccccaccccctttcctttcat

SEQ ID NO: 72952 - DNA, 1030 bp, Homo sapiens
gtcttccacaaaactgtccctggtaccgaaatggttgggcactgctgttttagttgaccatcattgcatatactgaaatgtagatcatgcatatataagtattatgtgatcacatactgttttgtaacttttatatttcacttaaatatgtcctggagatttttccatacctgtaccattttatttagacaatagcagtatggtacattccatataatgggatatagtttctgtgacgtttcccgatttacataatagtttgtttctagtttcttactactttgaacaatatcgtgctgaatatatatctacatctttgcacgtgtatttattttgttagaataaatcccaaggactgaaactgctagataaaaagatagaggcattaaagtcttttggttgtgaagttgccttctggaatgatactctttggactctcataaataaaatatgaaaacatttttttccatgtaccctctctaatcatttgaatctttgctaatttaatttagtaggtgaaaaatggcattgtttttctgctctgaggttatgagaatgaacatcttttcctgtatgactacatttcttttgtgaagtgcctattcatgccttatgcctgtttttctattagggtatttgtttcaattaacaatagctttttccctccatattttattatgaaagttttaaaacacacagcaaagttgaaattttataatgagtactcatacacccactacctaagtttttattaaattgcagatattagtacattttcacttaaatattttagcatgcatgtcattgagcagtgtttcagtattttagtttttttcttttgagataaaaaactgtcttagaactaaatacatatatctctttaccttaaacactttattttaacttaaaacctagaattggatgttaattggtcaatcttttgatgaagggtccaagaccattttctttgagagtgagcccactgtcacagttctgtattgtatcgtcttaactgcacatccacaatata

SEQ ID NO: 72953 - DNA, 1041 bp, Homo sapiens
aagagttttgttgcaccacaatgtgaatgtactaaagactattgaactgtatacttaaaaaggattaagataatacgttttgttctactttaccccaattaaataattttaaaaagcaaatttcagtttgtatgtggatactctatgcacattatttatgaatgtaaacagcatctgtaatgatgcagtttcttatttcaccaatatgtgagtgttagatgctgggataaaacaatgataaaagctgacaagatcctcatgaagcttgcagtttagtgggagagacggacatggattgaacaagtaaaaagtgtgcttaagtgtacacgcatggcagggagacccctaacatagtgtagggaagggctggattgagaaggcttccctaaggacatgacgtttctgtagagatccaaaggatgactaagccttatgtaagagaaagggagaaaagggaagagagagtagattgagggagtagcattttgcaaatggtctgcaaggaggaaagagtgtattttgggaaatgaaaggcctggtgggctgtcatgtagaaagtgagatgcaatgggagatgaggctgcaaggtatcaaatcatataagacattctaggccatgttagatattttgaattttatcttcagcagagtgggcagatattgatgggttttaaatgagggattatggaggtggaatggcataggagcaagaaaaatgatgtacttttttgtacacttggtctttaactgtaaactacctgtttagtatggtgcttgaatgttggaggggattgtatattggccaccattgtgagctgttcatatggtaaagtgtacttaaagggtgaacttaagagaattgtcaagggtaattgaggataagtgattttcaccttgatactgtgatttggtagtttgaagccctagaaattgatacttgacttgggagagtctggagtaagaagaagactttgagcttttaggacctctagtggtaagtggtgaggaggtggggcagagaaaactgagaaagagtagtcc

SEQ ID NO: 72954 - DNA, 1032 bp, Homo sapiens
tgaggtggtaggattgcttgaacctggggggttgaggctgcagtgagctatgatcgcaccactgaactccagcctgggcaacagggtgagaccctctctctagaaaataaaaattaaaataataatggaataatttaatggggaaacttcagctcctagttagttccacaaatgtggtaagtgcttattaaataactgatggaggaggttaggtaagtatacagataattatgatacaatacatagtttgataaatgctcagaggggactaagccaggggtcataagtgtttgatagtgttcaaaatccatatctgagtttgtgtgaggggaatgaggaaaggcctcctgtaggaggcagcattcgagataagctttgaaggctggttaggcttttgctggtagagacagggatggggacaaggcattgagaggaagcaagcaggagcagaggcatgtcaacagttactagcacattttaatggagctgagggtgcaggtaggataggaatgggaaataaggctgcgaaaatagattagggtctgtagtggacaatgtgtttttactatcctcctgatgcctagtgtgcctccaatggctcatacttaggaagaacgatacctcttacctgcagagagctggaagtgtctggggacatatcctcctcccgctcacagaccactgtcaggagtgtaactttggagcaggggctttgacttgtttccctctgtatcatcagacttgaagcagggcttggcacctggtaaacattcagaaaacatttgaatgaatgaatgaaaatcaagaagtggcaagcaaggtctatttaaagcaaagcaaagtttattttacgaagccccttgacaaggagattttggaagcctcttggatttggagctaaggagtttagttaggaaaagagatttctggtaatacgaggaatgttttaatgaaatgaatttggtagtaacgtgcaggttgaactggtggatggaaggattatgtctgtgctccccatctccactgtccctt

SEQ ID NO: 72955 - DNA, 1357 bp, Homo sapiens
cctcccagcgcccccgtccggcccacaccctcttcagccgctcttgcgactcttcctatgcaggacgggctgacccccctgccctgggcgccccagagcccgcgcccggaccagtagctctagtggttctctggccgcagggtatttacgaggccccacggaacacagtgtgccttccgcgccctcccggggggacgcgctttcccggccgcgcagccgcccggcgcccctttccgccgcgtgtgcgctcgcgtctccacccgcggcgcctgagcaagcgcgaggccggcctgcgaggtcttcccaacttgacttaaggggcgctggtcgcagtcacggaaagtaccctcgaaaaaaggcctttgggaacgagaatcttttttctttccctttaaaaatacacaccacgagctatggaggagaaaaataccactctgatgagatggctttaaataagtatatcgactttccaaagggtctaacattttgagcgcggttgatttaaagaaaaaaattgattaaaacaacggcaaaacatcctggggtggaggtggggcttgggaaagagaaaattggctggagactggggaggggacgttaaaacaaagtttcactgtatttttaaatatagaagccctgtgtttattacaaagaagggacagctgtgtcagcagcatgtgagctgtaaatgaaacaaaagcgttatcttaaatgcaagctgaaattagaaaatagggtcggctataatgtttattgggcctctgggaacaaacgaagaaggaaaaagtgactcttgtagatgggtttctggtcagtgccattactgaaagcagatgttttggttgttagtatgtgtgttcccagactattttgtagctttaactgcacagtaaatttgttaatgtgatctgcgtgattaaggattaattaggcttaccttgttaaaaagaaagaaaaagcctaagtattttaaatcgtcttcattaattcaaatatttgtgtgtttgctacacaccaagcaccaccacatgcttttgaagttactgatgtttgtattctttatgttagctagtggatagaatactgaatggaataatattttggtctttgtgattagctgtgtgatgagacttttcaccttctctgttctctggctttagagccatacatttttgataacacgtatcactcacaaattttaaatagagttacaagaattgttgagcgattcctgaatagataatgaaagtggaattttcatttaaataagtaatagtgtgtcattattaagaagcagttactaaagaattacagtagttgaaaatttggaaagaaggaaagataactcggataactc

SEQ ID NO: 72956 - DNA, 1057 bp, Homo sapiens
ggtgtttaggatttggatttttttttgatgttttggtctttttggatagttgctaaagttcttcactattttacctaggctatccttataaataaataccatgaatttttaaaaccacacaggtcacttaaagtctctctttcttggaggtacctaggctgtaaaatgaattttgtgagttatctagagtaagtaatcccttccagtgtagtctgtctttatcttcttgagttggtaatacacattgatttaacctttaattagaaacaaaattaatttaattttgaatggtcctttaatattgtattctttgtgtagtgtaatcaactttaggaaacgcaatgtatgaaaaacaggaggattatctgctttacaaagtcacactttaaagatgaattcatggtagtattttaaaatagctcagttaatgcatcatgtaagatttgattgacagaacttattttgcagagcttgtgaggaatttcttactgcatttaactagaaacttgtaatttagggagcatttctgattgtttaaatagataattgcgctcactcaccagcccctgtccccagtcatctagtggccatcactccccataggttatcatttttttttttcattttcttgcctatccttccattgtttctacatgcatgtagacacaagttcttattccagcatacataaaaggtaatgtactgtatatattattctgcactagttttaaaaaatttaacagtatgtaactggagctccctttgtatccatacataaagagcttctttctctctgttacagtagactatgagaatgtaccatagtttaaccagtcagtcccttagagatggataccgtattgttattgcaaacagtgctgcagtcagtaagcttgtgtatatcatgattttgtacatgtgcaggtatatctatagaataaattaccagaaatgaaattgctgtgtcaaagggtaaatgtatttgtagtcttgatagatattgccaaattatcctccatagaagttgtacattttgaaccattaccacattgtataa

SEQ ID NO: 72957 - DNA, 1097 bp, Homo sapiens
acaaatactccactccctccacccccaaactgtgtccttttttttcccataatgcttttgttagaaggctggatggagatgaaatagtgatatctggctgggtgcagtggctcatgcctgtaatcccagcactttgggaggctgaggcatgtggatcacaaggtcaggagttaaagaccagcctggccaagatggtgaaaccctatctctcctaaaaactacaaaaaaattagccaggcgcagtcgcagttgcctgtaatcccagctactcaggaggctgagtcaggggaatcactgggacctggggcggcagaggttaacagtgagccgagattgcaccaccgcactccagcctggataacaaagtaagactccgtctcaaaaaaaaaaaaaaaaaaaaaagtactgatatctatccaaaaactgcattcagggcaaatattagttggtttgccgtcagttgccattcacatgttcctgtccatttggaaggaattgttcctggctttcaaaggtgagacatccactgcttgaaagttggttctttattagcaaaaaccaagcttcctggccatgattagtactaccacccctaatacccaggtgtattagtcagttcttgcattgctataaagaaatacttctgaaactaggtaatttatcaagaaaagaggtttaattgactcacagttatgcaggctgtacaggaagcatggtggcatgagcttctggagaggcttcaggaaacttacaatcatagcagaaggccaagggaaaacagtcacatcttacatggccagaccaggagcaaagggaggtgccacacacttttcaatgaccagatctcagggtagcttgctcactatttcaacaacagcaccaaaggtggatggtgttgaaaccatgagaaaccacccctgtgatgcagtcacctcccacaaggccccatctccaacttggaggattacaagtctacatgagatttgggtggggatgcagatcgagatgatatcaccaggtgtcaggaggagaggcaagggtggctgactgtctgagttattcaatagaaaatcatggttatccttagtttatgctgg

SEQ ID NO: 72958 - DNA, 1181 bp, Homo sapiens
agactggagtgcagtggcacaatcatgattcactgcagcctctatttcctgggctcaagcagtcttcccgcctcagcctcctgagtagtgggtactgcaggaatatggcatgatgcctgctaactttttaattgtttgtagagacaggttctcgctatgttgcccgggctggtctcacactcctgagttcaagcaatcctcctacctcgccttttcaaagtgttggaattacaagcataagccagcacactggggccaggaaaggaaatctctgtgataagcaagtttcaggaaatctcttgtttgctcattatcaatacgtttcctgaaattggtgtcagataaattgtgaaccgttagaaatatcacccagttcttaggtctctcattccattggagttatagtttacacatctagtaaatccgggctgtttgaaatcaatttctgaaagatacaagagcaagaggtttgagaactctgttatcttcttgatcaagagatagtatgaaatacatacagtattgtcatttaataattgtaagtgataaatgttatgttgaaattacatctgaatagaattaataactaaataacatgactttaaaatgtgttgagcagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggtaggtttttaaattttactcttcacatcaaattttttttttttttttttttttttttttgagatggagtcttgttctgtccccaggctggagtacagtggcactgtcttggctcactgtaacctccaccttccgggttcaagcaattctcctgcctcagcctcccgagtagctgggactacaggtgtgtgccaccaaacccggctaattttttttattgttagtagagacagggttttaccatgttaataaccaggatggtcttgatctcctgacctcgtgatctacttgcctcggcgtcccaaagtgctgggattacaggcgtgcgtcaccacgcccagctgacatcaatttttgaaaagctctac

SEQ ID NO: 72959 - DNA, 1044 bp, Homo sapiens
cttagataatgcatcctttgtgcaacaggaataaattaatacatagaacttctcccagcatttatccacctgaataagtgttcagtatcttaaataatattgtaaagtcagtattttaaagtagttcctactccaaaatgagcaacttctaatgtcattagaaagctgatcttggggcattggttatatgaaaacgtttgtcttaccctgtcaaatagagttttactttaactctatttccagtgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtattt

SEQ ID NO: 72960 - DNA, 1086 bp, Homo sapiens
cctacaaatgacattatagaaagcatttgctaaacgatgtgctgattaattggaaaacttagaaaagggttcttgtcatgaagatatttcaacactgctagttcactgcacagcaagaattttgtacatttagcagaaccattgaattagaaagtcaggaaacctgggttctagtaccagttttatttataactaaccatgtacaaatcacttatctataaaataatggttaacatctactccttaattcacaaatagatcacaaaaccaagatccttcccaagaaaaccttactgtaaaccaagacattcccactatttagactaggttttaactcaaaggttaagaactcaaaggttgagaaagacaaactggagcatttgtcttttatttaccagttgcataccttaattctgcagatggataatctggttgagataagcattgccatctctcaatttttacaaaacaaaaagctaccaacaagaagttaatggtgaagaaaaatttgtctcaaaaataacacaattgagaaatagctttgtattaagtgcagtacttataacatccctgatgtcaaatgtacaaaatttagctttaggtcactaaagcatgtttacccttttgaagaaacatgtattgctaggtcagccatcctacttcactggaaataacgttaaacttgtagactgttcaaatggccaatcaaaatgactaagaaacattatcgtgtgtttttttgtttgtttgttttttcatcctttctctttccttttcgttcaaaaattcagttccccatcctagaccagactcctctgtcctctgccagggtataagaaaagttagcattctgtcactatagaacatagaagaggaattagcatgttattgaataaagaatcaggaagataattctaattgggtatagaaaaatttatacaccataaacatctgtatatgtacaccatttatcatatatacgtattgtgacaaccatatgtattaataaaccttcaaaaggtaagcacctatattttcttgtaattaacaattttagttttgtgcaatgtagtctatatttgtgga

SEQ ID NO: 72961 - DNA, 1032 bp, Homo sapiens
agttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgttaggccttttgcagtttgactctggctttatttgcctttgtgctcgtgtttatccttcctgccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaatt

SEQ ID NO: 72962 - DNA, 1053 bp, Homo sapiens
taaagatggtttgagagcctagaatggtgttgtcataaaagccaatcagtggaattttaaagggagggaggtggtcagtttcaaaagtccatctagatctctttgttttgttgtctctggagttgttaggaaaatccaaatctcagaagatttattttaaaataaaatgctaactgaattcttctacagagtggggatcttcccaagttagcgattgtgttcattgtattacagaacattagtaatcctttattgttattaaataatgactgcaaagaaattaaataaataaacactaaagtctttgcttatatttctaatcattaggtttcataatagctctctcttttaccaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgt

SEQ ID NO: 72963 - DNA, 1102 bp, Homo sapiens
aaaagtgacagcaattgacacagggtgctgtgtatatcgggtgttggggaggtggaggagatgagcagactaagaagaatgcaaataactgtagcatgagacaaactgtggtgtgccatgaagaacattccaagtacagtggatttcagggaagaagagaatgtatttcaattgctggggccagaaaggcagaaatggtaggagagtattagagaagggcatcccttgagatgatgttttatagcagagataaccgacacacacataataatgacatagtattattagtggcattatggagattaacgtaattttcagaaataacactgggaagattggccacgttacaaagtaccttgaatgctgagttgagttgtgtctgctcagtagacaagaaggaaccaaagaaaatttatcagaaaactgtactgtaggaagagtaagcagggcagcacaatgtgagcaaaaaaattggagattaatcaggagatttttgcagaattgtaggtgaaagtaatgagtccatgagtgagaggagaaatggaaagggcaggatataataagagacccatgaaaccaattggaaatgggcagttggagaatgggatgaactgaagatggtctctcccgccgtgtgcatctttgtcaaagcctggcatagtaaactcagacccacaaaatgtttgataaattgcagaatgtcagaattttctacttggataaaagagaatacatggtactgtcatttatagaaaccaggagggggaactgattggagtggaaagatgattaatttgattttaaggatttggagtttgaaatatcaaagaaacattccttcttattctataaccgagctctacaaacctgtagtattaaacattaagttctgcccattctttttctttgtcattttgtatatatgtcttttagaaagtatctaaattgttgaaatggtcatttgccaagtgctttttccattgtaatgaagacatttataaaggtaaaatataaattgctttttgttatggcacaggtgggaacaagagcccagtcagagcgaattcggacatataatttcacccaggatagagtcagtgac

SEQ ID NO: 72964 - DNA, 1269 bp, Homo sapiens
aacgttggtatcttggtagaactgataaaagggacagaatcaaacatttatcttgcttttcctatgtaattgtatcaccatgtaatcaaatggtagacaaggggaagtgtctctttattagtgtattttaactaataagtgagaaaggaatgatagaattagacttatcaccattttgtaaccccagtgatgcattcagtgtcaaagcctgtcaagactgtaaaaagagagacatccagacaccgtatacctcctgtcgtcttgccaaagggctcgagctggtgtctgatccagtgtctgcatccagctgcctaattgctgccgatacagagggcagcagaacagggtgacttgcaccaagaatatgcagtctgcaaaaacagactgttggaaattctacaggtcagcagcccaagttcttcaccagatcatttgtaggaaatgaaagcaatggatgatgagcatgtggactaatagactaaaaagatacatcaaacatttttaaatgggcaggactaaactgtagcgcctagggctacacgtttaggtaatgaagttatgataaagaaaggaataaaagtcaggataatgattactcatagggaagagagaggattatgtctggaaatggcatttgggagggcttatgaagtgactagcaccgttctttttcttgacctgagtggtggactctaaaccacatatttgatttgtgtgtttttctgtctttcatatattattgtatcataaaaaagatttttaaaaaaacattagataagaacaagtggccgggcatggtggctcacgcttgtaatcccagcactttgggaccccaacgcaggcagatcatgaggtcaggagttcgaggccatcctggccaacatagtgaaaccccgcctctactaaaaatacaaaaaattagccggacgtggtggtgggtgcctgtaatcctagccactcaagagaacgaggcaggagaatcacttgaacccaggaggcagaggttgtagcgagccgagattgcaccactgcacaccagccccagtgacagtgcaagactctgtctcaacaacaacaaaaaaagaacaagctagcctaggtgttaagattctttgtgatactcttcccactccatagataagcaagagctgactttcaataaattcttgaaaatttgggaggatctgtagagttattcaacagtatgaaattattctcctattgagcattcttttatatatgataccctattagcctaagactacacag

SEQ ID NO: 72965 - DNA, 1131 bp, Homo sapiens
atgaaacaagatttcttgatgttccttccaggtttattatgcatgtatctttagagatgatttttttttaaagactgtgtttattgtatttcagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagtaggtaaaagatacttatgtgtcctgcataagggctatgaaaaaaaaaaccacacacttatatgcgtgtgtgtaagtacagatttgattttctaagttaaagctttattgaacttagtctttgttttttttttcccacagaagcaggttctcacttgttgcccaggcaggagtgcagtgactcaatcgtagctcactgtaacctgtaagtcctggccccccacttcagcatcctgagtagctaggactattgtgccagggctttccaaagcgatatgattatagccaccgagccactgaggctggcctgaactcagtcttttaaaaaaacctacaagtaataagctcaacacttggaaagaacaggactctgtacccagagtatttgacacactttagctactaaagatcaatgtactaagtaaacaggctcctcgtggtacttcccgtggtctcaaggtctgggagacaaaatgttggtcttttcagaagctttattttattgagcagacctttattgaacactgtacctacatactagggctacacatacagttcctaccccatcagtgggcttctatggtccagtgagagaaacttatttaagtattgtt

SEQ ID NO: 72966 - DNA, 1018 bp, Homo sapiens
aattatcttattgcttataaatctctttgtgaattatgcaggatattattttagaaagataaactatacccagatcctatttgcttgcttattgttgtttcagagtaacatgtagtttatgtatagatacatcctttatgtggtactataaaattaggtgtctcttgggtgggaagatacaactttctgttagaagtgtaatttatatcttttggaaggataatggagtttcattgaagattttaagtgttaaagttaacatggaagtttagtttatcttcttatattttaaacatttgcaatcgtaatcctaaaactgttgctcctttgaggcttttatggggatatatgtaggtttctttgattcagcgtgtttacgtaggttatgttattagacctacgttataaaaagattttcttttccatgagttgtatgctaaaggaatatagagaagtgcagcatatcttgagtctgtgatggcttgtatatgtgatttgggttgtatttagaatcttgcaatgagagaagttttggatttttctggagatgagtttaaaacagtgacttaactgattatagtattttgccaccacagagttttaaatgtcatttttaccaaaattgaaagcagctttaatattgttaatgcagttttatttataacaaaattttagaagtttgttagcattttaccatagataaaagttttgatgctatgaatctcacccatatttactgataataggcactttagaagagaggcttcaaatttatgaagaaattagtaagcagcaccccaaagcaattacacccagaagattacctttgactcttgtcccaggtaatattaagatgtcttttataatattaattatttgtcagaattactcaatgttatttatattttagaaacgtgtttctggtatagagtttatgtttacagcagtcttggagttgggagtgaacagttatgagtttatatgttaagagtgtgatacttcaatgtgtagttaaatg

SEQ ID NO: 72967 - DNA, 1035 bp, Homo sapiens
ttttgtttctaggtgaaagatttagagaactaatggataagttcctgagggttaacttcagtaaaggctgcccacccttgtttactactttgaaatctttatattacaatacagaaaaggtaaaatttggtatttattcagatttgctatagtcttttttactaaactgtagaaagatgtccatgtaaataatgtgctattacttaatcattttctttgtttcagtaatgttaccttactttcagtcatgtactgaaattacatgcctgtagtataagtaatatcaaagtaaagggtttatgaaagcactaagattataaaggttgtttatttttaataggtatacttttttttagtaggattttaaatttgacattgttaccaaaggtatatatttattttgtgattattattttatggtacagttatggatttttaaattagttatgcatgcttttaaagttagagcttggataattgagttagtgcaacagtaaaatgcaatttggtcaaattactggtacaaattactaggtttaatcagtaggctacattttaataaatacaggtttagctagttcttgaataaagaattgtctttctgctttttaaaattagaaaataggccaggtgtggtggctcatgcctgtaatcctagcactttgggaggctgaggtaggcagatcgcgaggtcaggaaattgagactatcctggcgaacacggtgaaaccccatctctagtaagaatacaaaaaattagccgggcgtggtggtgggcgcctgtagtcccagctacccggaagcttgaggcaggagaatggtgtgaacctgggaggcagagcttgaagtgagccgagatcgcgccactgcactccagcctgagtgacagagcgagactccgtctcaaaaaaaaaaaaaaaaatttcgaaaataggcacttaaatcttggtcttaaattagaaagataattaaaagttaatagaaagcaagttatacttttatttccaagtgttgcttcttattaaagtctaaaat

SEQ ID NO: 72968 - DNA, 1158 bp, Homo sapiens
acacgcgggggtttgggggaggtttctagaggtgggattttgccatgttgtccaggctgatcttgaactcctgagctctagcaatctgcctgtctcagcctccgaaagtgctgggattacaggtgtgagctgccacaccctctatgagtttttttaaggcacattccagacttactgtttcatctgtaaatatcttagtgtgcatctctatttaaaacacgtaaacagaagaagtcatcgcagtgccatgtcacacaaaacctcataacataatatctgatacccaatcttagtgtgcatctctatttaaaacacgtaaacagaagaagtcatcgcagtgccatgtcacacaaaacctcataacataatatctgatacccagtccgcattcacatttcccccattatccaaaagaagtctttgtgtttggtttatttgagtatagatccagttaaggttcacaccaaataattggttgttatatctccataagttgatggttatgtctcattattttaatctagaacaataactctcccctccctttcaaaaaaacagtcatttgttgaaaggtcatttgtcttacatatcccatattctagatttggttgattgcctttctcatggtatcatttgctgtatttcactgtcattcatacttgtaagttatagttaggtttacttgctggattagattcaggttctgtttaaatacgggtggtgctttgtgcttcctgttgtgtcatgtcaggaagcttgagacattctggttttctctcttttttgatgttaagattgataaagattcagatgttgtcagcctgttatactcattaaaaaggtccatgacggcgtgggggcacggtggctccacacctgtgatcccaacacttttggggatgctgaggcagaaagatctcttgaagccaggatttggaggccagcctgggcaacaaagtgagaccctgtccctacaaaaaattaaaatattagccacgttcggtggttctcacctgtagtcccagctacttgtgaagctgaggcatgaggatcactggagcctaggagttccaggctacagttagttatgatcatgccactgcactccagtgttggtgatagaacaagacaaaaattcctcattggcctctcagcaat

SEQ ID NO: 72969 - DNA, 1022 bp, Homo sapiens
ttcttgcctctgctgaaatcttgcagtggtagttaggaaatctctttgccaagtttttttccttgacttttcctggtcttgctgcccttttgctttcaggctgagagttcacagaattagtttgacgtatatcttttccccagcattgtttctttggagtgagattggggttagaagcctgtcaaagtacaatcttatttctctacatggctgccactttttgaactttatgaagtcatacctctttcttttgaaattagtagtttttgctgagtctttcttgcttattattattgcaatagtcatttcattatgaattaggagagagaaaatatgtgatttgctttacattctttctataataatttaatatttgtttgattgcagagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaaggtaaaatctgaatcctgttttttgagtagttgaagaattcagctactttaagaatccttggagttttttctttgtggaaacaagttctagggcaccctgataatctttttctaataatcctgtgtagtttcatgttatattaattgtataatcaatgtgtaattagatgtgtaatcatttgagctcttagtaaatgtgaactgtaattttgatttctaaataaatttgacagaaatggtgacagatttcttttttgtctgtgtaaattattttccattttattgtactcatattctcttgattataaattgtggttcctttaattatcttttatagcatataggtaatctcaaagaagctgcaaagtggatggatgaagcacagtctttggacacagctgatagattcatcaattccaaatgtgcaaaatacatgcttcgagcaaatatgataaaagaagcagag

SEQ ID NO: 72970 - DNA, 2336 bp, Homo sapiens
cctaagtgacagttaggtagcagacagtgtggatgtactagacaaagggatgattcacgttccgggtgggatagagtgggatggtgcaagattttatcacagtattcagaatggcatgcagttgaaaacgtatgaattgtttatttctgcaattttccctttaatatctttagaccatggtcgactgtgggtaactgaaaccatggaaggtgaaaccttggataaggagagactattgtagtataaaaccatgtttggaaacatactgatatatttgctaattgctgctattgtcataatagtactgtagccctagttgtaaagaggaaatgatttttaggatctctttcattgtttgctctctatagttttgaatgcttccatttcaggaaggaacatctgccatggaaaatctaaatgaaatgcagtgtatgtggtttcagacagaatgcatttcagcttatcagcgtctggggagatacggggatgccttgaaaaaatgtcatgaagtagaaagggtaagttgttagaatttcgacttcagttttcactgtaaggtgataaaaagcaggtagatttctacacaggatcatctgcctcttctaacttctctgggagcttcattgtgaaaaaaattcttgatctttaacctttacattcagaagttgtaaacaatggattgctttactgatcctcaagtgattatgcttttgacatgtctatatatttttgtctgaaggaaaaagattgttagtaaacaattattgctattaacataaattcaaaatttatgttccctaattaggccattattttgatattcatcaccaccctaagaggacacacagctgatggcaacctctttcccctttaaaacatcaggatctggtccgcagtcagcctctctccagtttgtcttcccaggatatttgctctcacattcagtattctgtataacaatctatggccagtttgcaggcttattttattgcttgcttttaggattatttgtgtgatgtgccttagtgaggggacttttcttttcctttgtgtgaatttttgttttcctgttctttgtcatctctgaagcactctccttccacatggaccacaggaggaaaagagccgcaaatgcacccctgaggcagtcctcagcagccctcagttgtgggggcaatcggcaccactgttcccatcctgacgcagtatagaaccacaggcatcgtagtcaggtgagcctgatgtctgcaccgtggcagtcactttggcctttttcccacgtgaaatttctgagattacccacaaggaaggctaaattttagggggtggcttttgatggggactggaactagaattatacccaagcatttttagaaataacctaatttttgctctgtttttgttttttgtttgtttgtttttcatgcccttttaagcctgggcttgatggctgtatctctggggaaaatcctcctcatcttctccttgaaaaatataaagcccttgggatgataggtgaaatacccaagcattctagtttaaatcaggctcttgtttccttcataaaaccacagatcactagcttgttacactccctagaggaccattattttaagagcattctgcttgttattaaggaaagatacatttttattaactaggacattctcagtgagaggtaaattgtttcccttatgaagaggctgctaggcacttacgaattagtaatttcagcaagaccataactagaaacttaccaaattttctgtttaaatgaaatttgaatatcctaaggatcattatagttctgaacttcttgaacttaaattccatttcttctaacattgatgactatattgctttgttttttaaaattttgagaatttttagaatatgataagtggatcttccattactgagtttcatttagattatactttcccttaaatttttagtgattttggctgagttgcatggaaaaaaattctgtaatgtcagaaaatctactgacatagttcaagaaattaattggtaaaaagcatttttgaagaaagaaactacaggaaaatcattggttgtcacagattaaaatggcagaaatcatcaccctctggtcatgttacataattattatcgctagaaactttagggtttactattaacatttgagattagaaagaagtagaaacataaacaagaaaagaacctactcttataccagttgtaagctagtcttcagtgaatatatctatactaaaagcaaataagacaactcttttatagttattatgtatattctacatgtgtggttatatgtagaaatgtgtttcgtataa

SEQ ID NO: 72971 - DNA, 1658 bp, Homo sapiens
tttagggtttatattttaaggttttgtagtccaacccaatctgatgtttgaaacttgacttttattaaaacaaacagaacaaccttcttcaaaatattagatttaaacttgtgttcagaataacattttaatctattttatctttcaagaattgagttttctttctttccatttttttcttttactattagactgctggtgattggattatcattattttagaatactgacttagatatgaaacagggcaacgatacatatatttctaactctttgataagacctaggacttctgatagatacaaactataggaagatcataactttatcttctattgtatcttaatctttatcaaattgataacatgctttataacaacagattctctattaagtaaattgagttgctaattttcctagttgacctagttattattttttaaatccagaggtttttgttgcctttctctgtataagctcttactagtcacatccgggaactctgagaggtagtgggaaggagaatctggtctagaagagagggcctaataaggagttccttaaaaaaataaaaacactacactctaaagctgtgaacggcttttcttaattcttgcttagggggagagagttaagggcatgagctgtatgttaagatttgaatacgtacttttctgcagtgagctaagtgatttttgtcatgctcttcatgtttggccaaaaggtacagggaaactaactttatctgttggtgttgtgtagcatatttttgtgttttacaaatttagagactaaaaaatcaacccaagggggagcttcttggtgatggagtagttctgtgtttcttagggtagtggttacatgaatctacaaatgataaatcacatagaactatatacacattgtaccaatgtcagtttcttggttttgatactgtattgtagttatgtaggctgtaaccttcgggggaaactgagggaagggtatacaggacctttgctacttcctctgtatctataacccaaaacaaaaagttaaaaaaaaattcaacccgagattatttagttgtttctatatagtattctgcaatacactgttttttccaaaagcaaatattacaatcagctgtagctgcagtatcccacttgtttttaatttagccatattctgtctatcaccattagtttattatggagtgattaacaagccaggtttgcttgaggctgagtgggttcgcaagacacagtgctttcagtggaaaaactgagagagcctctggcaaactaggataagttggtcacccaatttatggaagacattaactggagagaggcagcctatgggctgttactgataaagaggtggcttaaatatttgtggttacatatggccccctccaagacttgacttaaaatctctgtctattaatgctgctaggaatatctcttgaagtttgtcatctgccttttttcagatgtttctcaacctaaaagaatgtcctgtaatctcttagatgttttcatctgattatgtgttccaggacttttagcgccaccatttttccttagttaactgtattgaatttttaaaatattcttgtgctagttataacttgatttacattaagagaaaccactaacaactttatgaaatatgta

SEQ ID NO: 72972 - DNA, 1528 bp, Homo sapiens
aacagtataagtataagattgttttgttgggggaggggcagagggttagtgttcacctttcatggaagggattagttcttaacctcttttggccatggatccattgaaaattggatgaaagctttgagctctctccttaggaagaagtttttatgcttgtttatacatagactccagtttcagaacttctgctaaaatggaatgtaggtagagtaagagaaaacaataaagttctgtatttatataacagtttactgttgaaaatgaactttaaaatacattatttgatcctttaacaaccttaagaaattggctgtatggatttctttattcttaacttagattaaataattgtctaggaaattaaaaggcttattcagggtcgcatccctaataagaagcttatctcttgagtgggcaaatactgtgcttactgaatgtctgctatgtattaggccctgtggcaggcggtgggtaaggattgcccttgaaaatggtagagttgagtagagcagtcagatttgtaaatatttagtgtgaacctacacatatttagtcttcattcagagctctgtttaactgtgccatgctggtttttagggaatatggaggaagagtatttcattaaaactaaaatattaatatatactaactttcaggtttaaaaaataacctgatcttttgacttatatagaagttgagtatcatcacaaaacatgatttgtagggaatgggcatggtttgtaggaagagaaagttcaagttgaatgccaaaaataattcatatcctttatagtgtaaaacattggagagggcagctaagtgaaaattgtgactgtttaaattgttttttgggctttttacaattttttttttctaaaggtagacattattgacataaatgtaaaggttaattttgtgatttttgtttttaagcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcaggtaactgaataggaacttaaaagattttaaaaggacactaaatttcagaatgccattagcgtaaacaatacctagaaaaatattaatatattgtctgttggagttgaagacaaacattagataactcatatgccaaaaaacaaaaatgttgcagagagagttaaaaaaagtgggatgatattctgtagctgatggttctaaattactttaatggaacaacttagaattttttttatttttgtcttcagaaagaccaatttaagaactgggtatggtggttcacgcctgtaatcacagcattttgggaggccaaggcaggcagatcatttgaggccaggagttcaagaccagtctgggcaacatagcatgacccctgtc

SEQ ID NO: 72973 - DNA, 1050 bp, Homo sapiens
gctggccctccatttttgtgggttccacatgggtggaacaaatcataaatatgtttttttaaattgcatctgtactgaacatgtccagactttttttcttgtcattattagtatttcctgaacaatgcagtgtaacaactatttacatagcatttacattattttaggcatacctatagaccataatataatttatgaaaaagtgaagtcattatatgcaacttaaagcaaaaggaaggtgaaagatttaaagctgatctaattaaaagtatacaggaggatgtacataggttgtatggaaatactgtgtcattttatatcacaggcttgagtatcagtggactttgtgggggtgggggtcatgaaccaatcccccactgataccaagggacaaccatactaacagtatgtattacagaagaatatgaagaaaatgcaaacattggctcagaattttgttcatttggatatttatagaaaacttgtcagccaaagaattgaagaaaatgcttagcaagcagagaagagctcagaaaaaggctaaactagaagaagaaagaaagcatgcagaaagagaacgtcaacagaaaaatcaaaagaaaaaaagagatgaagaagaagaagaagccagtggccttaaggaagaacttatacctgaaaaattagaaagggtgagatgggttttactatctttgttatttggtaaaatttatgctatttggttccgttctgacagttaacatgatttatttaaatctgtaagaagccatttgaaatatttcaaggtttttataatagccgtcaattatctttgagtgacagtatacaaattttggctaatgcaagttatacatagaattgcaattgtggtaggcagagtaatggccctgcaaaggtgtctgtgttctggtccccccagcctgtgaatatgtaaccttacatggcaagggagaattaaggtgggagatggaatttatggttgtaatgaattgacctcaagatagattagcctggattgtccatgtggtcctaatatcgtcaaaaggggcc

SEQ ID NO: 72974 - DNA, 2798 bp, Homo sapiens
gttgtgttttttgtttttttttttgagacagtcttgctctgttgtctaggctggagtgcagtagcacgatcttggctcactgcaacctccacctcccgggttcaagtgattctcctgactcagcctcttgagtagctgggactacagttgtgtaccaccatgcccggctaatttttgtatttttagtagagacggggtttcaccatgttggccaggctggtctcaaactcctgacctcaagtgatctgcctgcctcagcctcccaaagtgctgggattacaggcgtgagccaccgcgcccagccataaagggttttcagtaggttttttttttttcaaaggacagatcaaaaacaaaaaatccaaatgtttttgtttttatagtgtctaatcatagtaatcttccagacattgtgagcaaagttctatctcaagaaatgcagaaaatatttgtcaaaaaggatttggaaagttttaatgaggattttctgaaacgtaacgctacctctcttcagcatctactttcaggtttgtttgtagcccccagggttaaaatacttatggaaaaagcgaacaaagagaaagctttgacacccccaaaatgtaaagcaaatgaacagtactgtgtgtaagtatggggagagaaatgtggacaaatttaagttatgttcaataataggggaaacagggatggattcacaggatgtaataccagatttaaagtgatgtttattcaaagggtttgtgataacgggcaaatacttttataataaatgtgcgggattgaacatacaatataatctcaactatgcatgggaaaaaggctgaaaggaagtgtctacgaaagctttaatgttgatttggggtgtgtggttataaattatttttcttttttttttttttctttgaaatggagcctcactctgtcgcccaggctggagtatgttttttcttctaatttataggagaaatataaactgtgtttcattttttaaaattttactttctttttgaatatgcaaacattttcctgttttccccgcccctactctcctcctctgtgacagtaatttattccttagatgttttattttagaatatcttttttcatagttttggctgaaatactgattgatgccacagggcagtccatatttacattctcaattttatttctaaggggaggaagttgttgagtcactgtccatctgataaatgtttaataaccatcattttgtgaaggaagaagctctgatttgtagtgtattttcatgatataaatactctgatcatggcctatcaatgggatgctactgaataggaggtagggaagaaatgtcacacttggctctcttgagctggtaggagccagctccagcttaccactgattaaacacttaaaaccatatttgaagtcactggccagttgatatcacataaaatgtaaagtataggtgtttattcattttgaaatgccttggtatttcaggtgctaaaatgatgtattttctggacaagtcaaggcaggagaaagcaattgctatagccactagactagatgaaactataaaagataaagatgtaaaggtaagttttttttctttggctgatttatgcttacacagtgatctaacaaaacgtgtctttacagcataattcttgagtaggccttcagaattatgcctggatgttaatcccagctctatcaattatgagatgcgtaactttaggcaggttatgtctcttagcttctttttcctcatttttaagatgagggtgaaaatactagtgctgtcacagaatccatgtgagagttaactgaaataataaaacgtgaagtccttagtgcctggcacgttgttaagtactcagtaaatgtgggctatttttgttagtaaaggacactttgatttttagtgatcacagttttaaaatgttctcttttgcagttattagaattttactgcctttttcggggttgaatttttaatgtgccttttttgaggtgattgcttactgtgtagattgtaaggcattattttagactgaggcagctttctcaatttaacacattgcatcttttgattaaagtggttattaactgcgagcttattatttttaaataatttgtgttttccttttgtttcactagacattaataaaggtttctgaagcactgcttgatggcagctttgggaactgtagttcccaatatgaagaatataggatggcctgtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccagggtgcattttaatatacgtatgaaatgaaatatttggttaggatttttaaatggcatattctgtaagcttattttgttctttacccgacctgccaatttacataaccatctgttaaaattacctgtttattcttacacagttttgtggtagctccgatcgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttggga

SEQ ID NO: 72975 - DNA, 1034 bp, Homo sapiens
aaatacacctccttttcaaaggctcttaatggcttaattttttttcaaagtactcaataataccaaagttaggtaactatttctccactaagcactcaaatagtgggaccagaaaagagatttatttcattattcagaagttgcacttggaaaaaaaaaaagaaacttaaacgtattgtttctgtgaaggcatataaaccatatcctagggcagtggttttctaacagtgtaacaagaacctttgaaggatgtttggcagtggaggggggcagtgagtaggcagcactttgtgccccattgccctccatccccaattcaactacaacaatttcacatgtatagataatgcaggatgtttcataagctgggcttttgtgcagtatttcatttgaaggaagggttccactgctaacaaatttttaaaggaaaggaagaattagaaagccattgtgttagggattatgtaatgtactggattattatttctcacaggctctgagggctttctttctggaaaaggtgccattgaccctctgatttagatgactcactctcggccgggcgcggtggctcacgcctgtaatcccagcactttgggaggccgaggcgggcggatcacgaggtcaggagatcgagaccatcctgggtaacacggtgaaaccccgtctctactaaaaaaatacaaaaaattagccgggcgaggtggcgggcgcctgtagtcccagctactccggaggctgaggcaggagaatggcgtgaactccagggggcggagcctgcagtgagccgagattgcgccactgcactccagcctggacgacagcgagactccgtctcaaaaaaaaataaaataaaataaaataaaataaaataaaatagatgactcactctcccttgacagaagaaaacaaggcattaggtgttcctaaaactaagagaagcaggctttctcattacaattcttaaacataccattaagtttatatagaatttggggggtaggaatggccttggaaattattttcaccaacct

SEQ ID NO: 72976 - DNA, 1006 bp, Homo sapiens
gaaaccagtatgtataattttctacatttgatagatgaggaaacatacattgtgtcaattctcataatcctgtgaaatattggttccatttttgccatcttttgcccccgctttataaatgagagaccagaagattagaaagatggtgtaacctgtcctgggctgtatggctagcgaggcaggtgcggcccaaagctcagttcattattgtttgttagggtctcttttctctttttccaactcaacaattccataaaaagcatatgcttacatatactcataaaacattttgcatcattatccaaatgccaacacagcatttttcaagtgttttccttattgaatctatttttaatccataggggagttattctcaggtgggccttctagtcctccatttaggaagatagggctagtttaaaacctagctactcaccaagcatggacacggccttgtgtagaatatggaactttagattgaaaacaaagcaaggaacctttgatttggtcccattttgccatcttctgccagtcctgtgtggctccagttgactaatatcttccagctgttttgaggttgctatgtaatccaagtaaccatgggtgtttccttggtgaacggcacaaagtttggccaggaactagcaaatcatcacttgagatgactttccaaagcacagcctcaggcccactcattgattccaggtgggatttgaggagcaggaaatgctgttgccacccatgttaatgtctgctttaacatgtgcctatgttgcagtacatgtctttcctctcgattaagatagctatcaccggtgactttccttggcttctttgagttattgaaccttttcccttttgtgaatcgattgcatgaatcttctcatcagtccataaatacttcaattatacttggttcagaatctcaatctcttattgcaccatgcatgctctaacaaaagaaaacatccattcttacaaaaaaccacttgattttaatcatatc

SEQ ID NO: 72977 - DNA, 1059 bp, Homo sapiens
ttagaatgaaagttctctgcatttcttatgaattataaagtacccatttagaaaaagaactaaacaattggaaatgtgtcattctcccctccgcaattaatgagttctgttgttgccacccttaaaacctgccaagtaattgttcagtctaattttttgcccaagtggacaggtagataagagtgttctggcacacacatagttcacagggaggcagaaaggtaacagtgcctggccacaagtatgtacgcccttctcctgttgccataataggagtaaggagtgtggttctcttcaggacaattgccctacaggggaagaagtaaggggcatctgtgcccttaacgcaaatgaatttagcggatgtaagagaggaaagagaggacatggggaagggatgaggaaaatgtacacctctagtaaatgctgcagagaagagtctcagttgaagtaaaagagaataccgtaaggtggttgaaagacagaggagttggccaagcgtgtgagaaaggagagaaagaaatagaaacacatggagatcctgagaaagatggggcacagcaaaacaccaagagaaagatgttgctttctactttcatgtagaaatgggactttcatcccatttggtgaatatttcatttaatgctgctgaaaatttttcaaccttttactaggaacttttcaaacataaaagttgagaggaacatataatgaatgcgatggacccgaccccccaacttcaagaggaaaactctggctctactcctagtcttctctgctggcttgttttgaagctaatccaagacttctatcatttcattgtcaatatttccaagtgtatctgcataatataaaaacaaaaaaatacaaactcacaatactattattaagtctttaaaaagtaataattcctcgctatcatcaaataataggttttaaaacggttttgccacttaggcatatgcagaatgaggtcggttcccaccattgatgcttttatggcatcctgtaccttttctccacaactcttatcactctttcccgttatgtgatttgtgt

SEQ ID NO: 72978 - DNA, 1037 bp, Homo sapiens
cagcacctaggaagctttcagctcaaattcatgatccacccatactcaggataccctcctgtaggaaaggagttagatcccagaaacaccttttcctcctatagctcattgtcactgtccagttactgtacccctctgcctattggctggccatgagtaagaaatgggagtcacacacatcccagaaggaattttccaccacccatttctaaataaaagtgaaatatgttccaatcaaaagattaaagtagtgtaattaataggcagttctcatggtatttcccaaaaggaaatgacctacctggactttcataaggaaagcagttcatattgagttcttggttttagttttgttagaccagttaaagctcagtggtaaggtggaggtgggggtggtgatggtgaaagaaaaatgtaacataatttacccaaagtctaaaagccttcaaattttccactttataaaactagaaattgcctaattctgtgtaactaggctttgtttaataataatagtaaaagcagtccattatatggcttttattatgtgccagatactgctctaagcattttagcttcatgacaatcccatgaagtaaataatattagtatccccactttataaagaggagcctgagacacagagaagttaagtagttccccaaagataaatggctggtgggttggagccaggattcaaacccaggcagtctggtttaactatatcataatatactctacaatagcagtgtattatactatactgcccctccaatattggattcccttctaagttctcaagttatacgtgaatgaacaaaagaaacaggttactagtattctaatctacccctaaataggggtaacaatcttatagcccaaaggccaaatctagccaacagatgtgtttttttctctggtccatgtagtgttttaaaataatttcaattttcatgtatttagacaaggtaaatcctaagttagccaatgtccccaccactttttatcatatgacctacctggccttacaggcattt

SEQ ID NO: 72979 - DNA, 1056 bp, Homo sapiens
cctattcaacatcacatgtatacctatgtaacaaacctgcacgttgtgcacatgtaccctaaaacttaaagtataatcataataaaataaaaaaatttaaaaaagaaaaggagcaataagaaaagaaaaataaataaaagatatccagattaggaaggaagaaataaaactgtccctatttgcaaacaacataattgcctacctagaaaatcccacagaatctattaaaaaaaaaaaagacaaaacaaacaagcaaaagaaactactcttagaactaataaatgagtttatcgaagccaaaaatcaattatatttctatatactaacaattgataactaacaattaaaatttaaaaatacatctaccatttacaaacaactttctctaaaaatgaaattttttatttaggtataaatcaataagacttgtgcaggatgtgtatgctgaatactgtaaaacattaatgaaagaaatcaaagacctaaataaatggagagatatactgagttcatggattagaaaactcaacctaataatgatgtcagttctctccaaattggcctacagatttaacacaattccaattcaatctctgcaggattttgtttatagctataaacaagccaactctaaaatttatatgggaagataaatgaactaaatgaaccaaaataatttttaaaagaagaataaagttggagaaatcatgctacctaattttaagatttactataaaactacaataatcaagacagtgcaatgttcgcaaaaaaattaaatcaatgaaacagaatagactgtccaaaattagacccacagacatattgccaacagttttcaacaaagatgccacaacagtttaatggagaaaggatagtcaacaaatggtgctttgacaattggacatccatatgcaaaacaagcacatgtttaaaaccttgttgatttttcaatatgcaaataaaattacacaatagttacaagcccaggaataataataggatacaatagtaataatagtatacaatgccatgtatacaataataatagtatcc

SEQ ID NO: 72980 - DNA, 1907 bp, Homo sapiens
atgaataataattctcttagatccttaaaagcttgtaggaacattttgaaaacctcaaactcaaatctttttgaaggggtataaatatattaatttaattaagctaaaacaaatgtgtgactctaaaataaacatgtgattaagtaagtgccatggactgattacagcaacagactgaatgttggttactactcataacaatatttagaaagccaattaattatggtctgtttcatttattattctaaacattagtttcttctctttttgaattaagctcttgttctcattacagtcattggtgcctaatagtaaatactattgtgtttgaatttctatattttatatgtggtagagatcaaaggtcatgttttccatctggtcaagattaaatttatttttcacgatagaactttacaaaggacttttactaatcatttaataattgtgcttgactgctacaaaaatgaatttgtatttgttttttaatcatgtaggccttctcttccagttacttctctggctatatatacatctttgtactcctagcttgtagcacaatgattggtgcaataagcaattaatatgtttgtttgtgctcacactcctatatactaaaatgtactggtaattgaaactatttgataacaaatggaatttttcttttaaactgtcacaaattatttgtttagatgtaactgaataaatatttattgaatgaggatatatagttattaagttagaaatgaacagaattatggatctaacatctcaagaataatcaaaatattcagctacattacacagtgaaatatctgaactttccctaaaccaaacattttccaggacatgtgtaactttatgtctccagtttaaagttcagctataagctgggcatggtggcacatgcctgtaatcccagctacttgggaggctgaggcacaagaattgcttgaacctgggaggtggaggttgcaggagctgagatcgagccactgccccccagcctgggcaacaaaacaagaccctgtctctaaaaaaaaataaaataaagctcagctattacagaaatgagacatatttagtaataaagttgtataattcagaattgaatgatagtttcatttggaaaattagaatagatgttatctgacattctcctttgatccctaagttcccttgatccattttggttgatattaaaaatgcatacttatatacatactcaaacatgagtctgtattcttatgttcaaacagacaagactaattgtcttaataatctatcattgttttaattttttgtcatatctctcttcttccctgcttggtaaataatgagacagcttatttaattgttcttatttagaccagctcatcttattaattacaagtggtttatacaaccaaacctaaatagaagtcattccaggggcaacagtaataacaagcaaatgtttgtcttttacagttccctttctgtttgatctttcaagctattcttcatttatatactctttattcagcacagatctgctcctaacttcagagcttggaaaatgcctttcatagaagtattgaaaaaagagaataggttctccataccctgcttacttaacacttgctggctgcaagcagcttccccatcactgacagagtaacctgatctccatctagtggccagatggacttactttttacatcatggaaattaacaggcctgctggcaatgaaaggcttatacactcttgtcttgtatggttcctgttgagcaagataggcgcctttaggtcagcagtgagggctgggcaaataacctgccatgccatccaccacaaaagatccccatgcctcctgattcctctgcatcatagcaaaggaactgtccatattgagataaacagtata

SEQ ID NO: 72981 - DNA, 1069 bp, Homo sapiens
aagaagttgttcaaaaattccttgctaaaataaaatcttaagtaaggaaagggaaactttgccatgcctaaaaataaagaccctccccttcccccactccccatgagattatttattacatctgtacaaagtttagaatttcagatttagggacattgaggtcatccagaggttacttttctcccagttaaatacaaacataataaaattgctcactcgcgtctcctccctgccccccttaaaggagtgccaaagccacagttacatgtactcatgtgtgacgcaaaattctatttttaaacccagacagaatctatcattagtcatttacagaaggaaaccattaacatctaaaaggatggagcaacagaactccttcatgttgccaattgcttataaactaattctaaatacagcagtggctggaaatacatgttttctgtcacttagaaagatacagtttttcagttcacttatgccatgttatgaatatgtaagtattagaccctaaaaaggtaggaaaatggaagacgatactaacttctttttctgcttgatcatatttgtttaatcaactgcttattcttatgcttactcatttttgggcatgaaacatttttaggacttcctttgcttacaaaggctaatattatcccaaattgcttaagtgctaagaattcattttaacgttgtacatatttattatacaagaaatattttttccatcaaaaagtactcattcaaaaaatatttaatctagaatagagattataaatttttaacttaattttatttttttcttaaggaaaactctaagatatcattaccattttcaaaactgtcaagtagtggtgaatgacacttcttatatgttaatttttaaaagaatatttctaacacacattcttaatggagaattatatcttatacagaatgatacattctaagggtgatgtttatgaaagaaatttaagcttggttaacatgcttagtaaaattttttaatacaaataaaattcagagtatatggtgtgaagtgagttatatggtgcaaatactattttaattc

SEQ ID NO: 72982 - DNA, 1889 bp, Homo sapiens
aagagtttctaggagttttgtatgtataaatttatgtggaaacccagaagtgtaaggaattcatttttcccagaaaggaatataggggagtggggagtaatgcaagggggagtgacatttgaattggcacttgggaataagaaggatttcaccaaggaggccagagcagaaaggaattctaggcagaggtaatggcctcctggaagcatgaaaatgcatagcatattcaggaatagcaactaatagtttgaggtggctgagactgaaaggaagggataagcacaaagccagaattattagtcagggctattccatgaaaggctccagtgaactttgttggacaactcaacttaatttttgccagaaattagatttaaaacatcaggaatgagtgaggcctgctaaaattggagttgttatttttcttctcaaagatggtagtaattgttgaatttttgagagttgttggaacagccctgaagggttccattattcccatgaaaattagtagttcttgtggtaaggaaatgttttcggaattgttgataataggtatgtcaacaacttccaattgcataatgcccctagaaagatccaaatcttttgcatgtgttttctttcatattccaaaaatagtattggcaaatgttcagagaaggcagaaatttgccagaacatactctttaaaacccagctcacctctttatggaagcaatcttagacaaatctgttgcatgtcattcagactatatagtacttggctttggtgtccatatgcatcatgttatgaattgtatgtgtgttttttaaaaaaagaaaaccttttttgttctttctgtaacttgctcaaatactataatttgacctgagtcataattatgatactcacctttcttttagtccaaacttttacttccagatccttattatcatttccacaagggattaagaaatgacaaacataggaactgaaatatttcactgttttaaaaaaacataaattcatgaatgacattgcagataaaaagtagtgctatttatgggccttaagttccttctccttccccatgaaatcaaatccacacatctttccagctaggactttaacaaagttaaacaatacaagtgacaaagtcttaaagccatggaaaatgccattattgttttaatcaaatcagatattaaaacttaagtctggtcagagttggatgacatagttcactaagggaatagagggccttttgctagctggttatttagagtttcccctaaattaatgttgattatgtttcaaattccaaagcttgctcatttaccgaaatataatacaatgcttcccctttcccctgactactaacttaccaagggagagaaagttagtaatggtcaaattttcccacagcttattcagaggtcttagtagtggaaaataaatgagggtcttgggtttacctcagtttggccagcctagagcctacagtaaaagtccggaaacaataataccccatgttaccaagggacaggatggagtcagtttgattgtgtaactccaggacaccctgtgttatgtgtctttcagtttagttattactgccaaatagcatcatgttatgtggttctgaaatagattctgtatagggtacctggaggtccttcccataccctgccaaccaaacagccagtgctatttttatatagagccagacaacatataatttccatgacttacttagaatgagttggcaagttcaaaccagattttatgaacatgcctggcattgtcagtaaaatctgaaagttgagcaaagttactttttctcaaatggatgaaggttttttatttttttaaagcatttatatgattgtttggtacggtttatgaaagaata

SEQ ID NO: 72983 - DNA, 1060 bp, Homo sapiens
tatgctttatatgggggttgaatttaattctgtgacatttgtcctatagagaaacaactgtatgtcatctatgaatcaagaaaagatgatcatccccacactcaagatggggatttggcctatagagaaacaagacaattgatgctatatgtgtgtgttgcatgtactaatgtcattttgtcagtattgtagggagagataggaggatttatgttaaaattgaaactcttgaattttaaatgttgttattggaaatatctttgtaacatatatattttaagagaattaggtccaaacatccaaccaaaggcatagattatctgctatacttcagtatagacaactataaatataaactttaaagcaaagtttgcctgttttttcctcaagtgaacttttatgtctgaactttcttttatttgggaataaacatactgctagcacattagcacttccaaattaaaaagtgtgtttcagaataatttatgaaatctgctatactgggaaaacatttgttttaaagaaagaaaaaaatgctatctttttcatgagatttccattttaagaaacttatacactattttatcttaaatttatatgtcgctctaactttccagttcttaagatgagaaaattgtcatttcatagatcaacaatgaaatgtaaatacttctaaatataattataacaacaacaatgttatgattatatttcataataatggtaataatgatggtagtacaataatattgatgatggtaatagaaacatttatagataactacgtaccagacatatttccaagcactttctttacataaatgtatataattctcccaacggacctatggcatatatataatattattgcatcttgtagatgaggaatttgaggcacagagaagttatgtaacttgctggaggttagaaagcaggggtacagctgggctatatgtaatattaattccaattctaaggatgatataaacagattgatatgtagattgcagggaatttctagatcagagtagttatttagatactgaaaattatcaatagt

SEQ ID NO: 72984 - DNA, 2048 bp, Homo sapiens
gatgggctttctatgctttgatgagcaaccagtggctctttaaacaaccattccattttttcctgtgacatcgtaatggatttgttgcatactgaatgtgaatcttttctctcctttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacaggtaggtatggcacacacctgtacctaagagccatcactctcttttttattttttcagactgtacagtttgtaccagagtttttaatttccataaatacaataatgagtcagattacatgatttgaaatgtgtataatctaagttataaatatggtaggccaatgaacattattatctgttcagcttttgaattaactttggcaaagtctgtaatcattaccaaggagttaggaaatttggtgggaggctgttagagggcaggtgaagcaagagagtgagtcagtggggaaaccttcctgttctgttctttggctttttacaacaagcatgtggtatgcaggtaaaaaatattttcattttgaagcaaatcacatggagacaacagtaaacagagtaggaactaaccgtactgattaaatacctgtaaataccgcaaggaagtttcacaagatagagtaggcaggagaatgaaatttcctgcgaccatgtacaatgtgtactccaccttagtaaagaaaacaaacaaataaaaaataatataaatcttacttacagaacaaataagggtctccaagctaacagtcacaacccaacaactcttgacctctgccttatccccaaccctccaagaaaaccctagaaagaaaagtagaaaggtggggcagggagaatacacacaggggaagatgttgatccaaggatacaaagttccagttagacaggagaaataagtttttgagatctattgcacagcctggtaactatagttaatatcaatgtaatgtatattttgaaattgctgagaaagtagattttaagtaatggttgtaccataaataaaggtgtgttaaatgatagatatattaattagtgtgatttaaccattctgtaaggcatacatacattggaatatcacattgtaccccataaatatatacagttattatttgtcaattaaaaatatatggaaagaaatcaagattaaaaataacagctttgttctgcctataaaaccgtaagtccaattcagccagctcagaacccatcacctaaagaaaatcaaagcagacccaggaaaggactcagaggacatgagcagtgtaaattcagttgtagtcatacttgttttcttgccctctactgctccctgtttctctgttgtttgcactttttatgttctttccttcttttcttgttgctttatcttttcttcttcatttattcatagactgacttttctgaaaacttcagtatagatatttaacacgctcctttacataactagcatttttaaactgttcgatctggtactcatattaaaggcaggagatttcagaaagcagtggcaatcactgacaccaggatctaggcactgctctaacatttgagaggaggaactctttcccctcaaattctggcatttatttaaaaaggaaaatattgttaagtcatctgagcaaacactgaaagggaaaaatgtctacattcctactacctgcttatttgacaaggccagtaaatttctgctgtagttcatttgatcattattgtcctatccatttcataaatctttataatgttgtatattttatcacatgcataataagggaatttttttttaatacagaaatttccgactgaaggtctctccagtgtagttcgaaatgtgtttgactttgattcctacaacaatgacatgagggagatattgattaacacttta

SEQ ID NO: 72985 - DNA, 1145 bp, Homo sapiens
ttaagagttttctctagctttcatctttcttttcatgatgtcaccatcaacccagtcaccttaaacctaagacttatttttcctttttcctcttcccacctaagcagttgccaagactatagattctgtccctacaaaaccttcaaatcaatctaatgccttttatttccattttttcatacctccctcaaatcagattcccaaaccactttttggccaaactattccgcatattgtcaccagattaaatgtcctgaagtgtagctccaagctccacttctgtcatgtgtgaactcataaccattaaattgcatcccattacttaatgaggcagtacctatttcttggtctgacagttaaacccttagtggtagacacccagtctacccttccagtcacttttctcacatttaacttctaattcagccagcatagactgttcatagtcactcatttctagatatgccccaggatttcttgagtttgaccattgattctctttgtcttgagtaactaccttttctccactatccatttgggtctattaaaattgtatactcttttaagagctttaacaaattcagtgttctaatatccacagtgattgtgatgtctcactcctcataactcccatggcactttctctatttgttatgcttgttttacatctctcctactcttgggtgtgagatgttgttgggtatcactaccatgggaataattttaatactaaaatgaaataaaaagataactgtagagttggcagtttagctacatgaagcttttggtagaaatcccaaaattttgtttccagctctgctatagatgtgtgtgtgtgtgtgtgtgtgtgtgtgtgtgtgtgtgtgtgtgtctacgtgtatacttgtaacttaaataaagccagctgttataagtccaaagcagtaagtaatgaagttttaataatggctgtcttcatttaattgtttatgataaattttctgtcgtcaaaggttaaagcagtaaagttgggtcatattctggtagtagatgaggctgacaaagctccaacaaatgtcacgtgtattttaaaaactctagtagaaaatggagaaatgattctagcagatggaagacgcattgttgcaagtgagtattttagaaag

SEQ ID NO: 72986 - DNA, 1022 bp, Homo sapiens
acttgaaaaatatcttttgacagcatttacttctctcagtcaatgatgttaggcttatgtcttactggtaaaaattgccatttaattctcttttcataattaaacttctgtttgaaatgttgagcagctgggcatggtggctcacgcctttaatcccagcattttgggaggctgaggtgggtggatcacctgaggtcgggagttcaagaccagcctggcctggtagagatggtgaatacaaaaatcagccaagtgtggtggtgcatgcctctaatcccacctcttctggaggctgaggcaggagaatcacttgaacctgggaagcggaggttgcagcgagccaagatcatgccattgcgctccagcataggtgacaaagcgagactctgtcaaaaaaaaaaaaaaaaaaagaaaagaaaaaatatcgagcaaacattttttcagtgctgtctttgttccatattctgtctttcctttctcatgtttggctcgtattattgcgtggaccattcctataggcatttctgttttaatgaactataaagacagagaagattttcatcagctcttatgaaactcttatgtgtcttctttcttcctttactcttatgtttaactattattgtttttcttaaaaaatctaactataaatcagttaagatacaacttattaaaatatcatccttaaagtaaacatcgctattttgagatcttctgctcctcaataaattagaagatactaacttaatgtacctttataagcaatatttcagaacagattgtgcttgctctctagaggccagttttctttccttattttgataaaaacttggtctttacacaatttaattgcttttattacatgtggaataattttaaattactattgaaatataactctaatttttaaaaagactttaaagtgccaaagttaagaatagagtttagtacaatatttctttgagcagcgcctttattgacacaggctttagttgatagatgctgtagtctgtaagatagta

SEQ ID NO: 72987 - DNA, 1023 bp, Homo sapiens
aacagaatgacagacaaggtcactgctatcatgaagctttctttctagtggtgagaagataggcaatgaacaaataatttaataaacaggaaaatattgatgctattaataaagtgaaaatgatataaatatttttaaagggtaatgtgataaggaataaatgggagactacttgaggagaactcaaacgctgatatgtttggcagcaattattaatttcataattgtagtttatttgtggtgagacattctggcatttcagcaactttgtctattctggagagttggtggatgaattgacccaatgcagatttgatctgtaagcgaagtaatagccaacctttcacattacagcaattagagggttgtaagaatttggtcaagtgacagtttggaataggactacagccaacagctaatgggaccaagccaagttaaggtctctcactaggggaatagaatcattcgtgacagcatgcttgtagcagtgagaaccagtccattgctcatcttttcttgcctgaactattgcagtagcctcctggttaagaactcagcctctgatctctcctttccatgccttacatgtttctactaataaagttgattacttgctcttctgctcagaaccctgcaatgactcccgttgccactatctgtttcacttgtcttccaccaacctttctctcccacgtatgcttaagccatatgagctgcctgtggttcccaggtatcacataccatatctattactccccaacttgttctgtgcagctcttgctgcctggaattccctgtcaagtctacctggaaaactcatactttatcttcaaaatgaaaatcaaagtgttttcctctaagaaaatatcttagatcctttcctcttcttctccacaagcagatgttgattcctttctttgtgccaccataagcataaagtggggtgcaaaagagcctttctatgtttgataaatgagattgaaaaatgcatgttgaactacagggaatgcagtcagtattgca

SEQ ID NO: 72988 - DNA, 1008 bp, Homo sapiens
cacagtgtctggcacctttagatacctaaacatttaggcaacataataagtgttagcttcttgccgtataccctactttcttatcaaacattggtttgcactgtagtagtttctatgtcttatttccatcccctcctctttgcccagtcatgcctctccaactaaatagggaactttttgagggcaagaacctggtttattcactgtatgttaattcattcgcctaatatctattcattttgtttggcagtgtctgttttaggcactggatgacgtatagatgatgatatccatcttgacctagtacagcttgcttgtcagtggtgaaaatgcatcaacatttatggtacagttattgtatataagctatgatagagcatgtgcaggtgtcgtgggagccttgaggagggacactgaactctcagaatacatgtctgtgatatggtagaaggtgatgtggagaaggtagcactcaaactgagtcttaaggggtaagtaggagttttctaagtggagcacagagaaagcagcattatggttattgaaaacaggcaggacttgaatcacagaaaacactaggaggtgatccagatcatactgttggtgctgagcaaacatattgacaatgagagtggaaagaaggaacatattgaaataggtttacagggctaattttagcctttataactatgtggagggtggggggaaaagagaagttaacagtaactcctgtgtgtgatctaccaatcatgaggcaggtacttggtgtggttcttaattcacagtggatgtccagtaagtatttgtttaaatgacttgatatgtgctaatttcatctgaaacttccaggtcaagctcccctgtggtcagtcatgcttaccgaggagcactgacgcttgttttagaattaaggttaattctatgtatataatagatctttaactgttatgtaagtgttctaaccaactgaggtcattaaaatattgcattttggatggttattgttaa

SEQ ID NO: 72989 - DNA, 1481 bp, Homo sapiens
ttacagttccatgtggctggagaggcctcacaatcatggcagaaggcaaacagcatgtctcacatggtggcagacaagagaagagagcttgtgcagggaaactcccctttttaaaaccatcagatctcttgagacttactatcacgagaatagcacaggaaagacctgccaccatgattcaattagctcccactgggtccctcccgcaacatgtgggagttcaagatgagatttggatgggttcacagccaaacagtatcggtacctacaaaaattcaaaataaaaaaaaatacatacactgaagattttttactgactagactgacactcctactaatttcagtgtggggaattttttatttattatatacagttttagggctacatttgccataacattttacatacagctttagggctacatttgctataacattttagctcataaaattgccttaagagaaacatatgtctaaaagacctaaaaaaggcagtctataaagaatgtttaagacttctctaatctatggataatccacttaagatctttactttgtttattttagattcctttcaatggatttgtgatgttaccatctaaataatcagtcacacttagtttatgaatgtcatttgaacaaattagttataagggccattcaaaacatagtattgataagtaaaactgtcagcaaacatacacaaaacacaaccagtgtacttttaaatatggccatgttatgttttgatgatcagatttcataatgccagcaagctgggcaattcatggatttagttaaaatcaagatgtctggagagaatgatatatgtaatttaaaagattaatgaaagtaattacttttgaaagtatacatttaaaacagaagagaatatatggctcccatttgtgaagtgaatctatttacttgtttttctatgatgttatgttaatttgacattaagaggacacttgaatatgttaacttctgtagctgtatttcctccttggttaaaaatacatgtctaaaattaaaattttagacaagattaaagtcagacttattttagggctctgaaatacttatactgccagagttttttttcatttgctatccttcataattgaagaggacagcacaggtccaatcattaacatgacctatgctcttggttatttttctaatagtggtgtttagattgggagttcccaggtctcccagggtagccccaactttctctttcagtgagattttctgcagatattctcaatttactccagactattcagtgtcctactcacaagttttgaatttgtatgcatgccttctttattcctccatctaaaatgtagctcctttctcccccaacccttcaaggtttggtccactgttacttctacataaaaccttttgtgatttttcttcattctgggtgtaactgttccctcctctgacactccacagaattgaatttgtaccat

SEQ ID NO: 72990 - DNA, 1757 bp, Homo sapiens
tatatttacctttctgtaactgaaaatcataattctgaagaactgattagaaaaaccattgttttatacttacttgatcacctttgatgacattcttcaaatctgaaatagttaatactataggcatctgctgtgatgcctagacttcagtgtaaatttacagaacagaaaagtcaatatgtaggaggctaatttatggatttcctttcaaataagaatggcttagaactagtacgtttagaaataaattttttaaacccttatgtcataggagatattccatatatgtttgccagtttggttttcatgaacaataaactaaaacagtaacaaggtgagaaagcaggttttggtaaaagattcttctgatttggcataagcttatctccagaaaatagcctctttttgtttaatgttttctgtgtaattacagggtgtaggaaaaaacaagattgttgacagattccttcacctgctcaacagaccccgagaatatattcagctacacaggtaagactattagacccacaacctcttaaaaatctcatttaatcatttgtttccctcctggtacaatttaaaaatactttcttagaggcccattttataaaccagttttatttctgttcttcttgctcttatctcttctctcctttaaaggtaataaaaccatgcaaaatttatttttaaagtggctaatgctttataaacatgaattaatagatattctgtggacagagagtgatgaacattacattctaggaacagatctcatcaacataaaggctcttaagttagaagaaaaacatgtaggatctaagcctattctctcacaagcagctaaaatagctcacaaggagaaataataaactatatgaatctcaggtatgagataaggaacccagaaatctggtagaagcatgttattatttgtctccttgccttccttaaagttactttttagataattttgtatggttagaatgctggttcagcttttaatcaaatagtttttctcaatatgggtcatttttagctttatgagtgaacccgttctaatttttagaaaataaaatataaatgatagatccaccaaaaacaaaatagataagtcaagaaatatatcaagtaatgaacaacttaaagctaacttagattgttattgttttaatcctaggaagtaaaaaatatatagtataatagagcattgaattgagttataagagttagtttctggtctgggtcttttcactaagtgatcagttcttgagagagaattataagagaataaagggcagagttagtgggtcaaaggagaaagaggaaaggactcagggaaagctgagatatggtgaaaaactgccttttgggatttatacctctgcccatgacagggtagtggtaccagattagccctaccacaataaaaactataaaactgaacaaaattcacaaacactaggaaaagaaaaactactagggatctttgagctgaacaactaccagagttccttcattaaataaccctggtattcagaagggtatttatcttataaagtctatgtttagaagtaggactaatctatccctaaagtaagagttactccatacctatctttacaaattttaaaactaagccctgataaagaaggatgcttgctatttaatattattttggaagttttgtctcatacaaaatggctttaaaaataaaaataatgggtatttggggagggagggaggaataccttgaaaaa

SEQ ID NO: 72991 - DNA, 1008 bp, Homo sapiens
ctttgacattctcccctcatccattctgaaccctttgttaatttcatagagtcctcttttctaggcccttgagttctcagggccactttactgcccttatcaccctctgtgacatttcatactgacctgccttgccctcccaaaggtccagttgcttcaaaagtgcttctgtcctgtggttttcagtgataatcactgtcttctaatgctgctgatctaagttaggaattaggccagtaataatctcatttactaaatatatgctaatatgtaggtcccatcacctttctctgctgggttttttgttttcattttgaagaggctgatttttaaataacagttgttgccattcgttgagcacccatatgtgtgtgacatgtgctaagcactttagaatcattttctaatttaaccttcataacaaccttaaaggtgagggcattactattgccattttaaagttgagggaactgagccttggaaaggttaagtaatttgccaaggtaacacagctaataaataggataccgacttatctgattcaaaagcctataaactttaccattatgttatgctgcctgccaaaagaatttcaacaaatatttattgagtactgaccatgtcctgagttctgtactagcaactctattcgtggaattttgggaaatgtaatatagcaaagtgaaagtattctgacagcataggggaaggattcaaaacagcaagctgcagcacaagtgacaaattggttgacacctctgtggccaacagcctaaattgtttacaactctttttggctattttagaaaccaccgatttgcttaaagctttaaacatttccgtggtatcttaacaccttggctttgtgtaaggagaaaaagtgaacagtcaatcatacagcctaagtccagtgtgacctttgttatgtaacatccttcccccattgcccctcccatctccaacttagcacaattaaaatacattaattaaatttaattgataaatact

SEQ ID NO: 72992 - DNA, 1031 bp, Homo sapiens
gtggtgtctttgtttttccttgaacttactagtgcctgcctcagggcctttgccacttggtgttttcctctacctagattattcttccctggatagctgcatgtttactcactttcctttttgggatttgctcaggtggtcaccttttctgtgaggccttcctgaagctctctagagtcaaatttctattccattttatttctatccctctttctgctttaagattctttatagggcttcttactctttgacataatgtatgttttactcactaattttttgttgtctatcttccttctctcggatttcagttccaggattgcaggggttttttctttgttccctgtagtctccccagcatctggaactttgcacagtagctattcctgatttgcacagtgttcctactgtgcaaagttgcaaatgttggcaatactacagagaacaaagttagagattagtaatgtattccacaagtatctgttaaataaatggatggatgaatcttccatattgtccctggaatgatctttcccaaatccatttcctaagttcttccccttgtttaaaaccgttaagggattgactctctttgcctgtagactgaagacagcctgctaaacatgcctgctgagttccctctgaccctaagctgctcatcaggcctcagtttctacaaactctcttgaagcatcctcagctcttcccacacttagcttcttgctattttctaataccgcttatactcaaatgtctctgccttagataatgcctagaatgtgctttccctacatccagttgtcccttagtttctctcttctcttaagtctctctcagcccccttaggcagcagtaactaatatctccaatctgctttcatgacacttgacatatatttgcaagttgtattatatattgttgacctattgcagttgtattataatttacttttatttccccagttgctatttgagctccttgagactaagtcccatttcccagcctgcggcctggcacataatagacactta

SEQ ID NO: 72993 - DNA, 1055 bp, Homo sapiens
gctctgcttctggtcattatatagagctcatattttctagagttttatataaacggaatcacacagtgtgtgctcttttttgtctggcttctttcacatagcttaagtgttttgagatcatccatgttgttacgtacattgatagtttgttcctttttactggtgagaagcatcagaaagtactttataaaaactcacacttatgcccacagacaaacatagtgacttcaatatttttattttaaaaattgttttaaatgatctttttgctctctaaatctgtaatctttaggaaataatatctttttgtctgaaattaagccgtatctgtagtttcatttatttttttcttgttgctaaaattttagtaaaattaaacctaaccttaattttaaattttaatggcacttatctcataattttttcattatctatcacttctttggtctttgtattacccaccagtttatcagatcaccttaagtacacagcagatcctctgctctctaactttctggcttgtggaacctagctagcatcatcaggaaatgacttcccatgtaacctatttgtatgtaaggaagcctttagggagaacctagcaaacaaaaaggcccttctcatcctgttattcagtagttcggtgactgtttttataatcattatacatttctctgcctaacatatcagctgtcttagaaactgccttcttcaaatttggccagcttacttaagaacgctgctggagtcaatactaaaaagcaaactattgacaatatatgggccagtaaattatcatcacctttaaatgtaaaccatttagcatgctctcattttagttgttcttttagttctaattttacagctccactgtggtacctggcttcctgatctactggtttaaggatataaattagacttccccttttggcttgcctgttgtattttgactttgtttattccctgatttggtatccttcactatcttaagtgagaaactacatctgcagctttaattttgggtagccaaaccaggctctttctctcctaccttt

SEQ ID NO: 72994 - DNA, 1043 bp, Homo sapiens
ttctttttttctttttttatctttttttgagatagggtcttgttctagcaaccagactggagtgcagtggcacaatctcggctcactgcagccttgaactcctgagctcaaaccatcctcccgccttagcctcccgagtagctgagactacagttgcgcatcgccacacccgttttgttttgtttttcccatttttttttggagcagtctcactgtgttgctgaggcatgtcttaaactgctggcctcaagggatcctcctgccttggcctcccaaagtgctggcaatataggtgtgagccaccactcctggcccttctgtcagtttcatgtttctcccatggtatattctgatgaactctaatctgggcttgtggctctttattcttgtagctcctacatcatcttagatctctccactcccacttactcagtttcctctggtcttttttcttgtaccttttattatttagatgtatgttgagcctcctgggctgaacttctaattttattttattttctctattatgttctgtcaggatcttggtctgtccttaacttttcagaggtgagatgtcctaacaatgattcttctttgttgtctgaatatttctaacagttgaaagcctaatccctttccttatctgtaatttttctttttacctgagaaccacaccattttcttaattttgttgttaaacacagtcatgttacagaatctgcttcactctgatagtatggattgttggtaaatttttttacctttacttagccttaatttaatgttgtaacttatttttgtctttctgaaaataaatatgttcttttttagggttataataggttagattcttctcttaagctgcttggcagtacttctttcaggactgtgtttattgagtagaagactgacagcttgactaaaaagacacagcacagtgtaaaagcagcaaatttgtactgaatgaggaaattactttatttcatgagttgttcttataagtaatatgacccattatctagcatgtgttgatcctatatgct

SEQ ID NO: 72995 - DNA, 1058 bp, Homo sapiens
tggctctttctaatatgatggtatacagagtttaggtgataaaatttaactgagctagtcttctaagaaatatcaagtatttcccatgttctatccctccgaagattgaaaagaggaagaacatttctggtctatagctttggttggcatttatagcggtgagctatattgatctgctgctgcatattgtgtagcaaaaaataatcattcattttactttagcaaatgtaagcgagtctccaactactagattgtaaaagaagagccctatgtactagttgtctttttcatcatctctgttagtataaatgtttacttacttgaataaggtaagtactgtacacatcctgtgaattaataagataaaaaatactttggaatcataaccaaatgaaatagtgcttttttatatcatgcacagaatggtgattcagatatgttggtataagaatgaggaattctttctattgaaattaaaaaaaaaatgttaccagtttttagcttcagctttttaggagtctgagcctcttatgtctgctgaagtcacgacattcctcatcttttcctgggcccaagcaaaagactcctaaccttaattgggccaggatatcagctgttttcagtctgaagctgtgattttcaaaattaacatccatcagtttctttgaaagtatgatattagttgaatgccttcatcctgccatctcctctctgaattccaataggaatgcttaaaatagacaaagcctactctttttttctcttatttttaactttacttttaatttatgttattttgttgtgcattttgtatatcttttgcaatctcacatcatattagaacaaggaagggtatagataagtgaattttaatttaatatctttttaagcagtgtttcccacgtgggaggcatatcagaatcatctatgtaatgtttaataaaaaacagatggtaggccccatgttggccctgatgaatcagaatcttcaggatagtggagcttaagtttatatatgtttcaaaagttccccacctgtttctgataatgtatcttta

SEQ ID NO: 72996 - DNA, 1087 bp, Homo sapiens
gcctcccaaagtatcctgcctttgagtatgctatcttgttatgtaaaagaattagtttaagagtctgagaacagattttctcctatatttctagagagtgacaataaactcaccaaaacattattttattttaatgtttttcagtttcctgttcagtttattaatgcatggatgaataagggtgggaagatactacagttaaagttaatggcaggactttctatttcctgatacacttttgagttacaaactcagtgtcttctagtttctgtcacagaataaggtcatttagtcatgtcttatcagtcctctctctgaaaaatacagatgatgataattgaaaggcacataagtttcccgtaaaaacatttacccatcctttgtacatatcctgtcaaccttttagatgtcctgcaaagattgggaaacagtagagataagcaaactaagcacattttctgaaaactccttttcttttttcccattttgcttctctgctcattaatttttagagaaaatttttagagaaaagagtttcctagaagtatagactttggaaagggatagagaaatataataactgtaatatgttttggaggtgaatttgtttcttttgctatatagcttctttccatgtaaataatcagttgctttttattatagaaaccaagcccctgagatcaaatataagactcctctgtgggacacaggaattaataaacttaaagaatgaatttggtttgtataataatatagtgcacattgatgaaaaagttccagaggtttgatgcaacatagagaatttagtgggaaaaagtagatacaccatctgttttcctagaagatgtggagacttccctgttatttgtacatgtataaagctacacttaatctgtggtttttgccttatttttagacttgattatttttaggactgcatttcatatgaagtaaaaggaaaacagagctttaacacagatttgaggcagtacgtaaagtaagttttataataggctataaaagtcataaatcatttggctcaagtgttaggtcagattcttttaactgattattctttttttagggt

SEQ ID NO: 72997 - DNA, 1014 bp, Homo sapiens
tcttggctcactgcaacctccgcctcctgggttcaagcgattctcctacctcagccccctgagtagttgggatcacagttgcgcaccaccatgcccagctaatttttttgtatttttgtagagatggggtttcaccatattggccaggctggtctcgaactactaacctcaagtgatctgcctgccttggcctcccaaagtgttgggattataggcgtgagccaccacatctggccatgttatattgacctctctttaattataggtgccagccgggaccaggctattaagtcaaccttgtgcgtcagaccgtttcatacagactttgagccataagcagctacaggctgaaatgatgcagtctcacatggttaaagatatatgtttaattggaggaaaggtaagaatgacagtctcactgcagacttttagtttcctggcttttggttattttgacttacctcttgaataattttttccatttgtagggttgtggaaaaacagtgatcgctaagaactttgccgataccttaggatacaacatagaacctattatgctctatcaggtacagtgttcatttttagctgcacttggactataagcatatatgcttaggccatcagcagaatttatggatatcttcttgttatgacctgtgtttttttatataggtaaagaaccaaaatagtaataaaattattcaaattaaagtgcaattataattctttggagcttttgaaagtacattctaggatatctgatgtgcacaacataccaggggctgtttttcaaagatatttattttccagaggcctggaagggtagggggaaaggaggagtgaagagaggttgattaatagttataaaaatacaggtaggtgggagaaataagacctactgtttgataaataagtagaatgactatagtagacaataatctattgtatattttaaaatagctagtagttaataattcaaatgttccagcataaagaaaagataaatgtataagg

SEQ ID NO: 72998 - DNA, 2985 bp, Homo sapiens
tgtatcaagttagattgacactactctagctgtgggaaaacatacatttaagctcatttatttgttttcctagaatttaatgaatcttcgttctaaattttttttctttttttttttttttttgagacggagtcttgctctgtcaccaagcagagtgcagtgtcacgtcttggctcactgcaacctcctcttcctgggttcaagcgattctcctgacccagcctcccgagtagctgggattacaggcacatgccaccacgcccagctaatttttgtatttttagtagagacggggtttcaccatgttggccaggctggtcttgaactcctgacctcaagtgatccacccatctctgcctcccaaagtgctgggattataggcattagcctttgcgcccagccatttgttctacattctaatgaatttaattacttgggtaggtcttgctcctttcctgttgagttctccttaaaatacagtggaactttttttttttcatgaaattaaggtgtcaatagttgttatttgtctacaacatggaagcaattcttgtcaaattatgtgatactgtggggatttgcatatataaattgtatgaaatatagaactttttaatggcagtataaattcacaggtttttttttaggtttggggaaaggagttagtgattgtcttgagtacttatgacatcaaaatgaagacttgaactgggatgttaagtttagaatgttgaggttaaacatgattttcttcctcccaaatctattttctggagttctttcattctgctgaatacatgatgatctgttctttcattgagtttcaactctttcactatagtaataatgttccaaaactagtgtaggattttgggggttaatttctgcctatttaatagtaaaaataaattcagttttttatattgagcatgctgttataaataaggcatagaacttaattttcaatttattttcatctttcacatacttacctgtattctttctgtgtagttttgatatagctagctggaatgaagtggtgtagtcaatgttagaacgttgataattgggccacatcaagaatcaatggttctagcctttttttttttttttttttttttttttttgagacaaagttttcgctctgttgcccaggctggagtgcagtggcacaatctcagttcactgcaacctctgtctctgggttcaagggattctcgtgcctcagcctcccaagtagctgggactacaggtgcgtgccaccatgcccagctaatttttgtatttttagtagacagggtttcaccatgttggccaggctcgtgtcgaactcctgacctcaggtgatccgcttgccttggcgtcccaaagtgctgggattacaggcatgagctactgtgcctggtggttctagccttttaaatccagttcaacaaatattgagacccctatagtgtagaaagcactgtaccatatgctgtggaaaattgttataataattttagttaagctattcacatagctgacagcagaatgatggccaagaagttctgttttcatgaatttcaggtaacacattaacttcgattgatttaaagaataaaccaatatgggcctatttcagcatattttgaagggtctcatcatctccttctaggaagttgattgtcaagaaatgtaaactatgaacttctaccaggtcaggaattcagtgattccatttcttgtcatttagtaaattttagggactattttaatatgatctttaataattattgtaagtagaatggtattagtaggaatagaaaaaaattttcgttaactttttttaacctctactttttttttttcctttttttttttttttttttgagacggagtcttgccgttttgcccatgctggagtgcagtggcgcgatctcggctcactgcaagctccacctcccgggttcacgccattctcttgcctcagcctcccgagtagctggtactacaggtgcccgccaccacgcccagctaattttttttctattttttagtagagacggggtttcaccgtgttagccaggatggtctcgatctcctgaccctctgatccgcccgccttggcctcccaaagttctgggattaacaggcctgagccaccgcccttggcctaacctctacttttatataataatataaaatggatttcacttgtaattaaggtgtaatctgtcagatagccaatgttaatgctaaaatgaaaagtaaattgcatgattttcttgtaattttacagcgctttgaacttcaagattcaggaagctctctacttcctaaagagattgtaaaagtagagaagatgatggaaaaccatgtgtcccaagcttctgtgaccatccggattgcagataaagaggtgaccattaaggtaattaatcacaggtttattctttctatgatataccttattctgcctgtttttatgacctaaattgggtttatgatctccttgtaagtcttctctcttgatagtactgcttctgtcggtatctatatgtctatgtctccagagtcatgtgtgcttataaactggaaaagttcaggagaaacatagggaaagcctttcatcaaaaattcaaagttgacctgtgggaaaatcaagtcacaggctgattactgacagcattttgtgctatgagtccttggtaagaaatagtgttttcaaacatttgagctgctacagagacctattttcaagtaaaatctttcttagctatgtgaaacggtttaaaaaggatctgctctggttgaattgtttttagagagggaaataatatttggtcatagagctccatctgcatgtatatatgttatatatatatcagctccttctatatatatctatatgtgtatatatacacacattttatggagtcttactatattgcccaggcttgttttgaattcctgagctcaaacaatactcctgccttagcctcc

SEQ ID NO: 72999 - DNA, 1113 bp, Homo sapiens
tacaagtcaagatttcaggagagagatctgtactggagagagaaaatcggggtcatgatggtttgtaaagtcatgcaagtgatgagcttatttaaaaagtgaatgtagatagaaaataaaaagttccactcctgaagtaccttactgtgtactggtcaagaagatgaagaagaaactgcaaaaaagactgagaaggaaacagcaaaataggaagaaaactaatttatttaatttggtaaataggatattattgatggacctaccaagatcagtgttagtagagtggtgggaatgtaagccaaaaatcaaggggcttacattttaaattggagatgaagctgaacccccagtgattataattcatatgtatcaatgaagtttgatggtgaacaaaagccaaaagatgatagatcacttaaggatgaggtataatgaagaaatgactgtttctggaatggggagacaaacatttttataggcagaagggacaaaaaatgtggagtgcatggaaaatgtgccctagctgaggtggaaaaggacattttcagagcacccttgtgtcttgttttgaaatgatggaagaacatgctttccactcaggaactggaatgatgaagctgccataatatgacatagtaagtcttctaggggtttctgtctactcatagttaaagcagaagtcctttctactgaaacagtgggaacaataacaagaattgattaaaacatcaatgattttgaggatgaaggaaaaataattttgtttgttcatttaacaaaccattgttgaccattgaccgtcccatgtgtgattctaggttctggaaatttggagtgagccaaatagatacatttaatattgccctaatggggcttacattctagtaaagtatggaggagtatgtgtctgaaagctctgttctgagtggaggaggcagctagattgcctcttgaaagggtggtaaatgggctcagatttacttctgaggagagcagtaatggtttgtatttgttgctgaggggctatgagaaaagagcccaggagagattgtggcaacatatttgttcaggcaacatggtatgcagaatttcactttcagtacttaacaatct

SEQ ID NO: 73000 - DNA, 1728 bp, Homo sapiens
gacaatatagttcacttcaaggtttattccaggtgctggggaaaaagagaaccggaacttatctttgatttaatcaacacctaagctaaattggccattggtcatcgaagtagagtacctagtgtttaagatcaaaggtcgtgactccagatgaactttaatgcccctcagcccaatgtgcagtgccttgggaacaagggcacatcctcagggaggaagaaactcatgagaagttctgataaaatgaagcaatgtaatgttttttgtgaaaaaaactgagagaagatattcagtgtctaataaagtcagttatgaacaaaggtctttatctttaccaagaaaccactttgatgtattttttggtctgtaatttcaaaactagtcatacaaatttattataaagttatagaatatctttaaagagttgaattttcttaataaagtagctagtgttgcttcattttttggtctttattttaaccataattaaggggaacgtagaaaaatgattgcgtttatattggaacagaaatgatttcaaatttgaatgtagagtgttttaaaaaggaaaaagggattggtattagataagaggagaaagtatggctgtcttctcaccttaattatgtgaagagctagttaatggacagttgtaactcagtaaactgtcaagtgggagggcttaagttcatttgtctgatcttaatgaagtactttctttttgtaagatcattacacaatgatgtatacaaccagattagcatcttaaatagcttttcttaagagtggaagagtcaaaaaaaaaaaagagtggaagagtatttattgatataattctttatcatctgttctgggaagtctatgtggtctgtttgttattgtaagtttctacatttacctcaaagcattattttaagctaatatttataggtgggtgaaatatatgtgctcaaatagttttgaattagaagaggtaaaaattaataaaatattgttgaatttggaaaaaaatgtttacttaagaaatagaagtatgtattataatggtaaattaagaaggtatgtatatatacacattaacttttccttgataaatgataattattttttctcctagattatcatagaaattaatgtatagttgcattcaaattagaaatccatttaaattttagtgtaattacttaattagactatttttaaggaaaaattattagtcactgaaaattcaatcagatagaattcacaatacctttcttttttctgaacaagctataaaagtggctggaatgactttcattccccagatggtgctcatcatgtgatgttcatactctaaaaacatgtttctgtagtcatgaaatactttctagcttttagttaaggatgtcttaaagaaaaccctctcattctgaatctgctatactttgagaatagtatgctttcttacagtttagtaacaaatacatccaggcttctagtaacgtgtcttggctcttggtctcagttaagactgcatcataacagtggttaaattggtaagttctcttggtgatttagaaaggatatactgccacttatccattgataatgtaatctgagccatagtttttttctaagaaacttggatcttacatttagtatttttatttagttcaacaaacactaattgagcattcattttttggcaaattatatgcatatagaaaggtagtgatacagaaatgg

SEQ ID NO: 73001 - DNA, 2258 bp, Homo sapiens
tggccaccaccccgtctgggaggtgtacccaacagctcattgagaacgggccatgatgacaatggcggttttgtggaacagaaggggggaaaggtggggaaaagattgagaaatcggatggttgccgtgtctgtgtagaaagaggtagacatgggagacttttcattttgttctgtactaagaaaaattcttatcctgttgatctgtgaccttacccccccccccccccccccggcaaaaaaaaactatgatgttctagtagcagtgatcataccaagtacctggacattggtttctaaataccatgctctctaaaaggattaggtcagggaatgcagaagatgagcctggaccatctttttgtgccagagagtaaggaaatattcaacaaatgatgtcgatatgtcaaaatgatggagttcccaggttgaagtggctgaaatctgggacaatttgagcataaaaataaatgatgatggtaattggttttaacctgttacataaaataggaatccatgagtccatactgatagaaatgaacaaaaaatatggagatgggagttctcttttaaagtgtaaaatgcctacttgtgaatctagaaggaattacataaatagaaaaaacaccatttggcaaccatcagagtggcagttaatttagacaggagtcatcaaaggatgttaaagctggcaggtggagcctctatgagacacagggtattgacataatctctgaatatctccctccaaaagactcagttgactacaaaacaagaaagtggtatttttacagtaaacttcaacttgaccaggtgggacaaattgacattgtatgcctcccaaattccccatttctggggaatttttgctgagagttcatgatgtatgtttggccatgaggaaatattgtagatttctaggttgagggtcattgtatagaacataggcctctattctttaaaactgttcagacatgaaagacagggaaaaacatagaaatgttccaggctaaaggagactgaagagattggatagctaaatgcatcatatgttcctgaattaaatcctggaccattagaagcaagtgacaatattggcactgttggtaaaacttgagtagggtctgtggattggataatagtgttatattaagtggatttcctcatttggaggcttatgtggtgattatactggccacagttcttgttttcaggaaataccaactggagtgtttaggggtataggggcatcatatctgcagcttactctcaaattgttcagataaagataactgataaaataggcagggggagtaggagggagggggaaatgtgctaaaaaaatgttaaccattgaggaaactgggtgaaggttattaacttgaaaagcaagtattttatataaaactatggaaattgctatagagctttcatttaaactaatgaaggtctcattttttgtcataagtggtttataatacgtggggcatggttttcttttaaaatatgtgtggcataatttcctcattgtatagttaacagtggtgttttccaaaaggccagtcacactctaaaatgtcttataactatatgtttaaagtgttgacccttggcagagacttattggctcaccaaaattaattcctccatatgaaagatggtttttgtttttcttacatggtttggctcaaggtgtggatttctaagaaatagaatgtgaccactaagctgtatggctttctgtatagaaccttcagtttctggaggccaggatttgacaacgttaagcatatggaatggtatttctctctcccttatcttcaaatctacccagggtctttgggatacacaacaccctctgtgtatctattaataatgagaagaccttagaagagtggaacattggattctaattacttaagtggtattttttttttttcagagcagttagccaaagaacccaaagaaacagtattttcattgactggttatgtcaataataataataagataaaattaatatacagctgttcctaatagataatgagaagagaggtgtagttagagacggaatctataagagaagcaaaaagaagcaaggggaaaataatggtcaataaagagacaaaggagggaagagacagcagaggatggaagcagtgaaataaccaatgatgaaagagaagaaaggtgtgtgtgtgtgtgtgtgtgtgtgtgtgtgtgtatgtgtgtatgtatgagagagagaggaagagtagg

SEQ ID NO: 73002 - DNA, 1793 bp, Homo sapiens
gggccataaaaaactcttggaggctagagtttaggtttgggattacgaaatgtgagagatgaggctggcagggtagatttggaccaggtggtgaaaaacctcaaatattgtgatgaatttaggaatatatttgcatctaatcagcttctgagttttaagtaggatattatgatgcggaaccattgttccttaagaattaatattagggatcttttttagattaattaaattggcccctgtattttatatttaacaacttacacattttatattttaaaactattaaaatttaatatcatttttcccttagagtttctcagctcttgtcctttgccacaactctgtgttcccaagaatcttctactcttggacttccagactttcctttagatagtttagcagctgcggttcaaatcttggtaagtaaaataaattaatgactggcatacccaaatatgttaaaaattttgaaagttaatcattagggattaatgacttcagtttgcttttgtcatactcttctataaatattgtaaggcctgagattaatttgttgtgcagtgcagtaaactgtacagagaccaaggacatgttctgagcccctaaagagctttcagctttggagtaggagctagacatgcaatctcagtaaagttctacagagggaaggaaggctttagcctgatcaagtaagaggtgtgctgcagtgtgagttaggcctcagagctgtccttacctgagttaggggagctagggctttcacactgttctagcttccatcagtctctgtgtcatggttgtctcaggggacacaaattcccagacactaactgctctcccagcatgtgtgcaagggtggcttcaagagcccaaggatcgtcttcttagaaagacctacagcaattgctgttggaagagaaagctaggaggcacaagagagaatgcaaacagatctgaggggatctgatagagtacagacattgtccactacagtttcacaaagggcatggcggtcatgtctggagtgataaaaggcccaggaagtcaaagcacaggcaaatgtgtttaatcacaaaagggcctagtatctttggagaatgagaataagttgtatccctaaagcaagtgtgtgtggtagagggagaagtcagaccgctattgtgaaatgttttgcatgatgaatgaagtttcctggattttatgatatggaaaaagtggcttatcagacaatattaagttggtgggctatgaatgtgaccagacttatgttggaggaagacacctttgttggaagtgagggaatgactaggaagcttttgtaacactcagtgagaccctgtggaggagggcaccatccaagatagtgggaatactatcttaggcaagagacttatttttaaacttgtatgtatgtatgtatgtatgtatgtatgtatgtatgtatgtatatatgtatgtttcatgtgagtcagggagcctaggtattgttgacattgttctatacatccagaacagaatttctcctcctgtttatcaaatcttatacttttatcaaatctttttgtttttgcttagaacattttattttgaaaattcttatgaaatcttttgtttttgcttagaacattttactttgaaaattctcaaatgtaaaaaaaagttgaaaaacagtaaaacattcataatcccctcacctacaatcacccattattaatatattgccacatttgtttgcatgtgcttttttctttttttttttcctgaaccatttggaagtaaattgcagtcagtac

SEQ ID NO: 73003 - DNA, 1010 bp, Homo sapiens
aagatggacgcttcctgatgtctgctgagcgttacgacaaacttctccgagtaagaaaagaaaatcctgttgctttgtctttgctgtcaagctatgggcagtgccattttattgtgtaagacatggctctgttggaatcaggacagatgttcagatggcccttatcttgggtaaattgctagagtcatgaatttacagctttacaacactcttctgttttagactttgtcaaaacacctcccagatttttactgtcttttttttttttggtcagtctaataactattctcttttccattttttttcctattttttcttcttctctttcttcctcttttcccatctccttttttcccccctttctttctcttaacaactatttaataaaaggctaatgacttctagatagtgctggtcaccagggatacaaagctgaagaaagtccagtttttagcttcaggaagctaaaggtccagtaggtattgacagaaatgaataaaatatttaaaggatatcctgttctgatgacccaagccaccagcatcacatgccgaggttgctgtaggaacctcctaactgcactccctgcttccatccttccttcctgacactggtctcaacacagcagtcagtgatcgccttaacagtgcatccatttgggggcattcctatgctctaaccctgatagcttcttgttccactcagagtaaaattcaaaagtttttacaatgcaatacagtgccctttgttgtctgcttccctctactagaatataagtttcacaagggcagggatttttgtaactggtattatctcaagttcctagatcaatggctggcacatggtaggtgcttaaaaactatttgttgaatgaatgaataagtaccgtggaatgattaaatgctgtgagaaacatgcatataaagagggcaacaactagggaatgtggggactcttcagaggcttgggagatgggttcatgtaatgtcacaaatgacaagaagacattt

SEQ ID NO: 73004 - DNA, 1054 bp, Homo sapiens
acaaaagttcattccttggttttattttatgtttgtggttgtcattgtcataaatatgactagctatactaagcctaacaaaggtgccttcagcaaattataatttagcaatgcctaatacataagcactttaggaagctgagctgcaagttgaactttggatattaaattgtgatctcttgaccagccacactaccctgaggtatgtcaccaatcatattgctcctttcgtgcatgtcagttctttgcttccagtatggctgttattactttgcagtatggtttttcaaaacataagaagtataaatttttgttcctattacaaatataaaacataatcaacataaaaacttggaaaacattgaaaaacacaaaagataaaaccaaaattgtccataagcctaaatagacactattaataatatatgtaattctaatttttaaaaacagtattattaggtataactgacatgcaatacactgcacatatttagaatgtataatttgatgtttttacatatgtatataaccaggaaacattactataatcaaaatactgatcaaataaatttatctccccaaaaagcttacttgtgcctctttgtaatgtttcctggttcctccattgcctaggaatcattaatctgctttgtagatttattcggattttctagaattttatataaatggagtcatacaacatatatacttttctgtctagcttttatcactcagcataatgattttgagtttttttctttctaagtggtattccattgtatggatatattacaatttgtttctatatccacatgttggtagacatttgggttgttataggctcttagaaataaagctgctctcaacattgatgtacaagtctttgtatggacataggctttcttttttcttgtgtaaatacctgcatcatgcggtagatgtttaactttttaagaaatgccattctgttttccacagtggttgtatcattttacatttccaccagcagtgtatcagagttccagttcctccatattcttgccagctcttggtg

SEQ ID NO: 73005 - DNA, 1026 bp, Homo sapiens
ttccaagcattaatttttatttatttttattttagttcctcttctaacaccagcttcacaaactgtggcaaacctggggccaaagaggtctgtgaaaatctctttgctgtatagctgccagatttttggaatgctggggaattctctttgctattcagtcttatattctgcttgctgcaactcagctgtctcttgtcttgttgtactgccctcagcctccagaggccacttcagtgaaggtggagagtgcttctgagggatttatctcagctatctggccccagtaccatccttaaggaactgctgtcttgcactggataaagacctggagtgcctaggaggaatctctgtcacctcttctctcctaccactggccttttagtgggatgttgccttgcactagggaaaggtccagcatgcttcaggaggaatatgtctcagctcctgccctgtatttggtctgtagtgtacatccctgtgtacttgtaaggactgttgggaaggagtaggtgggtggatgcaggttttctatgtggctaggacttctcggtacattatgtctgcccatgcgtggccatcataagtttgctgaaagttcagtttgtttctcctgacacatctatgcagattgtttctcctcctgccattctaccaggggtgaaagttagctgcgggtctattctttccttgaaaaggctcagtcttttctagaatttagttcatgtaggcttctttgttttgttagctgtgtgatgagttttagaaaactgtgatttttatagattagctggtttattctggttgttagtttggaaataaaattctcttgcaactcatttcatcctaactggaagtgggagttgggaatatttatttttaatattcattatttaatggttatgcctaagtgtgttattttaataggttttcttttccagaggtaagactaatgacataaattcttcaccaagttgttacacttgtctggagaaaaattaacaaaatagatgtataataacttacatg

SEQ ID NO: 73006 - DNA, 1054 bp, Homo sapiens
ttgtcatacttctttagacatgatttcttttaattctttgaatgtatttgtggtagctgatttaaagtgtttttctacttagtcaaatgtctggtttactcagagatagtttttattgactccttttttctgtatgtatgagccatactctcctatttcttaatttcttataattttgttgttactgaaagtagacattttaaatagtataatctctccttcccaggctttgtggttgctccttgtgttgctgtttttttttttagtgatgttcctagtctatttctttaaagtctgtgttctttgtcatgccttgttagcttagtggtcagctaatgtttgaacggagatttctttaatgccttgaatcaataagtctcttggcttttgctgagagtctgtgtgtgcaagttggacatgacttcagtgctccataggtagcttacagttgtgtctcaaccttttctttctgcttgtgtggaccctcaagattagcggaaggtgagagagagattaggcccttctcaggattttcctgaatatatgcatggccttccagattcttaggcatacactgaagcttttcaaagccttctgcaaacatctcattttcagtttttgtttctgtctttaaagttttttggttgtcctcttgttagctccaactggttttgctgcctcaggcagctgtgatgttaaacaattgttgattttttttgacaaatgccccgagttagtgctgtttgcatacagtagctctgagtacatcaaataaagacaaattctaaaaatggagcatttcagggagctgccagacaggtcaagtagggataattttttgggattgaggcttttgaggagcttctgtatagttctgttcacttcagtgacttccaggctgctggttttcaccatgattatggacagtttgttgtaaaacaattgggctcacgcctgtaatcctagcactttgggaggctaaggtgggatgatcgcttgaggccaggagtttgagaccagcttgggcaacatagtgagacactaaaaccctgtt

SEQ ID NO: 73007 - DNA, 1018 bp, Homo sapiens
gccgcgccgcgggggaaggagtttccggcggactcggctaggtgccgcttcctgtccccttctccgcgctgcctcacggtgcctgcacgggacgccgctcgatccccgagccccctcgccgtccccgacagcccccccggcgccatgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtaactcggggtgcgcccctgtcctccctggtgcccctgcgctccgtgccgggtccccgcgcgcccccgcccctcctctctgttgcttcgctgcgcttggaaggaccgtttgccgagcggggagctgaaagattgaggttctagtcccgacctcggcgctaactgctgtgtaacgtgggggcaaggcgctcgccctctctgtgcctgattctgcaacccgaggggtctggactaaggtttctgatgacctagaagagtgatttctccttcccctgccgctgcctttacccccagaattctgacttaggttataatactcgtagaggttaatgcctcagccctatggaattattgaaagctggatttgaccttgctctctgagcctcaagggcctggaagccggtctgtgtcatgttctagccagggcttgtggcggcttagaagggaacattcttgccaaagaacccatagttcacggtgttttaaatgcatccccgagcctttccaagttttacaggagttttccttaaagtttcacgtaattcttagagctgacagttacaccttaatttagttaaaacacttgcctctacaaatgaggtaattgaaacccagaagggaaaagtgattcgctggagaacacacaactaattactatgctagaatcacatgctttgatttctaagctcagtattttttggctctacttga

SEQ ID NO: 73008 - DNA, 1630 bp, Homo sapiens
tctcccgggacccgcgtctgctcccgtcgccagcgcggtggccagcctagcccagcccagcccgggctttcctcgccgctctccgcgcgcccggccccgggggaggccgctcctttccgcgcggccgcccggtgcccgtgaccacccggcggccgctttcggttccgcgccttataaggcctgacaggggggtcacgtgtgtcccgggccacccgccgggaggaggggcggcgggggggaggggcgggtagcggggaggaaaaggggagggcgccgggggcggaggaaggagcgaggggcggattctgcgcccgtgggaggctgcggcggtggcggggagcggaccgctcggagccgcgcaggggagcgggaccgtggagaaggaggaggcggcggaggaggaagggaccggcgcgggggcgggagagcgcggcggaagccggagacggcgggtgggccggtggctggccccgggcggggagccggggcggcggcggcggcggccgagagggaccgcggcgagggaagcgcatccaggagccccggcgcagcggcggcggcggggacccgggtctgcgcgcccgggcggccggcgggcgcgggctggcgcgatggagcctcagcacgtgcgccccgcgcccggcgcccgcagcccagcgtgggaggaaccggtgggtaccgcgcccgcgcccaccccctcccgcttctcctttgctccccccgcccgggccgggttccgttcaggaaatggcccgggatgaggtccccagctgcttcccagccgggttagcgcttcctccgccgcccgggctcctcctcgcgcgccgcctggagcgcctttgtccggctgatcgaggctctccccgaggaaccgctggcaaaccgctggcgacggccctgcgaggaccgtttcccggcttcaccgactcctcaacttttcacttgctttgagaccgtggaatgtaggcgggggagaggagaagccaggctgcgcggtcagcgtggggagtctgaggagcccggttttccctgtcgagaccgcgccctggtcgtcacctgggcgcgcaggttcccggggacacgcgcctggagaggctgagcgcggcgcggagcccagaaccacgcctccgactcctgccagccgctaaagcttgggcgtctggagggtgcaacgggttttgccggggacgaagcagaaagctgacttcgctttcgcctgggatttcgctgcacacgcaacgcggaggttgagtaattttaggaaccaagagtagtgtgtgtgcgtgtcttaagtgtgcgaggataaggaggaagagaccagggggctttggatttgttccctcaaactccctcaacttccttctctcttccgattcaaacagaaccgtctcacatccctccagggattccaccccggaatccccctctcactcagagctctggaagcctgtgtgggctgccttttccctggcgtcgaattttgactctccacgccctgcctcgatatttgctactccttcttggttgacattgtgagccagtctgaaaagccccgtccgaaatttctggcctcacccatgttccggtcaacgtgttcggatgctgttttcccagggactctccgagtctg

SEQ ID NO: 73009 - DNA, 1043 bp, Homo sapiens
accttagtttggaggaaccttaaaggtcatgtcaactgaaaaaatacgaaaggaatggtactgaaaggcatgaacataacagagattgaatgctttctccaggtggagagactccacagtctggcagggactttttgtcctatttaaaaatatagctaacaccagtttggtgttctctttggatgacaagagggatctgtcgttttaatgtcttctctcgcagccccctcaccgcagccccctcacacctgtgaggcttctttgacgttgagcgtgcacaacccgctgccagtccgcggttcccaagtgcccgcgcagccagcttgcaggggagttgtgcgcggtggctacagcctgttgatcccacttcctcctgctctagtccgggctagggagtggctctgccaggacttccaaggctttttgtctcgggtactggtgttcgcatggctcgagtgtattgttttcttccaggcaatctcggttagcgcttcagcttagacacttcttgtgcgttctgtcgtcttgggctgcgtgtagtctcttgtttctgcgctttctccacgcccttcccagtttcctgttagccgaaggggatcgctctttctgaacgaaaagttctcagagcggagctgaacctcccggaaaatgctcttctcttccgtgtgcgccggatgggggtgggggtgggccagaaactgaacgccgccgtcaggagagctgaggggacccgacggccctggcggaggcgggagaggtacggtcctcggagtggggctgggggtggggaaaccgacgaggggcagcccccgactgtcttggtggcagaggggacttttattcagctggaaccgcgcggcgaggcccaagtgtctctggagagattcggggttcaggaggtggcgggtgcacccaagggtgctgggaggaagctccaggttcccattcttccccagggatcggcgttgcccctgctgtccagaagtgagagggggtgtgcgggcatcgccactacggggtgggctgcagaggtttcctgcctc

SEQ ID NO: 73010 - DNA, 1870 bp, Homo sapiens
tggaaacataatttttattcagtgcctgtggaggccggtaacggtggctcatgcctgtaatcccagcactttgggaggccaaggcaggcagatcacttgaggccaggagttccagaccagcctggccaacatggtgaaaccccatgtctattaaaaataaaaaaattagctgggctttgaggcgtgcacctgagatcccagctcctcgggaggctgaggcaggagaatcgtttgaacccgggaggcggaggttgtggcgagcagagattgtgccactgcactccagcctgagcgacaaaaaaaaagctagtggattaatgtttgtagtagcctgcctccttattttctgaaatacatgtgtgtaagaacaacacacaagaacaactgttgacaagatgcacttactaaagagttagggattcagtcactttagttaagagtacatcttgtaactccttttaatagtgacgtttttgagtttgtagtaaattaagaatatggcatttaatgtgttttttaagattaaggcttttacaaagttagggactttcctaaaagtgtttttaatatttcaaatcttaattctgaaaaaagttcataaactgtgttaatgatgggcaaaatggcaggtaaaaaaaaaaattgtataggggccgggcatggtggctcacgcctgtaatccctgcactttgggagaacaaggtacctgaggatcacttgagcccaggagttcaaggctgcagtgaactgagatcttgccattgcactccaacctgggcaatgaagcgagactgtctcttaaacaaacaagcaaacaaacaaacaaacgtgtatgttacatatttatatgaaatggtcaaaattccatgcatacttatatcaggattaaccagtagatttatactgttcgaaagaaaactgagagatggctctaaattgaattgaatcatgtcaaacaacaaatttgttgggagtaccactgtattttataggtttcatgcgctcgttgtaatagctaagattatatgcttatggagactacaagtaaatttaaaaagcacattatttgtgattttctatctgactttctaataaaaacatttagcacatacattttgccatgagagatcatttttgactatgaaatcaaatattgcttgaatttcaaaagtgtattgaatgtcagaaattcagcattttacaatttctcctatgttagagtgcatgtaagttcatcaacattttcatatatgaacacttgagatcagggtataagattctgagaccagtgagcttcaacctcataccccgcctcctgcaactggactgttcatgtatgtcacagacttcattatttacgtcttttatcacatatactgattcttggggaagaaagtgagagcaatagggggaatttatagaatgagaactactaaatttaacgttggttcccagtcttcaattatgattcagatgagaattaaggaaggatctttagaaaaagacaaatactttctgtgtctccgcacaggtgtgtaagatgggagcacctggaggagaggtaggccctaagattagctcaaagccatcttttttttttttttttttttttttttttttgagatggagtttcactcttgttgcccaggctggagtgcaatggtgtgatctcggctcactgcagcctccacctcccaggttcaagcgattctcctgcccctgcctcagcctcccgagtagctgggattacaggcatgcgccaccacacccagctaattttttatttttagtaaagatggggtttctccatgttggtcaggctggtctcgaactcccgacctcaggtgatctgcccaccttggcttcccaa

SEQ ID NO: 73011 - DNA, 1032 bp, Homo sapiens
ctctttttaagaaatcagtttgaacatgtgaaaaccttcttagctcgtcgactatataaaatcaggcggccggcaggatatggcccatggatatagtctgtgggctgtagtttgctggcacctatgttagaaaatggaaggtagtatagttaggtttgccaagcattgcaaagttaaggtgctgttaaatatgatccacatttaagggaccaaataaagctagatttcagtccatttaaaaaatctaatctttgtagaacattttatttttagcttggtttgcgtctttgcttccattttaatgtgaactaaatatagactggaaattctgactctcagtacagtaatatatggtataacacctttctttccattttgattacaagttaaacatgatatcccattattaaagataagagacataataaataatttactaaacctttacatataacttaacgatgccgtattttaaagtatctaaatttagaactctttcacttagtttaagtttgcttgtttgctgttgtggtaaagaggcaaaaggttatatgaaactaccagtataaaggacgtggggccccgttctgtttccagggtacagtgtttttcactcatattggatttgttaggctttacttactcaggaaatgtgtttataagcaaaggttttaattaaagagagtttgttttacatctaagaatagacctttgaaaaaggccataacatgttagtacattacagtttcccttggcaaatttgtttggttttgttggatattgagtattttactctatgactatttagtcactggaaacacatttgtagctgggcaccgtggctcatgcctgtagtcccagcaatttgggaggctgagctggtaaggttgcttaatgccaagagtctgagacaaactttagcaaaacaaggagaccccatctctataaaacattaaaaaataagaaagttagctgggcgtggtggcacctgtggtcccagctacttggaaccactgctctccagcctgggtg

SEQ ID NO: 73012 - DNA, 1009 bp, Homo sapiens
atgcatgaacccaggctaagaacttttctctatagtaccttactttggacactgttaactcactttcaactttctacttggttccccccaacccccttcagccccactgacctccctctttgcagctgctgttccttctacttagcctgctcttcacccagaggtccacatggctcattgcctaaaaatcccttcccactccacctccactcacagccatgctctatttctctctatagcacttatcaccttctcatatactatgcgtttcaagtatttacaagttcataaattctccttgcattaaaatgtgagttccatgagggcagaggtttttgtatatttttgcttactgctctatccctggtacctacagcagtacttggaacaccatagatatttctttgaatgcatgaattgaggagcaacaaaggagtaaactgagaaggagcacacaggaagatgcatgatattgaaaatgttcccattctgaagctggattcacgggtgttcattttaccactgtgcttcacaaactacagagatattatatattcttataaatatcaaatattataatatcacataattttaaagtactacaagagtgtcgaggaacaatacaactcaaatcaccgtgcctgctcagataaaactcttgcactttttcttacctacataaaatagtgagatggagaaaagtaggccaaaaaattcctgtcgttttcattctctagctaggtaaaaataaattttactcatattttttcctcaaatatgttttaataggccatgtggaaaattacttcacatgattctttttaacactataccatgacctttcaaaaatggcatcttaccttatagaagtgaaactaacagttttctttgaaaacctatttgaagagttaggtacctagaagcatttttttctaaaataatccttttaaaagtacgttaaaaagtctcaataatttttgttaagtttaattcaaatgaatataaattt

SEQ ID NO: 73013 - DNA, 1009 bp, Homo sapiens
ttaggtaaaatagggctagaggactatgagattaggaagaaggttagaaggctaatatatagagtgaggtgtcttgcacagctagagatgagttgtaaatttgatcccgggtagccagagcagcaagaccagttataaagtcgtattaccagcgggaaaaaagccctctagattttaagggggaaaagcttttctagctttccttgggggaaccaaagaaatatgttctatcagtctttgatgtgggtgggagtgaggtctgcaatatgttcccctcacctacatccacttgggaggtgtccttatgatgtcctcccttgtgaggtcaggacataatccagacttcaactttgtgtgacagtagttctgtaggagatgtaattaaggcagttttagttacggccaacttcaggcataaaatccaaattatttttgaagattgaataaatggcatgtacttgaaacagttctcgggttaaaccaggtatctgctgaaatactttcaaagtgtagaatctcaggttatctgcgtttttatttatctgttcacttgtagttgatacaaggggatggagtgatatgttcttagctattatgggaagaaaaatctggtatttcttggtggctctcataaaaactggtaaaatgattctacattcaggtttaaaaaatgttctttggagctttatgagtgcattgcagaatattaaaagctgtgtgtattttaggattattgtgaaaatagtgttgacttcatggacctttgaaaaaggtcttgggaacacttgaaaatcctgctagggcaatgtatctggacctatttttttttttgaagagagtgccatgaggatatctggaggaagagcagagcaagctgaaagaacagcaaatgcaaaggttttgaggaagagacacacctgacacattccagggatgagcattcccgaacagctgacacattccagctggtgggaagggagtgaggggaaagtgagtagcaggaaaaaaa

SEQ ID NO: 73014 - DNA, 1071 bp, Homo sapiens
aataggagctgtattttgctcctatgagttcatattgcttaatgtttgaattagaagaaaaaacttttgttaggtcactttcttattaagtttatatttgaacagttagtaagcaggcatattgaaatgctgtatgacataaccgctcttatctttgaggcaatgcagtgttgtggttaagatcatggactttgtgttttgagaaaggcctggtcttaaatcccagttgtcctatttaccctctaagtgacttcgggtaagttacttaatctctgtaacccagccttatctctgaaatctggacaatcaatgtacctacctcacagagttgtcgtgatgatttgcatgagataatttgagtatttagaactgtggctggaacatattggttcttaaaagagataaattattgtattgatgttaaaagaatatagatgatgttccacagtaagtaaataaaatcagcatctaaaacaaacttgaattgtgatgatcaagaaaaaaaatgtttaccttgcaaagaaatacagatctgcccactgtcatgagacagtggcttcccattagctctgttttagatcatttctaaatttactagattgtaaaatctcattatgaaagcctagacagggtgatgtatgtggagttctgtttataattaacaccttatagaatgtaatgtttttaaccaatgaatttttaaacaaaagaaaaagggattttcaactaataaaagtccctccctcacctcagaggtcaccttctcagggcgacctgccctggtgatgctatccagcattgcagtccccacccccaacctggcatgccccaacttcctttccttcttaacttctccccttagcactgatcaccaccgaatacactagatagtaccattttctctaaatccatcttctaatattagaatataaactccatgggggcagggatatttgtctatttttttccctgccctgtctcctgtgcccagaacactgcctgttacatagtcattgcttaaacgatatttgttgaatgaaaaagggaatggttctagttttgagaaattct

SEQ ID NO: 73015 - DNA, 1081 bp, Homo sapiens
tcactatctagtgtggttatctaatgttgaagaaaagctagagacatgcttctaataaatgcataatttaatttagcaaaacagtttttggaaaaatagaattggaatttgaaagtgtgtgccactcatgaaataagggttacgtggggctttgtttcacatggagcatgagagtggcaatgtgtagtaatggagattaagttagtacagcaaacaggcctttatgccttttatacttactaattgtgtgataataaaggagttatgtaacatattaaaacctcagtttcctaattttaaaatagagatacattcatatggttggattgttatacagattaaacgagataactgcaagtgagctttgatttacttcttgttttttcatactttttcctgtgttagtcgtgtttctgcagtttgttaaattcatgtgtacattttctagtggtgtttgaaggtgtaataatccttccaatttgttaatacatttagaatagtgcttttggggctagaagattggtggtgaccatgctgtcacattgtttctcactgttctaaagtgaaagaactttataatgaaaatatttatttcatcatgaaagtgtgtctcttgggacccaggacatcaatgaatatgagatctaagtgtaaaagtgcactaaggacttggcgcaacttccactatcattatttttgcaccattgttaatctgtatataaaataactttttctttccttaaatctttcagaagcccctttgaaacttagcccttaacagatttgtcaactcatgcctgttgctgctgctagcttatttagtctactgaaaggttatttattaatgtctacaggttgctggagccactaactgaaacttaagaaaggtgcaggtggggactcttttaagcctcatgccatgatggatgttcatccagtcatcatggttaccatggcaagcactggctgctacctgtttcagcagcttcctcctactctttcctattttcagactgctatctacattttacaagctcattgtcaccttgtttctgccagtgttacctaattccatccttga

SEQ ID NO: 73016 - DNA, 1045 bp, Homo sapiens
agatggtgtttgtaaatattgtgcaagtgtattttgtaaataaattcctcaaaatttagtctatgattttttaaaaaaaccgaagtctgtaggcaccaagacaccaacttaagtttttaaaaatcacttaacaagtaaaatcatttctcatgttgtttgcagcctgtgtaacagactgctgtgtttgttggataggagacagctcaattctttattggcgtaaagaataaaagaattattacacagagagaaattccatgtatgctatatttgtatgtgcagctgatctaaagtagtgattcattttctattacctgtcatattcttgtcacgcaaactttctgtactggccttttggataatggccaattgaagagagaaaagaaaatcaacccccaacatagagctggagggagaaagacacggtatttatatcaggagagtgttgtgtaagaaaacatcgtaaccctcttttttattgcccattttccagaaatcttactgctattcaagtttaggttaacccctttttgtctgcagttgggtctatttttactttgtttctatgtcttgtgaccataatgttttaacatataatgttgggaatgtaattattttaccacaaataatttatggctcttttccaagaatatataagcaacagaatattggtttaaaaaaagtactgtttagatttttttctttctacagatgtgacagtgtaattcatccaagggaagctgcttgaatctgctaattaaaatgacttgttatagctccaatttctgtaggatgagaaagaagttatataagttattggaagttatgggttcttatttcttaaacatgctgtaaaatgtgtctgtgtgtaatttttttctttcagtagttcatagctgagatttttatcctgttaaatgaaagccctcaaagattttcttcatcaccttttatagaatatagaattatgcatcactttctcttcataatgtttacttactttcttttggcagtttggtttagatattcttcttggtactttcaa

SEQ ID NO: 73017 - DNA, 1028 bp, Homo sapiens
gcctggcccaagaggcatattctttaaaaatatatgtacaaagttatggagtatatgcacaaagttatttgtatatttttaaaaaatatataccaagttatgggtatatgtacaaagttatggggtatatgtgcaatttcattacatgcacagattgcatagtgatcaactcagggcttttagggtatacatcacccagataatatacagtgtacccactaaccaatttctcatcatccattcccctcctaccctctcgcccctccaagcctccgttgtctcatttcactaaaagagggatattcttaaagaaacctctaggtttaagaacagagtaaaaaaatgatttcagttgctttggtcagtgggtttttttgctcttcacccccattccagtttaggtgtgctcccttgacctactaggaaagatgaactattctcactcacggagttcatccctgtcccctcccaccacctcctaactttgtatgatcatgtcgaccttttgttttgtaaccataatgctaactttaaaaattatttttatttgaatgcattcagcactcaccataagtcattttaccacagtttgtgcacttctgagttctttatttttgactctgttcttaattacttgtatttcattgttaagtagtacttccaagaatggtgcatgggtgttttttgagttctttgaggtttgaaaatgtctgcttgttgtttttaatacacaaataacttggctaaatatgacactctttggtcccattttccttccactttcttttgacttttttattgtggaaaaacctgaggtcagcctgattttctcacgttgctttttcgatcaggataacctgaaaaattctttctttatctttgaagttcaataatttaatgtctttgttttcactatacccaaatacaaaattaaattgctacttaacatggtaatttagatttcttcctcatctgttggtgccctttttattgtatgctttttgatgtggtgcattctacagaatagt

SEQ ID NO: 73018 - DNA, 1020 bp, Homo sapiens
cgggctgaactgggcttcgggttggactgggcttctgtggcttccctgagcaactcgttgcttcttgaggacccatgtctgggtcactaacccacccactaatcttttccctttagggagcccaagctactaggacagacaacttaacctctgtctttaaaagcttttaaagaaatattgaaaaaatgaaacaggctaaataaaaagagagagaagagaaaaagtactcctggaaaccaacgatattttctcaagtattgtactttgtaagaaataaaagtggaattagtgttaaacccactttcaagaagcatgaacgacacggggatgggcagcattcctgcccgtctctacctggaatgcaggtagagacagcgaccaaaagtgaccttttacaggtagagacagcgaccaaaatatgagagcaaattatggtgaagccataactagaaattgatcactaacctttaatcagaatctagacataattattgatataaaataactcctggtcatccatattcatgtaaatatattcaatatttaatataaaagacaatagacatttatacatatatgtcttgcatcatagtttgtatacgcttacagatgcttgctccataaaattatttttaaaaatcacttaaaaatttttttttgccatgtttattcacaggtatctcttggaagttctttgctgttcattttattgctgtccaaatagaaatagtacaatctgttttctttttctttgatactacatcttaggaaatgatcccatctgctattcagtgttgtatataagagtgcttgtgtgtttttagtttaggtgtaaatatttaaaactaccagatttttttaaaggaagttattcacaatagcctcattcatcttaaagagttttataattaaaaattttaggtaactagatctatgtttatatagagttaaccttagttatatgtattacaatgtattgcgtatttttaaacaaatgttaaaataactttgatggctatg

SEQ ID NO: 73019 - DNA, 1031 bp, Homo sapiens
tagatatgtatgcattctggatttctgtttttgctcatgatactttacattgctatttttattcctacttttaaacatgaagcagttgtccattttgagttacccattttatgaattggcatatgatataatataagaaaaaaatttaaatttaggttatgttaatgcagatgatataaaaacagctgagacatgctagatcattacctgaattaatagctgggggatactgaccaatgcagtctttatagggcatgcgaaacctcttagaatataactgaatatgtaaatcataattaatgttacatttcatgctggtgaaatgtaggtgagcaaaatagtttatggattccctttctcccttccccctatgcttctctctccccaaaatggccgtcctgcctgtgaacctctctagaagctgcccagaaatgccatggttccatggaatacactctgagatacattgctgtaaagggaaaagcccagtgattgtgatttggagtttgtggcaataggtaatttgaaggttctgaccattctcaaaatatgagcaataaggctgctatgatatggcagacctacactgtgaaatgttaaaagaaatgatttaagatggtaggtttacagcagagtaagcctattatgtggatggaaaggattgtttttggggaaaaatgtaaagtagaaataacattttcaaagagaacaaaaaaacgagccagagtttgattctaagacataatcttgtgctttttacttgaagctaatatagccagaatatttaagttgaaataattgtttttaaaaaaattattcaactcttggaaaatccaggtatgtttgaagtccatagtctgagtgatctctttcctctatgaatttctgtaacacttaagaaatatttttccaaagatatttactacatactgatactcatgcatgatgtctgtatttttatctaacctattaaactaagtttttttttttgagacagagtcttactctgttgcctaggctggagtgcgtag

SEQ ID NO: 73020 - DNA, 1858 bp, Homo sapiens
tttacacaggtgaaaaaataattaatattataaattgaaaattaggccagggcacggtgcctcatgcctgtaatcccagtactttgggaggccaaggtgggcagatcactggaggccagaagttcaagaccagcctggccaacatggcgaaaccctgtctctactaaaaatacaaaaattagctgggcatggtggcacatgcctgtggtcccagctactcgggaggctgaggcatgagaatgacttgaactcgggatgcagaggttccagcgagccaagatcatgccactgcacttcagcctgagcaacagagcgagactctgtctcaaaaaaaaaaaataaattaatacttaaaagtttgttaatgtgtagtggcatttgtgtcatattttaggagccattccttttgatgacacttacaaaatcaatcagaagattcttaagtatatgattcttcaagtttttattttctttatgttcttaatgtcatgctggtctctttgtgatctaaatgatgcagtgaatatttcataaatacaaataatttaatcttaaatttgttaatagtgtgtatttataaagtgaattttattaaaaatccactaacaactgtttgagtgcatctttgtgctaatgctatgaggtaattatattcttaagctaaagtcagcacttccgaattactctcaggtgagaaaaataacttttaatatgaaaggacacattccggaagtacactggagtgcataaggagttaccaaagagttttcttgttggaaaaattacaaattcataggaaacatgattaaatgccaaattctatattagacttaattgcaatagaaggtcagagagagagaaatcagtgtgggccaggatagcaagaggttgcttcatccctgcttgtgtagccttttgtcaaaaatgcacctttaaaactggactcctcatcttctcgcccacactaattcatagagtcaggtttgcgagtaaccttaaaggtgctcagttcactggcgctttccggctgatttcatcctgtcctgcttgtgtttctttgccttattccacattatcaaggcttgttgattcttcctttgtaacaggtctcagtttgtccattcaatctagtgcctcaacatgtttatttaagcatctactgtgtgtcagatgttgtgcagagtgcggggctgaataagggccctgaaggagcctgcatcccttcatgtgtgcagtggacacagaaaatttccggaaaaatgtggggtgtgctaggaaagtgttcacactgggtctgtggcagcatggaggattgatgctgaagccacctggggagaagacctgagagagcagggggtatttgggcatagttcagtgtctctgaagtgtgaatggcggggctgaggccatcttcactgcaggtgaagcagcactggtagtaagcaagggtaaaggcttgaaaggtgtgttacccattcagcaaatatttattgtgtgccaactacgagctaggcaactattttgcaaccgaatgcaacagtgaagaaaacatgaaaagcataagtatgataaataagatgactgagtagcgcgtgtgaaggtgaaatgtgttgtcgaaaatgataaagcaagatgatggagttggggactttgggccctaagctggggttgaaggatgtttagggtgtactccacagaactctgggggctgcagaggtgcttctggggtctataagaattgttctaaattttgttttaaaatatgccttaaaacatttcaaaaacagtaatgaagaacagcatgagcaaacagatacattattgtgaaaatttacacattagatcaggggtccccatc

SEQ ID NO: 73021 - DNA, 1312 bp, Homo sapiens
aactgtctttcacgaaaccggtccctggtgctaaaaaggttggggactgctgcattagacaccaccagcgcattaactggtgccgccatggtagctcatgtttggaaaaatgcgtggattttaaaacaattttttttattaattgacttcataatatataattttgcccatttaaacctaaagttgaatttacattaataaaacatctcatttacacattttgtataaagagaatctactgctgaaattattggacattcaccttacaggaattcaacccgccttactcttggattatcatagttgccctcagcaccttcaaattatctcccttctaatctcttttgcataccattgctagagttaattttcttaaatcactaaatcttttaattaaatgcttgaaactcaaactctgtggtgggggcaagtagacttactagttacagttctgccacaaaatgctctgtggccttaagcaagtctttgttttctcatctgtaagaatcttttttgctctcagattttactcccataactctcctcactagctgttgatgatctttgtgatctgtctctagcttatccatccagcactggctcccccactaatctctgcctttatcctctgctctagcatggccattctcttcattcctgtctccttccttctgcaatgcacacaccactagctgattaattatgctcgcatatgttgatgttatttccccagcccagactggcctctttagttcattgacttacattctgcgtatcctttaaaaatagtcttctagaacttatggttaaagaaaatttattggaagaacaataacggcaccaaatgatacagcattaaggcacattgagaactaggaataaaccatttgatttgttgaaagctgtgctgtctagtacagtagccactagctacatgtggctatttaaattaaaaccaattaaaatttcacacaatgaaaaactcagtttctcagtcttaccagtcacagttcaatggttccatttggctagtggctacgctatcagacagtgcagacaacgaacatttccatcattgcagaaaggtttgttggacagtgctggtcatgggtggcttgaaagttttgtttcagggacttctggaggagaaataatatatttacagatggtccagaaggaaatgtttgataaagaaatggaggtgaggagtattgattctagaggtctgacagtggcaagaaagagggacggggaacaggtaacgtccaagttaaaagaggtatgtgtgtatgtgtgtgtgtgagagagagag

SEQ ID NO: 73022 - DNA, 1036 bp, Homo sapiens
catctgtttttcctgtttctgtccatgtgattgtcttgtgaacagtgggggacttttgtgggactgtggtgttcagttgaggcctgcccgggtaaggcagccccgctgtgagtacaggaacaagaactgcaaggacagatcgtagacaggcaagcaggagggctcggcttcttagctttggtgtggagaccttgagtgtgctgtctctctgagcttgtgctccttggcctttggggacccctggtatgcccctgatgggggagctgagacagaagggtcctagagtctctctttgggctcagaggcatggaggacaaaagggattttgtcctattgtctaaaatggtactttctgtctacttcccttttattagtgccaacctttagaaaagtcttgtttgagtgttctgtgtcacctctgctttattacgagtccttaaaagaagagtcatttttcacactcgggccaaacttcaagaggaatcaaatgaagagttagtgttgtgacaggcaggtggtggttctggccctgctcaccatcaggaggttctttctggtgtgctggtcttggaagcatttcttcatagggggtcattgttatagtctaggcaagaataataaaatcacaagcattaggtcactgggcacaggagcaaaaaggaagaccagttttcagaaaccttttgattggcagattaatttaagggtgagggaaaataaatttaagggtgagggaaaataaaagataggttgggagttctggggttcctaagcagtgcttaggaaaatacactgctgctagcaggtgaggtcataggaagaggagcagaattgccacgggaaggtgctgaattcatttggaattccgtatagagtgacttttacccagtgccgtgtagttagctgctggcaattttggaattagaatctaggttttctgaagccaggccagtgtcttttctattaaactaagacatgtgttacgtgaaataaaatgtacttgagtttcaggtggtgacggcatctctaagtggag

SEQ ID NO: 73023 - DNA, 1050 bp, Homo sapiens
tcaatatattatgtctttatggtagtaagaaatagtgtcatgtaaaagttggaaatgaactgtggaatcagacagacagaaatatgatctcagcacctgccatttattcatatagatctcattatcatatgtagcagataatgttctaggcactggagatattgtcagtgtgcaatccagtgggatgattaaaaattttggttctacaagctgtttttgtcttggaggctcactatagcactgtaactctttattgaatgctgtataaatgtgatccatcttggaccctatcctaagggggtctatttgagccagtgttgtgacatggcctctaaggtaatcctatagaaaggctctagtgtagtttgctttcttttttccttcctctcttctttccatccaattaaaatgaaacattaaatttaacttttttagatataataaactcagggaccttatattctaataggggtagcacaataaacgtagtaaattacattatgtgtcagaagatggaaagtacttcgtggggtgggtaataagatcaggatgggggaaaatatggtgagcaagcacaagtttcagtgtgaaacacgcagttactcaggtgggtctcattgagatggtcaagacctgaaggaggtgaaggggtcagccagagggatatctgagggaggagaggggaggtagtgccagcctacagcaggagtatgtaggcccactgcagaagaacgcagccattgtgatggaggaaatcaagagagggaaacgctagatgaggtcagagaggttcaaagtattttgctggtgaaaacaaaatgaactagcatacctaaggcacttaaccagagcctggcccagggccacagagtccctgcctacctcttacagctgcatctccctctgctccctcttgcaaacttttcactgcatttatagcagaaagctctttgaagatgcctcaaatatccatgttgttttaacctttctacttttgcacacacctaaaatgcccttcccccatctcttgtcataaactccttcaagacc

SEQ ID NO: 73024 - DNA, 1057 bp, Homo sapiens
caaagttccctgttttcttcaagatcccctcaaatagtccttattccatgattcacgagagagagttcagttttctgctggataaatcatctgtgatcttctatagcatttcattgtatttcttctcttttaattgtctatcttaccttaaagttagttgtgtctatttaatctcctgtgctagactgtaggttccttccagtcaacgaacaagtcttacagtcacattggttgaattgaagtagactagttctacagtctacttcagtttcaagttccgctgtcaactacttcaagttctagtttccgcagttcttgcggtgcaccgttatccctgccttgctggaacaacgctgaatgagtatgaacaatgagtgactaaaagtgggaagcctacatttattgactaggatttcctacttgctaccttggatgttaagagtatacaaaaaaggtcatctgctacttgcaaagcaaattcattacctcatttgaacgcatagttatagatgaggaaaataaggttcagaaggttcagttacttgttgtgagctaagccaggactggttctcagctctcaccttgcaaacctggaaacaatgatattgcctctgcctccctggcagagctgttacaagcttcagagacattgcattgtgcatgtgtatgccacgcactcagcaggttccccgtaagtggtagctgttatgcttccagagagcacagcacatttgcattgaaacagtgttcccagggtgtctttaaagcccttttcagttggggatttatggattagttgtactttatgcttttatttttcctttctaggaagaaattgcagaaagtaccaccaacttaacttttttcccccattttctattcctaattcctgtattgaaaaaatgtattgaagagcattgagttaggttttcttctaatgtctttgtatgttttttttcattaacagtctctgatatttgatgaagttgacctctcagatgctagtgtagctgaagcaagcacgaaaaatgctaacaacagcttcacggtatggtta

SEQ ID NO: 73025 - DNA, 1034 bp, Homo sapiens
tattttctccatgtagcctactttcactccatttcaccccagttgccatcgttcaggcagttgccatagttcaggtcacttctcacttaggtgattcattcggcagctctgttccagtttcttcttttctgatcacagatcacattgcttaaaaagacctcactggttccacattgcctgcaaatggcatcccccaactcagtcttcagatcttgtaagatcatgcctcagcattctagtattaccagacaatttatttgtccttctctgtcccaccagtgcagcaattctacccatgcctatgcttttcctgttccctctgacttcagtgattcctcccccatctgtcacggtgggaatcctaccaattcttcaaagcttatttcagataacccatttttttccagcttctttcattcacaaagtatggattgagttcccaccatgtgttaagcacaagaaattcagaggtgaatgtgtatgtatataatttccctcaagatattcctgacgtcgttcagcccaatttcatgtgggctactttttataactacatactccctaggtcttcaaaggtgcattgttcttgctgtgttgtcactcccatccacactcccagtcctccctggaaagctaccactcctgacagcagtgtgcagtgtccatcccctaggcatgacagagcaggggagacagactgctaaacaggtgcacagcggtgccatgatagaggtgagcactggtaggggttgggggaagagaggacacaaatgaattcagatgttgccttattgatttatgggcatgtgggttaattcatagtgtaaatattcctccccgtctcccctgatccccagggagagtttagtttgagaagaggaaagccaagaatagagtcctgggaaaatgttaaaattcaaggtttaaccaataaagactgagagcattcttaagtaaaggagaatcaggagtcagtgatgttataaaaaccaagcagaagagagtttcaagacagatgctttgacacgtcctat

SEQ ID NO: 73026 - DNA, 1049 bp, Homo sapiens
tcttttctcactaatcatgatatgtctatccccagatttgtttttatttacccaatttgtagaggataggagcttagaccatgaaagtcaaacagcctgggtttgggtcctgacttggctacatccagttatgtgaccttggacaaatgggttaacctttctaaatcccagtttcctcaacagtcattgagaataacaagagtacctacctcataggattataaggattaaattaaatgtgataatacaccacaatacctgcagtttaataaaagtggcagttattctcccgagtttatcatctccctatttccaagtagcagtatgttgccgattcctgaaagtttgggaatttggaagaagaatgtggatgaactttatcttgagaaaacattccatgctgcttatctttcagagatatagcaaagatttatttccacttttatctcatattaataactatgactgggaataataaatgaaattataatctgaccatgttaggtaaatgttatttgcgaaagaagagctatttaatgatatgaaagtcatcacaatcacatggcatatgttaacctttcaaagcatgctgttcaaatgactgttttctttaaattttaatgaagattaggctaactcttaaatgagtcacaattttaaagaaatttttgtactggtattgttaaaacttcttatggaagtttgctagagaaagtagcatgtgttttttatttgtttgtttgaagtagaaagaaatacataggtaatttaattcatttatttaaccacccataacattttctgggggcagtctgtaggtgtgtgtgaaatttcatgggtacggcacacccacatgggcttactcggttgatgaaacacaggcaccctctggtaacacttatatttagaactaaatgatcactggaagaaaaagggattttagttcaggggtccctttccacagcagatgtgagtaaagtttattagcattagattattattctttctacgagggtttaaaaggtctacataaaaagacaccaataaac

SEQ ID NO: 73027 - DNA, 1089 bp, Homo sapiens
tggtcttattgacaactccagaattgggctttacatcctgtatgaaatgctttaaaaatatgaacacattgttatacctcacagattttggttccattagacagtaaaatcacagtaaccaagtaaaagcccacccttttaaataggatttagtctagcctggccattcctagtgaatccttattaccttcaagtgagaagaaagctcacctagaacagtgttgcagctagcagtgattaaagtgcttgtgccatggcattgattcttgcggtcactaggttgattgtctttaatggatgagagaggattagcaattttgattcccctttgcattttattcttacgtaaggatttaatttccaacaagaaaatcatgaaattagtttctggcaaaaagagattttctatttactggtttctgccttacacatttttgtggtctctggatccagtttaagcttcgctgagcccaaatctcaatttatgaaggcaaaagtaggtttgtacttaagagagacaaatgacaatctagtcagcaacagataagggaagtcagaagcaagatcttcctgttgacaacagataggttgagtgttatctagttggagattttattttttagttgtttattttgtcggttgccacaggttgagacttgctggtagcacatctaaggtctttgggacaatcctggaactcagggttgaggtggagggttggccagctgtcaggatgctctcggaaccttctggtaagctgctcccactgagatggaactcaaggcagaagttagtctttgtatcttggaaataaacagattagtagtaagaaactattaaagagagctgacatcttagaaggtgtggctacacaacagccctggcccttgacatcaggacttggtaaggccaagacatcagcgatgtcttccactgatccaaacaccaggcaatgcctagtgatgtagttttttggaatcagttggtagggtttcttgttggtaggggatgctttgacatacttcattaatgctttgtaataatctagcataacactatttagtatgaaatgtctgacagtagttagct

SEQ ID NO: 73028 - DNA, 1070 bp, Homo sapiens
ctttgtggtctggtttctgcacaaattttggtcattttatttttcaaaattccgccagtaaagggtgctaataataactaatttttcccaattactcaacaatattattagagctgccccatttgttagaaccataatgtgagaaaagctgtcagtacaaagcagttaatccttttccctttggagcctttgtaagagttcagattctggggaggcttttttttttttttttttgtacaggtaaagtattcatatgaatgtactttagattgcatggacctttttaggaaaatgtaggatcttgtccaccagcaaggacagacgtgactatcctcaaaatgactgtagataaacttctaaaaggcgtttacctgaagtttaacacaatatcaggacacacactttataggacagagtgtaaagaaaggttttcaagtctttagattcatcagtgccttcactactatcattatctggaatcagcaggcgtactgaagtgtgccatttatgtgtacaaagacatgtatacaaggatatgattgcacattgtaatagcaaaagattggaaacaacccaaatgcacaagttagagacccgttggagtagattgtgaaatatatcatgcaatggaatgttatgcagccattaaaaagatgaatgagttctgtctgtaacaatacataccaaacttcaagttttattcagtaggaaaagccagatgggaaacagtgtgaattgtaagatgttactctgtgtgtgtttgtgtgtgtgcacacatgcatgcatttaaacctcaacagagcatatagttgttgtatatggatagaatatccctggagagaaatacaagaagataaatagttgccttcagtaaaggaagtcagtagctgggggcaggcttaggagggatatgtgcttttcattctaaatacattttgaattttgtatcataaatgtttattgcctattcagaattttaaaaaatgctacatgggacccaccttctggaatgcatttgataggagtgatggattcagcaggaagaccaccttagacactgtcaggatgtt

SEQ ID NO: 73029 - DNA, 1013 bp, Homo sapiens
gctgtccgtggacaaatctaatcagtagatttcttaatcacaaggcctataaatcaaaataattttccagttttttttgcctctggaaaacgtaactgtattaagtgtgttatgatctttccttgctcattactgttcactttaaaacaagtttttattgaaaaggagaaattgcaaatgtatacattttactttagtagtatataagtacacatggtttattttgctgaaatcatttagaattgaggcatttgtgtaattccaaatacacaaagaaaaattagaagctattctttatccttctttctcccctttttcttgaattcacaatgactttacaagacatttaatgtaaaggcactaaagacagttaaaaccattagtcatcatgctttacttagaattcagcaaagaacaaagttaaagaacaaaatagcaagcctggtttatttgtctgaataatgcttgtctcatgatactttatctcatataagggaaggagaggaaatccttagttacatcatataaggtagcaaaaaataaatacaataaatgctagagacaatatttattcagaaaacatcagtgagtccagtgaaacttggagactctgaaatgctgtgccagtcattagagccaggagtgtattatgatttaatggtacctctctgctgcatctcatgagctgtcctagaaaaacattttgaagcaataaagcatccatttggctcctaagtaatgagaggcattgttctttgcattaactatttattcaggaagagaagtgaccaactgttaataagctttatccaaagagggtcgtggaaaacaagaaaatgcaaaagtgaggttctcttcaatttcatatgcaattaacaaatatccagagctgactgattggtgctcctcttccatgtgacttttggctggctgtatttaagggtgagtgcctgttagatgtattcaaagcttctgggtttaaggaaggattctgtagcctaaacccatgacaa

SEQ ID NO: 73030 - DNA, 1154 bp, Homo sapiens
tggaagtgatatgtaaactcaatattatttaaatattaacagaatattcttgataccataataaatcaattaggtggccgggcgcagtggctcacggctgtaatcccagcactttgggaggccgaggggggcggatcacgaggtcaagagatccagaccatcctggccaacatggtgaaaccctgcctctactaaaaaaaaaaaaattaagaaatcatttaatattgcattcctttgatttttaatttaaaaatattttccatattgaaaactatgtattcctgctaagcttactatgaattattttgaagtatatttaaaatcagtttgtaagatgtatttcgtggaataagaatgcattgtgtatttgggtccatagccttagaaaaaagggctaaagagcccaagtcagtagcaaaaggatcaaaggtagaaaaactccttaggctttttctttcctagaccacattattttatcatacagattacaaaaacgtaagaaataaagactcaagttagaaatggaattacctcagaagatgttaggttttgcaacaatctttctctttgggtattaacaatcattagattgaattatccctttcagatcatcactccattcagaaggctaatgctgtgtgctgagaacagaaaggagatggaggattggatcagctcactgaagtctgtacagaccagagaaccctacgaggtaaaatagcatcttttctttcatctcgtgttcttaggaaataaatgttaaccaaagggctagagctctaccgtgcaaacataagtatgtgtacactcattcagcaacttgtttaaaccagattttgaaattcttatcttaaagcaaagtgctttggttttaaaaatgatggatttgaaaatttgaccataactatatgcattccaaacagttcagcatctgtagccttgttcactggcttggcaaatctgtcctcacatctcatttctaggtggcccagtttaatgtggaacatttctcagggatgcacaactggtacgcctgctcccacgcccgacccaccttctgtaacgtgtgcagagagagtctttctggagtcacctcccatggcctgtcctgcgaaggtactgtagcacctagcatgtgttttctcccaacagta

SEQ ID NO: 73031 - DNA, 2224 bp, Homo sapiens
taagtctttaatccatcttgaattgatttttgtataaggtgtaaggaagggatccagtttcagctttatgagtttctaacagcaggatatctagtgcctaaaacataatctatgtagtgaaaaaagaaaacaaacaaaataaaaaagcccatagccctataaacctaatgaatcaacttataatttttcctactgtcatccaggtctgtggacatagttttaccttttctgtaaaaattgtgaagatataatttgatcatctgcttttcttatttagcattattataaatacctttctgttttgctccatggttcttatacattttaaaattacttttaaagctatctgtgtgtgctagtttttctaaaatgcatttggattgttaattattgtaaagcataatagaaaactgtctaaaaacaggtcttcaccagaattagaattattattgaattttagttattctcccaaaggttttgataaatacaggtttaattatgccagttttctaaaaggactaataaaataaagtcatattaaataagaacttgatgaaaagtgtctgcttttactggttaaaacatttagaaggctctccagacaagtacacaaactaaattgcctgggtcctacttaataagttatccttgtttttgttctcagtagtaccttgcatgaccatgaaactcatttctactgaaagcacatttactgggtgcctgtgatacgcatcactttcctttaccttacagggcagcagtccagctgagaaaataagcatgggggtacttgtaactttaataatagggaaatgtcataaaagaaatgtgaatagaaagttatgggattactgcagaaaaagcaggcactttatagattttatctttgttaaattttataagaatttttataagaacaaaataaatgttctgtcatcaatttattttatgggcaatgatattgacacactggttagtttccgtccttcttcttccttttccccttctttttctcttctctgcctcccttcctctgcacttggtctcttctctttctctctcttcgccttcaacagttattcattaactatatattcctctctgagataattacaaaaattggttgcatggactaaaatcaaatttccatttctaaaatgtttagtcatttcctgaagtataaatgttataccatttaaagtagtttatgaattactgaacattttgtggtacagttgattctagattatcagttccttagatgtgatttataatggcagaacattatttttatgattcttgaaggtatatttgtttgtcattaggtacacactgcctgcaaagatttataccatccaatatgtccacttggtcaatgtaaagtatctatcatacctccaattgcactaaacagcaccgattccgatggtatgtagcagtagtgtaagtacgtatatttctggtatatttaacattgatatgtatatttcttttcctagaataataactatgatggtaattgactattgtagtcagtttttctaaaataattccatttaaattgctgaaagtacattccatttttaaaagaatatatttaagtgaaagttgtagaatagctgttaacattggcgaaattactgtatataagacttctagattttatgttttagtaaataaaacaagatcattactctgtacggcaatacaatctgaaaaggttaatttttataagtgtttttttcctctataattgaaactgcctattagcatggctgttattaaaatctgtttttctgtaatttcattgtaggaatttatattcctataaatgcacttttcccaaaatcttacaacttaactctaaagtgctgaggaacccctctacaacaccggttttgggattgcatactaattacttccttctaagcaaaccgtattgcaaaggctttttaccatgtataatgctatgctgttttatgtaacagacttgagcaactgtggattttgatattcatagggttcctgcagccaattcccccaaaatatacagggaggactgtactattattaatgtcttgcattgatatcatgccttatgcttttcaaactttttaatttatgccaatagatatcttagatataagtttataaacctgaagatgtaagtttataaacctcaaaatatgtgacttttttaaaaacctgtgctattaacagccct

SEQ ID NO: 73032 - DNA, 1066 bp, Homo sapiens
aatggccctgactaggccctgaactaggctggcaccaggaatgcattttactgtgtgtggcctttttaccttgaaaactgcgataaaagtagactaaatctttcttcttagcttttgtatacttcattagctgtgggtcttaggcaaattactcagtaagcctcaggttctttggctataaaacaggacagaggggtaaatatatacagagtgcttaattacagcgcctggtacacaatgcaaaatattaactcttattattacttacctttctgaccgtgctaagtgactgcatagtaggttaataagttacatctataattttatctttgaacatagaggctattttattttcctctgagagaaattgtattttttgatcttcaaatatttttaatggacaaaaacttggattttttgaatgtaagtttcaaatggcattaatcaaatgttattaattaatacattagtcaactggcattaatgaatttattaatagcattaatgatcatgtaaaatattttctaccctgcagggaagaaaaataaaaccaatctctggagaacattttcttttttcaaattttaaagtttatttttagattatatattttcatttttctcatcctagctgtaaagatgtaatttttagtgtttaagagatcagtaaggtggatttgtgggtaaatgcaacatcttgtgtaacttgggagctcctggcctcacttcctttctttgatgtaaaattgctttcctgtagtggtctgcctttgaaggagaatgtagaaatttaaaagagtaacatacttttgaaagagtaacataaccacttgtggaatgaaggtaaattaggaatgtggttcttttgggaagagtctagtcaggaaagctttgtggggaaggcttattcagacttaattgaatcttcaaataagtctgaataaactgaggctgattggtagaagtaatgaaaagatacctgagtcaggcagaagagcataggcggccagcttgcctagagcagatcatttatactagaaaattttgcgctgtgtgaaatggaatat

SEQ ID NO: 73033 - DNA, 1050 bp, Homo sapiens
ttgcccaagctggagtacagtggcgtgatctcagctcactgcaacgtccacctcccaggctcgagctatcctcctccctcagcctcccgagtagttgggaccacagatgtgcaccgccatacccagctaattttttgtagttttggtggagatgggatttcaccatgttgcccaggctgatctcaaactcctgggctcaagtgattcgtccacctcagcctcccgaagtgctgggattacaggcgtgaaccactgcaccctgccagaaaatattttcttaacattaatttcccaaatgtttatgttgctttattaagagcttataaaagctctgccttgttttaattaatgtgtatattaatacttctcagaattttagctatagtctaaatgttaattttagtatgaataattaatgttcaaaaacccctttatagattgtaacttgtaattgtatttcattctctaaaattcttatactttacttgtttattctgataaaaatataattttagcaactttagtttttgatctttagttcttcggacatcaaccccaagttcattgctaaatagtgtttatttgtgaatctggaattttgtttggcatatgtttcaatttgcctttcctgagcatatcttaatattaatgggctttattttcacttatccaaactatttgtcttcttactacctgaagttatggatgacccgacagttcacccctgtgaaccagctaatcagtcctctgattatgacagcacagaaacagatgaatctaaggaggaagctaaagatgatggtgccaaagaatcaataactggtgaggaaactgggaaaaaattattttggaattaaataaaatgtcattttgcttttagttttcaaaaggctgatcagtttgaaaaaaactatttgtatttttatttttgaaaaggctttttggaagttaaagcttagataaatattcatgaataataaaacaataaagataacacctagactattgtccagtactctcacatccctctcttatcatgtaatctagaga

SEQ ID NO: 73034 - DNA, 1118 bp, Homo sapiens
gctgtggcatgatgaagacctttcattccccatgtttatggccgatttttccacaggactagtagtagtgagtacattttaaattttacatgtttgaaacatctcttgttaactatgaaaaaaattagatagtaggtttattaatatgttgttgctaaatttattccagctttcatatgaagctaaataagtaaaacgtaaacttaataagtaaaagaaagggtagttgataaagttactttaaatttaaaaacctgtttttatcttattctcaaaaaattttaaaaaatgtttgcaatcattaaatttttgcttttactttcactacatataaacttgggcaaatttcttaacctctttttggttttctcatctctaatatgaggataataatctacctacttcattgggttgctgcgaaggttgaaaagttactataagtaaagtgcctagaatagtgtctggtagatagtgctgcctgagtgttcactgtcatctttattgttgttatttttattgctactactgctgctgctgctgtcactaattacattaacggtgagagaatatttcattgtacttgagactcttaaaaactttgaaatcagacctcatggacctcacatgttcagcataccacccaatgcaggcatgttctaggacccttgaagcagatggccacaagccttaggaccactcactttcaatacatcccactcttatggtcagctctaattgttagaaagtcattctttatattgggctttctattttctcccctaaatttctacccatgattacagtaattattaggttttatgaatgatagtttgacagtaacaactactggcctttatgtagtgtttatggttagtttaaggagcaatttcatatacatttgactgtatcaaagaggactctgactctggagctatttctcctcttccttctcctcctcctcctcccttcctcctcctcctccttcttcttctttttcctcttcctcttcttcttcttcttcttttctttcttctttcttcttcttcttccttctttcttctttcttcttcttgttcttcatgtggcagccctttaatgataccaaaaacagctttggt

SEQ ID NO: 73035 - DNA, 1041 bp, Homo sapiens
accttaatacatctcttaatattttaaattaagtatcattatctatgatttgagaatatggaactgataactccatgacattttgggtaattccgcctttattgtaaattccttatagacttaataccatctttgctataacaaaggaagtaaaatgtatttgttatagaattattgggatggtaaatgagaaagtgtcacaaagccattcctatttaggtcctcctctccttaattctttatgataacatatagatccttggaagtgtcaaaagccttgtactcacaaatgtcattgtttttaattttcattaatgagaagagtaggcactgaaataaggcactgaaaaccttgcttttaaaagtaagatatttgatatcaggcctggatggactggttctttctgtgttttttcttaacatgcgatcccatatgtgtttgcttttctttccaggtttaagagcaggactggctgcctcaattgctgggagttcgattatcaacaaaatgttactggcaaacattgatccttttggtgccacgccgtttattgacccggatctagattccgtgtaagaaaatgcttttgcaaatattttgtttgggtttttcttgttttttttttttttcaacatgaactgtaacattttaaatgtattacaataaatatggtcccatgtaaaaaaaggatgatcagaaaattacaaaagttgataatgccaagcacattgagtcttttaaaattcagtggtctccgtgatctgtccctgagataggtccttttccagcccgttctctctgagagcaaccctctggcaaaggaaggcaccaataaatagaactgatgctattccctttacctcctttcttctcagtcttgccagatctgtcatctttccacgtcagcttctaggtttacttattttgggaatcttttggcccacactgatctcttcccttcttaagactcctacaattttttggcatttcaagatatactttcttttacttcctttttaaattttgcttttgttatatca

SEQ ID NO: 73036 - DNA, 1379 bp, Homo sapiens
gagttgtaggcacctttggcattctggtgaaaataaagaccccttctcagaatattgttttcaaatgcattatatgaaatacagacttacaaaagaagacttaccaataagattaaaataaattaacaacatatttttatgttgctaaagaataatatatgtgtttcatcgttaccgtatcaaataaaaatctaatggcatgtctaataaataccataacttcaaagtgatgatgaacttatatacaagatatctgaaacatctataacgtaatataaaaatgtctcatttcgattgatgatgaaatcacgggtgttactaatgccttttttcccctacatttataattgagggcgatgctaaacttcagaggttagtgaacataaagatacagatttttaccatgaagttaacaagtcacctgaatctatccatggactcctggtttctgaaccttaagttaagaacacttgatatagatgtatatgttaaatgataagggaaaataaaatgagtaaaacaagataaatgaaaacatgttaatatacataaaaataaagtagaaaaagtagagcactctttgccatcattaacaaaaaatagtaacaataaagtaaaccaaaaagatacattctacttctaaagacgatggaaggccgttgtctaaaaattcatttttctgatgatggttcactcgggataaaggtggaaaagagagacccacaccttgggaggctctttccagagagacgccttcaccaatggccttcctttttagctttttactcttacctttttcctcagataagttttccctccccgttatgttgttggtatggaacgaggctgacttcatgtcttaactttaaatttgtgcagaacaaagactttgaccttggtttccctatatacgaaattgataaaataatgattttatgcaaatcataaataaatgagcccaaggtactgtaaatcacagtgtgaatgggaaagaactgtacaaatgcaaactttgtttcccaagccacattatcagtgattctgatatatactcaactttcagaaacttggagtgagatttagaatcctttttacaatgatgggaattccagaaatgtaaataacgtcacagtatcatattttgctacttttagagtagaaacacctttcacatgtaaatggaagaattgtattaaaattccaaacattttttgtaagaaggatgacttttttgcccataatatacgtaatttacatgggttaaggagactgttctatttattaactgaaataataattatatattgtttcaagttctgtaagtactaagatacatgaagaaaaacaaataactttaaaaaacagtcttcatctgtagg

SEQ ID NO: 73037 - DNA, 1299 bp, Homo sapiens
tagctcactgcaaccttaaactcctgggctcaagcaatcctcctacctcagcccagctaattaaaaaaaaaatcttttttgtagagatgaggtctcactatgttgcctagactggcctcaggtgattgtcccgccttgacctaaatctcttttttaacttttaaatgatgtattcatgatcattgactgcactacttttcatgtgttgcagtacattggaaaactttgaaatgtcttttttatacttgtgatttatttgaggagtcattagagaaaaagcaattgtagttttattaaagcacacatttacatggacctctgagttctaaactaacaattcgttacaatattgactttaaataggcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggtagggggctctgctgacttttcaggctgtgggaactgtggtctcagccaatttttgtttttttaatcttaatacattgtttcagtagtggtatcaaaaagagatgcaattactcttcttcacacagcactctttccattattgtttatttctccattttatatacatctttacactatactacctacttatatgttgccttctaattactaattaaatgtttatggaatggagagggaagtctaaacattcatcctgttccagagaagagtcaggagcaaaaagaataaaaagacttcaaaaaccaatttctgacaagttattagagagattttgagaccacacataacattaattccaatagacaaaaagaaaagagataaaaagcaagcctatgagtgttaaacaaataaaaatcactatgaccagggaaaacttcagaggggaggagggaccatgggccagtgtcttacctcctcacctgagtcttatctaccgaatggggctaataagagctgtttcaatagggtgtgtgaagattaaatgagactctagggatgagtcctataagcacattgtattagtccattttcatatggctatgaagaaatacctgagaccgggtaatttataaagaaaaacaggtttcaggccaggcacagtggctcatgcctgtaatcccaacactttgggaggctgaggcaggtggatcagttgaggtcaggagttcgagaccagcctggccaacatggtgaaaccccgtctctactaa

SEQ ID NO: 73038 - DNA, 1787 bp, Homo sapiens
tatggtaatgctcttccctaatctgttgcatttgcagtttcaatgaatgaaagagaagtttctagtctttatacttgtgatccctctcactttccaaggatactgaaaaatgaagtattactatatttcattcttcaaaatagcacttcaatatgtctccctctgatttttaagcctaattttttatacaaagattttttatttcatattttttgttgcagtggggtctggatttatagatctacctgtgccattcataattgagcagccattaaaagtgttcttccatactgatcttcatatattttttacttgttttatcctaacatttctatacttcaaaaaaaatgagcaatactcaaaaaagttttttattcatttgtttcatttttgcttttaggatatgtgacgcagccacaattcactgtcttttggagcaagaactggcccatgctgtgaatgcctgctcccatgccctgaataaagccaacccaaggtgcccggaggtgaggatctaatggtaaattctcattccacagattcttttgggtgttacacatgtattttaatactgtaaaatatgccacgccctgtgacagaaagttatgttgtctatatgagtctctacaaacctgcagtaaaatcgtggacaactttttattttccttttcctgttattttttcattcctgctcttaaattctctcattttttatgtttcactttcaatcacttgtcaccttccatctgtcttcacttctttcttttttgaactttaatcgtcctttcttactccttcttttaccttaccttctgccctgtaccttgttaaagggcaatcctagatatcatcagcgtgcattttgttagagatgtccactcgtttttgaagttatgcactgaaattattcctacttcattttgttttgctaaatcggaaattgatgcttctgtaaaatttttaatgtataagttaataatagaatggatagaatataactcttaaaatgtgccacatggtacaatgctatagtatggagaaaactgatagcgtttttttttttaattatttgattgaagttacttaaattaatatacagttaagtgcttgttctcaagataatagtctaaaaagcaatatggttagtgttactgagagtaaaagttttttttgacttaactttttaatgggaatatgtatatgctggtgctagcatatacatattcattaggtaggagatgtgatcctgagtgtattcactgtaatcggtgcattctttttgttctgtaatataataataatgagatagtcatacaaacaaatgtatgaaactttgcgattatagaattttggtagattaaaaatgtgtgctgtgaatttaaattataagaataaaatttaaagtgtttatggtaatgaaatcctattttaatacagatcacatgtctttgatattcttcttttctagagtcttacaagagacactgccactgaaatagccatcaatgtgaaggcgctgtataatgaaacagaatctttgctagttggcagggttcctttggtaaggaaaagaatgactggtaacataagaatgatgaattaaatgtctgggtcttaccttcattggggaacaggcatttggcagattctaaggcagaagcagccttctggcttccatcctgagagctgcctcttcacctggtttttgtcttcaagaaaatatatggctgaagttgggagtcatgattcaggctaacaggagtggagatttcccctcatatatgcca

SEQ ID NO: 73039 - DNA, 1048 bp, Homo sapiens
acagtaatattatctctgaacttttagttctaaaattctataaacatatttatgagaactctataattttaaagtaatttataaatatattgattagctagaagagacctcaaaaataatctagtcggccaggctcagtggctcacgcctgtaattccggcactttgggaggctgaggcaggcagctcattgtagaccaggagtttgagaccagcctggacaacatggtgaaaccccatctctactaaaaatacaaaaattagccaggcctggtggcatgcgcctgtaaacccagctactttggtggctgaggcacgagaattgcttgaacccagaaggccaaggttacagtgagctgagattgcgccattgcacttccagcctgggcaacagaacaagactctgtctcaaatcatcatcatcatcatcatcatcaccttgtgctatttccagaggaagaaataaagtctcctgaagtcaattaaccttcctttggttacttagttaattacaaggccaggagtagaatccaatcgactgccttccagttctgtgcagaggaatgtttatttaatctttattcatttattgaacttgtaagtgcattttaatacctgctttcaatgagttaatgcagataataggtgagcagttaaattctccttaaaatatccaaacccagtttcagatgataagccattgagctttttgctttgccctaatttttacaacagtttttcatcacagatttttctaagattcatgattttttacccttaagcctattctttaaattttcaaggagatttttctgcagttctttttatatgacaagtttttaaccagtttaaaaagtattatttgttcatgtggtgacttttttttttttttttttttttgagtcagagtttctggctctggcacccaggctggagtgcagtggcgctatctctgctcactgcaatctccacttcccaggctcaagcaattctcttgcctcagcctcccaaggagctgggattacaggcgcccaacaccatgcctaact

SEQ ID NO: 73040 - DNA, 1042 bp, Homo sapiens
taccccatatcagattttaaattgtaattagcatttgtagctcatttcagtctatagccgttttcatacagggtctgaaggaaatcatcagagcttatttagagcttgcaccattgatcctaatgatgtgaaatacattttgtatgcatattgtgtaggttgggtggctttaatgaggaaactggactaaagctaagcatgggtgcacggcagcaaatggttttgtatagtcggatccttgtgttgatagtgtgtaacttgcatgggaaaaagtggaactatggttttgttgaaacaacacctttaaccttttcttttgctagcactgccgctgcactctgttttgcatcttctttggccaacctttgctttgtaatgcattgagcatgtagaaattaagggggttttgctcttaactttggtagttcagaaatggggcacagaggaagttgctgcttggctggatctgctcaatttgggagagtacaaagatatcttcatccgtcatgacatcagaggggctgaacttttgcatctggaaaggcgagatcttaaggtatttcctttgtgctcttctgttcttgaaaattttattgcaaaacagaatcctttctcctgtgcctcttctgatacttgcttttagcttcgcttatgtcatgcaaatgtgtagtaacctaacattcactgtcctgtggtctgagtttcttgtatgctttttaacaagaatgtcagcagtattttcctgtcagaatcactctattatagctaaagcttagcatgaacttagtaatttttctctgcatctagtgatatgactgttgctgtgctagtatttccaaatggatcatgtttccatcagctcattttattgcatcagcatggaaggtgataatttggctgaaaatgactaaaatctaatatatggttaacaactaaaaattaatgcaaaataccaataacaaagcctttctaacatatggaatgagaagagagacttacagcaatggctacttagaatcttacaatttgttgtatttctaag

SEQ ID NO: 73041 - DNA, 1042 bp, Homo sapiens
gaaattcaaatttcctttctatgacatattattaaaattctattattctcaaaaagaattttttttctttagtaaacgaggtaaaaattttgcctagcttttgctagaaaacagctcagagcctatttgtgaattgacgatagagaaaaccattccttcatcacctgaggcatttcccttttattctgtgggtgaagtctcagtagtagtagaaacagctgaagtaggctctctggccaaggtttaggagtaggattttgtcacgttgtattttcttaccacatattgccattttaaatttccaataagtagtaacgtttgttggagtgatccctttcatgtagaccaagttctaaaatgcattaaattttatcataatacagagaattcctaacaaattaatgaactgttgttgcacctttatctacaaatacattagcaaagatctttgaatagataattggtagtataaagatctttattaaacagattcacaaagagttttagcacatcaaaagatgacaccacttatacctaaacaactttagccataataaaataaaataattaattaattaccttagttgagagtcctaaatctggaacatagcaaaatatgtagtattagagttcataaagcaaaagttggcttccaagcttgaaatgagtccacaaaaaagtaaatgtaggggggatcatgatatccaacatgtttttgtaacttctgatatccttggcagataccaatatttattaatgactgattaatatattatgctagcttctctgcatgatacctgtcctctagaagcatgcaccgcatttgctgtgaataagcatacattcagggaaaagactgtgtgtgtatgtataaaaaatatacatacataaatgcatatatgtgtacgtgttatatatatacatacaaacatagatatatacaggtacacacacaatgaatgtagcagaatgaatgtgtagaatggaaaaacatacactaaggcaaagttagaaaagaatagaaagaagatggttaagaatt

SEQ ID NO: 73042 - DNA, 1234 bp, Homo sapiens
ttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacgatgttcctgcctgaaatgtctttctttttcttgcatgtcacatctaatactgtaacactttaaatagctttcatgtcagttttaatgttaatgggatttaatttattactaaagtacatttttgttggttaagggcactgcacttttctgttttttaatgtgggattttgcgtaaatattctgtacctaagactttgtgaaagtgtgtctgtgccataatcaacaaatgatatacatcacatgcaagtcaattttatttcaatctatcataagcagtaggcgtgcacgttaagaaaattctctggatattttcataaaattacatgctcccttacctgacaaaacttgttacagctttccaaaccaaaatttccacattttgtttctaatttttaatttcaatttaataattatttaatattctatttgaatttataatatagtaaagtgttgatatccaggaattccctgaggtgtcaactgagatttatatactgacagataacccagactcacccgctctctacagtgacttctgacacgatcttccaaacagaagggatttaaattttttcttaagggctttatgttgttattattattatctcacttaattcttaattcttatcaggtggatattattttcctttttctaaaccactgtacttcagtgtagcttattattagaagtcaacattacaatgatcaaatctttgaaagccaaaggcatacgtatcaaaaagtcacaaaaatatccttaaataagctttctttagccattatataccaaaacattaattataatattttaaaatttgtatataagagaaataaacagggtactgactcagtggtgacaatttttatgaagtagcctgctaggtgcttaatagatatatatacacacagatatatacatatacacatatatgtgtatatatacatacatacacatatacatttatatgtgtatatatatacctacatacatataaccttgtgatatggcatcattgatattttctagacaattatttccccagtgtttaaa

SEQ ID NO: 73043 - DNA, 1050 bp, Homo sapiens
tgttcttgctgacaagaaatgacccatgaatgtctagatctatcctgtccaatattgtagctacatgtggctatctaaatttaaatgtaatttaattaagccaggcataatggcacaagcctgtaattccggtgactcaggaggcttaggagggaagatggcttcaggccaggagtttgagaccagcctcggcaacatagtgagaccctgtctctgaaaaaaaatttttttaactagctaggcatggtggcatgcgcctgtagtcccagctattctgaaggctgaggtgggaggattgcttgagaccaggagttcaaggctgcagtgagccatgatcatgctactgccctccagcctgggcagcagagcaagacccctactctttaaaaaaattaatttaattagaaactccatttctcagttgcactaactacatttcaagtgttcagtaaccatagtggacagtgcagatgtagaaaatttccatcactgcaaaaattctattggacagcactggtgcagatcattgctactcaaaatgtgatccatgggccagcagcatcaatattacctgggagcttacagaaatgcagaatttcaggcccactgcagatctaccgaatcaaaatcttcctttagcaaaatttctcaaacgattagcactggcctacatccattttatccttccttagctattagggatgtgaggtccgagggcttcaaaaggtccccggaatagcttgttccttcatccactgtgtcctattcattcttcagctaactccagcaatgagctgaaactcattcatcacccttgctgagttttcttctcaatccttattcctaattctggttctagatgagccctacctacccagtggttgtatttttgtagccagtgtgggacacaggagattggcagaccaacacagctagcctctctctagccctccctccacctctaagtcactaacaatccatgtttgttcagtttgttgacatgtggcatgttcatttgttcacaacttaatcacgggggacatttcagaa

SEQ ID NO: 73044 - DNA, 1006 bp, Homo sapiens
agtggcagttttaaaacaccaaattctttagatcagctgaaaagaagagtgagaattgaaaattcctccactagtaattgttagccaatagaatagcctcccagagcagtccccacagcacttggttgccatgggtttctctcctctcactgcctgccccagtgccatgatgtctggggcttgtctcttctatggcatcccctgattgacttttgtatagcaacctctgtgtcaagtcagtaatatgatgccattgtaataggaggccttcctaaagaagtaactgcaacttttaaaacgtgatgattattggtttttataatacacaaagcattaattttttcttatcttattttctctttattatttctttccaacttttgtttggagacatttatgttagaagaaaaactataaagttttatcattgtagagaacagagagatcaaagacagctggactgtacctgtttgtgtaattatttctgatatttttaggaaaagaagtttaacagagtaactcagactgagactgttaaactctgttcatgataaactccatattacataatataggtgaacagattaattccctccatgtaactaagatactctatttacattatttatatactctcttagttttttatgcacttccaagttttagttggaaaaatgaaaaccaagctactacttaaaagttattaaaaacttcacataaaatatttcattttagctacaagttattcattgcataggattttataaatagtctgggtatttcataggaactgcatttcaaaagtgaattaaccaaacctaaaaaaagggttacttttaaaatgcattaaaataaagaagtttcatattcagttgataaggccattaaggtaggataatgcagttacatatacaaactaaaaaaggaaaaagaatatattttgtggtccttaatgtttgattgcactattgtttcccacagcttagccgtatctatttctgtatac

SEQ ID NO: 73045 - DNA, 1883 bp, Homo sapiens
aaagtcagtaacagacagtattacttgtaatcatcaaaagaaggtttccacaagttgtataaatcagtgcatttatttattatgttgtgaaacttaagctttatatgaaatacatattctagctcttttcctttttactgctgttgtttagagtgtgtagttctgttgatgatttacttatgtacttgaagtactcatttctgtcaaacagatgcccaactattttccttttaaaaaactgtattctttactgcaatagatagcggaatagtaatagacactttgttaaaaaaataagtttcatgtttaaaataaatatttttttaaaatataaagccaaaatgaattcaccaatattaaggatttaatgtagccaagggattcagtgtgttatattttgccaatatgtattttatcttcatgtcacaacttattttctgtagccaattctcagttttagttgaagagagatctcagtgattgtactgccaatatgacattcaaatgaacattaggaatcttgaaccatggctgagcgctgttgctcaggcctgtaatcccagcactttggaaagccgagggaggtagatcacctgaggtcaggagtttgagaccagcctggccaacttaatacaaaaattagccaggtgtggtggtgggtgcctgtaatcccagctactcaggaggctgaggcaggagaattgcttgaacccaggaggtggaggttgcagtgagccaagatctcgccactgcactccagcctgggcgacagagcgagactctgtctcagggggaaaaaaaagaattttgaaccccccaaaatatcacatatctagcagttctaggttccagggtggatatttttaacatatgtttgcatttggttctgggatagtaaccgttatggataattgtttgtttctgtcaagtcggtgagattttaattgtttgaattatttctatttaaaattactctcaatttaactgtttaaaaaactaaaaatttaaaacataatggcacaacatacgacacagaataaaacacatgttttcaaggaagaagaaaaaactgttttgacttaatgtgaagcaggggtttaccaaagaaaattgctttaataagccctaactttaactgttttcttctatgttacagtgttagcggttgatgtattgtgtactgtttaagaactcataggagactaataattaatttactataattttaaaggcaaagagttttatattaattttactgttgcacaagcagttattggaagtgggggaaaaaaagaaaactggtgagagaaattacatggaaattataggaaaaaggaacttgaattggtaatttggcaaagatttgggaacaaatagtttgaacatagatttctttcaccttatatgatagaaacacaaggcacacgtgagctgtatagtgtgctgagcacacccccagaaaacaaaaaatatcacattgatgaagtccgagactgtatctagatcttagcataactagtgaattcagggagcacatcctgctgctgaaattgagaagtcagtaagaaggtagttcagatgacctaatcattcaagacatttgatggagtccacacaagggtttatgatgtggggcaaatatctgtgctttctcatctcagtgattgatgtctggagaactagtcagacacacttagctggttcctatagaaaaacaccagtaaatgtggatcagaccataccctgcagaccaaggagattttcttaaacttgctaagcctttcttaaacttgccaagtattagcaatgataattgctaaatggattttttcctttcactgaaacaacaaaacaattattgaaattcacaatacctagagatg

SEQ ID NO: 73046 - DNA, 1156 bp, Homo sapiens
tttttggtttttttccagcaactagtttttctactttcactctttcccaccagagtggtctctctaaaacaaatttgctaaagttcttaagtaggctcttttttctctaaattacagaatagcaaactaactcctaagcaagatgagtcagtgtctatgaccttgcctctttcttcctttttagtatcctcaccaaccttccctctgttgacttttgtaatccaggaatttggaactacttatgacttagtgccttggcataatcacatgccatagatgaacatgttcaagactcagttcaaatttaactttctgtgaagccctacctgacttccctaggcaggtattttctccatgcctatagtatattgaaactttttctgttaaaataacataacatttcaattacacacacacaacctgtctcttccactgaacttctctctccccctttgtattctcagtgtctagctacacataataggactttgataaatatttttgaatgaaggtaatagaaaacccgaacttctctatatttgtgtactttcacaaacaaaggcttagaattccacatgaaagtccacatgaggtaagtgtgcattcatgagcatgtgtgcactctgggcaaaccaacagaagataaacagcaaggaagagcagttgttttgtgaaaaataatcatctgttagctgtaaatcagaaatattggccaaatcagaattcttgtttctaaaatgaggcttctaaaattttcacataactgccaaactcttatttgtaattcttaaatatgccctaaagatcatctttctcttttatagacatttagtgtatacagtccacataaatacatatactgattacctacagacaataatgagacttcagaaagaatcaaaagcaatagtgatggtggaatttttaaataatattcagctggggggaaatagactgagtttgtgtgatttcaggttatttagagttattaatgtaaacataagaaggcttgtgactcttatcaccctctatagaatataaagactaaaaataaaaactattacctctgggcctgtttttctttgggattagataaagcctttctaccatatcaccaaatactcataaaggctaacacagaaagcttttccaagtt

SEQ ID NO: 73047 - DNA, 1087 bp, Homo sapiens
ataatttggtttgcatttatagtaatgattccttaaagttcacctcccccaaaaaaccactcgttaaaagtccagtgcatgacaagtgttgtctctagtggtaatgatctgtgaatagccctttaaaatcactgtctggtgaggaagaaagagtgttgtaacacagagtgttatgtgcagtgataaaaaatatgccaccaagtttaggggaggacaaaggaagggcagagatagagaaagttcaggggcaccttcctggataggggacattaagtcgaatcttacatcagttagccaggtgaagtatgtgtgtgagaaaggcagagaggacagtgcaagcaaagataggcaagcagcatggagggtaaaacatgctgttgctgaaacataagggagagatagaaggtggaactggagtaggcaaggtcagaactaagcaatccggtttgagccctggccaaatccgtgacttctgttggtgggattgacgtgaagagagcagaggacaaggagatcggttagaggttatgaaagaagtttgagtgagaaatagcaagggacttccttagtgcagttttagtggaaatggaaaggagggaacagatctcagaaatactcaggtgtaaatggactgtacttgagattggctgtggatggatgaggggagagaagaaacataacaaatcccaggtttctgataactgaagagggaagcatgaaattcaagttcagactcagccatcatggtttcaaggtgactgtctatgggatacatcatgttggagagaggtacgggagggaaatacagatctgagagtcattgccatatgggctgaaacctttggagaagatgaagttatccagaaagatccttaggaacttagaaaaggagccccacagaactgggattcagacctctgagaagggggcgctctcccgatggtggttctaggaatgccagaggaagaagccggagaatgaatgaagccacctgcctctgccagggtgagaaccagtgcccctgagacactggcagcaacagtgagcaaaacagaaagggcaagtcctcttttcttctgcaggaaag

SEQ ID NO: 73048 - DNA, 2857 bp, Homo sapiens
aatttggacaatatattaaaggccgttttaagagaaaatgccagttgtaaataggtagaggaattctgtctatacgtgacaaaaatgtgaaagacttagaaaatatctctttgtgaatgggcagaggagaccagtgttgattagaaaaaattccttcttactccatcttagcaaactaattttcagaagtagaaaaataaattttttggctggtcttcataaccttttggcaagggtttcaaacttgtagggcgtgtggtgtttggtttttcaaaagtaattgaagtaactttggatagggtaactgattttgttttttttcctgtcttgtggtctgcattttattaatcaactacctggaaggattgaagggtgaggacaggtcgagaaaagctttaagttaagcctgggcatgagttaagggtcaatgagctggtaatatggggaagagaaagaaaaatgctttatcagtttaaaaacagcctggaaagatccaagtgtctcgattctcccagtcatccttacatataaaagtttattaaaaaaatacttctgggccaggcttggtgccttacacttgtaatcccaggactttaggaggctgaggcgggtggatcacttgagaccaggagttcaagaccagcctggccaacatggaaaaaccctgtctttactaaaaaataaaaaattagccacgtgttatggcacatgcctgtaatcccatctagtcgagaggctgaggcacaagaatcgcttgagcctgagagatgggagattgcagtgagccgagatcgtgccactgcactccaccctgggcgactgagtgagactctgcctcaaaaaacaacaacaaaaaacttctggagtaaaggcatttgaaatttgtagattagagactggacatggtaaaaggagaaaagttatcatttttagaataatctgagaatgtttcttgggaaataaatggggtagaggcctggaacagagaggatgttacttgactgaaaatgaggtatattgtaaagagtttcggtttgggagtcaggtctattaattaaatgagcctcattttcttcatacccacctcaaaaagttagtgcgaagcacatagtagctgcttactcagtgtttttatttttacctcccgtaatggtttgaggattctttgattgcaaggaagaaaaagccaatttaattagcctacttaaaaaaaaagcatttgtcatacagtgctgctgaagtccattgcatgattccaattcagcgttttgggaaccagaaagtcttcaggcagttactcttccagtttttctctggaagcacatggtcttatgtctctgctactcacgcaggtctgttccagtttctttcagattggccttctctttaaagctcttggtttccacttccccaaaactttgatttgcatgagactttggtttgccatgatgccaacatcagactcactgactatgcaacatggttctcagcaaacatctccaagtctcagttatgtttctagagagagaatccaattggtcaggtttctgcttctagcacagttggctggagagtgaggaaagataggaatgggaaaaatggatgaggaagagacttagatttgtctcacagtttgcagggctgctccttttaaactggccatgccaacatatttaacaaaaggagagtggacagggaggaagtgatggatacctcaggtgtgctttaacatcctgcaatttgagttcttcctctggcattgcattgaacttgctctcagcttggtaatgttctaaccagatctaaccagtagtctctttacaggacagattctcctgggtgtgggagttcaggcaaattactgaaatgcttgatgactcagttttcctatgcgtagaatgggcataatagcaccttctgtggtgagaattatgaattcatgtatgtaaagcaattaaacagtgtctggcatatggcaggcacaatgcaagggtacggtattagtatttgttgagagcataccgtgtggcaggtactgtgatacaggcttctggtcgtgttcagagaggaaggaatttctgccctcaagaagtctagaagtccagtgctgaccactcatgcttaaaaccatttcttgacttcagtgacactaaattcttctaaatctctacctcacctacctttctgactgccatttatttgtggttccttttatgccggtcctggaaccctttatcatggttgtcttcatagatgctctcttgaatttctgttctttcccagtcgctgagaccagctttcaggttctctatatgtggattattcttagagtaacatctccatctctgaccccaagtaaatctcttaatttttagttctttttttgggtattattatttatataatttatatgttttgagacatggtcttgctctgtcacccaggctagggtgcagtggcgcaatcttggctcactgcaacctcctcctcccagggctcaagcgattctcccttctcagcttcccgagtagctggaaccacaggtgtgtgctaccacgcctagctaatttttatatttttttagaggtggggtttcaccgtgttggccaggctggtctcaaactcctgggctcaagccgtccacctgccttggcctcccaatgtgctgggattacaggtatgcgcccactgtacctagcctcttggatattcctatgttgatataaaatactgtcttccagttaccttctaatttgcaaagccttctgatttaccttctgatttgcaaagaaaaaaattttctttcagcatcccaggcttaaaaccttaaagttatttttcacattcttcttttttt

SEQ ID NO: 73049 - DNA, 1114 bp, Homo sapiens
agatgtcactgataaaaagaaatgtgttcctgggttaaaattctgaacatattttctgttagaaatagtcttgtggatagggctacgtacaagattaagaatgttactccattttctagggagcatattcatgttgaaagcacaatctcaagattttagttttttgttgttgcatttttttgtaggtattcaattacatagcattttaattatagcatatcatccttataatattgccatacacatatacaaagttttattataaatcagttgttgaaaatatttttgaaagtcaaatatattacagatgcacactcaatagtgaaactaagataatcatttgagggcatatatcctttacagtgatttcttaaaactgtattcaaatgtaggtctaatgagttttttattatgaaaatgttaactgttttatcctcctgccttcatctgattattctaattaacttctaacaatggaccgttgcatgtttaaaagttgtgtttattgttgctgaataagtagttttgaagtcagtagccattcacacttagtactttgtcaactagacccatgttattcctttcaataccagtggctagttgggctcaaacataccttataagtagatctcaatctggaatgcagttgaaaaatcaataatttttctctgtgactgtttgggaaaacaaaagtgacagaacaaatattcttggattaattttgtaaaaagtcattaggtaagtggccctattttctatttggtgatgttgcttttgccaccaaatgcctgtctgcattcacgtcattgatgaaatttctcttcaccgtacagctcgttcacttcagtaaatctatagttgcttattatgagtaaggcctttggggaatgcagagatgagtaaggcatggcgatggaatgaaattcactgttgtatcccaatcactgttacttagacgcttggtgaatgtatgtgttgaacgttggtagtacttacagtccagtgcagggcatagacatgtagacatttaactgttacataaggcactgtagtctaaagtgctaaaatagggtaagtggtgattttgctccccaaggaaatgtttggtaatatt

SEQ ID NO: 73050 - DNA, 1795 bp, Homo sapiens
taattcactaatttatttgtaatgctctggactcatggatttttgcagttctatattttataaccttttatttctttacagtcattaattcatctatgtaagttgctcaaatttttccaaaattgatacctgagagcccctccaagtaggtacctatatccttttgtctcaggctcataactttgattgctttttcactttcgggttgtatccttttggtacaggatgacctaatttcacctactttaccttcctcagacctgaaattggctattttttttttaaagaaccctgaatagtatttaaaacccaagatctggatactaggagttgcctttgcacttaccatgtcatgagtttatattgacagttcacgttcagatttcacatattttttcctgttttgatttcctgtttctaaattagtgtgaaaatccccgtttattaaggaaaacaaaattgtttaaaatattgaatattttcaagcccacagaaaagttgagaaaaaaacctagtacaatgagcacctcatatagtcttcactcagattcaccctcggttagcatcatacctttaagtatgtcagtatcattaccacctctttgaaaatcattaattcagtaacatcatctagcatgcattccaaacacagatttccctgtgtctcaagtatccttgtaactttttccttgcttctcttctaggatccacactgtatttggtcaaggttcacacactgtatttggggattgtatctctttggtcttccccattctagaccattccaatagtctaaattcttttctcatgcagcaaatcttctgaagagtctaggccagttgtgttgtagaatatttttatatttgggttcatttgtttttccctgtaattagattcaacacaacacctgaaaggtgatgttgtgttcattccggtctatcagatctgaagtccatattgttgatgttaggcttgactaggtggttaaggtaataaccaccagatatctccaatataaatgcacataatctctttatgattaatacacttaataaactataaggtgatcctctgagacagtatgagtgtccttttccccagcttttaacccagtagatttaggatacatggataatcctttcctaaatcagtaattgcattgggagtttacaaatggggttttctaactttgtcattctgtccatactagccagcatttttaggtaaaggagctcctctgactttgtctcttttaatggactcacagattttttttaatccagtagtcataattcattaccattttcattcttcttgattccacattgtcccatatttggccagtgggaattctttcaagctggcttctgtgttttttgaaattaccctattagtctttgagcatttccttgcattctggcacagttagatgttccaggctcgcttcatacattctcagcctcagacctggaaccagccatttccccagggaaatctagttctttttattggtgatagatatttacagaccaaaagctgggtgctgactatgctcattgccactgaaggtcattgtttctaagacttttcagtggaaaaaaggtagtacatgtattcaaagaattacgaatttgtaatgacaggtcagattcaaatgtaacagtacagctttttatcataaattctttgagtttatatttgtacctcttagactaaagatttccatttattttaatttattaagattgcagctgtttgagttaatctagtgtgaggttctgaaatatggggaaac

SEQ ID NO: 73051 - DNA, 4368 bp, Homo sapiens
aattttagtatattttatttttgaatttttgaaaaattatctgtgaataataaactgtatatgttaactattatgaaccaggaaattcactagccagtagaccttaaaatttttggatagggtccacattataggaaccttaacaaaagtgttactctacagtgttacttattgttattattttaaatcaggatttagctgcagtttctttggaacttccagatattctgaattcactccacttctgcagtctaaatgaaaatgaaattatttgtatgaagaatataaataaaccattagatataagcagtgatcctctaaatcaggtaacttttgtagataatttctaatgagatttttagggcaaattttactatatttgataaagatgattaaacttttaaatgcttggatgacatttgttttttttaaatggtatctcaaggaaatatgattcataagaaatataactcatgaagcattgacatccctgaaggatataataattttggtcatatcttataaattatattttttaactgtgaagttccgtagatggtatgcaagtacatgttaattttttctgaaaatttattatttctggatttcttgaactacttttacctttgtataagctacagtgacttttccctattatggccaatttcaaatttatataaatgttacgctatatgttttagagaatgtacttcagttcattttctggtttaaaaaaattccatgtaaagtggacatctgatgtgttctttataaataaaaatgttaccatttcttacaggtggttagttttataatattcagcatttagttctttaccaagtatgattttgttgataatgcatcagagaaaatgctttgcattctaagagataagacatatacaattgaaccagaaaatttaaaatttggattattttagttttaaaaaaactgctatgttgttctttataaggtctgccaataaaactagaactgcttgcttcatttccttaattatgttctttattcgtatttgctttatttgctaggatataagaggtgataagctattatatttgatttctagttttttgaataaataatttcatcagtatttacttgaaaaaagtagtatgagggggaaaatctggttacttgtatttttaaagctataaacattgtaagttgtaatgctagggaaatttaagtaaaaggagtagacttttaacaattgtgataggaaggaagatggcatcatacttgaaactacgggaaaatgggattaaaaataaaagaaaatagaacttggttgctgcccccaaacaatttataatagttagtgagataggtgaatgattaaggaaaatcatagggctgtacagtaatacaggaaaacataattgctcaaaggaatggatagtaagtttcataacatttcaggagactgggtagaatttgaatacctggataaaagaagatgggagaaaaaaggactggaaagtgaaaaatgtagagaaagaattaagaagtaaacattacaaaaccaaggagcttttcaggatgcatgaatttcttgtttgtttttttctctgagattgtcttatatctaggctttacttcatgttgttttgtatttgaaattaaaattgtttttattatcttttatctttcccaagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggtttgtttttcattagactttttcctaaaatagggaattaaaatttttcagttttgaaaattttaaggcaggcttgttcagttgaaatttatgttgagatttgattcaatttaaaccttttaactttttttctgattacctaaggaaattccttatgatttttaagttcattgtaatctggttttcagttttgcttatttcaggttttcatatttagttggtgctgttcacgcactggttacatcattaagtgtctggaacattcctaggttccaattttggaagagttagctggcagagtctccacggtaatttttctaacatgcgtgacagcatgcaaaacatcccatagaccaggtatccctagacatagagtaaactgaaattattttataaacagtatatttactttcaaatgttacttgggtgaatctttctgttaaacatagtttagaagatacacataaatattatatgtttaaagtcagtttattccatggatttaagttaatttccaaaaagttttgttcaaaaataatttcaccatttcattcttttcctataggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacaga

SEQ ID NO: 73052 - DNA, 2504 bp, Homo sapiens
atggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctggttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcaggtaagtttcacgtttcttttggttgttaatgataaattaaaaagataaatgtgatcctatatgtcttaggtcctgttcataaaggaatgattatttttaaccctacataaacaaaagttttccctgttgcatttatgtattgtttcatatcctacacatgactttaatatattttggtctcctgatcccttttgagggaaggtgttatccatttacagagctggaaaatgagggttggagaaaataatcaccttatccaagttcatagagctatgaaataggtaaagttgaattaaataaatagctagagaattttatatagtagtccccccttattctcaattttgctttcctcaatctgaaaatgttaaatggaaaattccagaaataagcgattcgtaagttttaagttgcatgttctgagta

SEQ ID NO: 73053 - DNA, 1140 bp, Homo sapiens
agacacttttaaaaccatcagctctcatgagaactccctcactgtcatgagaacagcatggaggaagccgccctcatgatccaatcacctcccaccaggtccctccctgggggttacaatttgagatgagatttgggtagggacatagagccaaaccatatcatggcctcttacagaaaacaattgcgaacctctgtcctagatccacattttcgttttcactacataccagttcctagtatgataataaacataataaattgttaataaatattctcatgaataggtaataaattaggcctttttacaattgaaataattttcctcatacaggttgcttcaggctattttactttttactcctcctcagttcagtcctgtctgccctacggacccatccatccccctttcctcccaccctcatgggaagaaaagagactgtcctctaaagtttttaagacatcactctcaggggctagcaaatgcctttgttattgattttctcagtaatttccacttttccttcttagagttgggtgagtagatagcccctaaagttcttcctgtaagccagtgctgtccaatttcagctttttattaaggctggagtaattattttcctgcttctcttcttaataattgtgctagggttctgtaaatactgactaaggaaagctgactctagtgtgtagagtttacgtttaacattttttatttctaaagttaaatttgtctttcaaacttgaaaggagattcattcagatggattattctttaaggtattatttcacctgatgtccctttttgtttgattcatgaacatgaccataaatatttcacaaactgtaatgaacagagaggtggcatgtgaatgcaattgggaaattatgtgatagtacatttttattcatttttgtttgttgttgtttgtttgtagagatgagatctcactatgttgctcaggctgatcttgaattcctgagctcaagcaatcctcctgccctagcctcccaaagtgctgagattgcaagcatgagccaccgtgcctggctgatagtgcatttttagccaacaaaacgattatattctaagctatcattccgagccaaaataacctcacagtcattataaactcttctc

SEQ ID NO: 73054 - DNA, 3767 bp, Homo sapiens
ttgaagatgaacaccaagatgaaagcagcagttttcatcatctaagtgaaaggtaactacacttttgcatataattgtgtagtttaggtcctcagatcttagaagtgagctataaatttacattattatttaaaaattctaaatttgaaaatatgctattactttcaaaatgtattttattattcacaatgtatttctaattgtttttaacacttatttaatacagtaagtagcccagctaattttattggggtgtgccaatagttgatttgaaaaatattgcatacatttaattttatgccttttaagcttctcccaaactttttatgaacttctgaggaaaaattttttttttcactttaaaaagggtacttttttttctttaaagaacaagaaaaaggacaggtatctgtaaaaggcatcaaagtagccctgtacttttcctgacattagttaaaatagtatctttttggtggggcgagggtccctgcttgtcctgctgttaggaacaaaatgacctggaagacttatgcttgaatgattgaaaatacgtaagtcaaagccattataaaaatgtgattttgtatagcacaaggcacttacctcatatataacttttcttagttaactttgttcataacagtggtgtttgaaatattttattaattatgagacagttgtttcttatagtcttaacctctacctaaaggcatttctgactaacctataaaattctataaactctttatccacattaagtgataactggaaataatagataccatttgtagcagagtcttgagggaggaaagggttcttagcatattgctggtttcaggcatgtgtggaaaggacctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacagtgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctgagaatctgcatgcttgataagcatcacagatgatttcagtgcaggtgattcagagacctcacttgaaaatatattgatttacaagatatgttgcatctgttgatgacaattgatatctatactgttcttttctgctacagagatcaaggtaggagataaagacttcggcgatttgggctgggcgcggtgattcacgcctgtaatcccagaactctgggaagccaatgggggtgggggtggatcacttgaggtcaggagttcaagaccagcctgggcaacatggtgaaaccccgtctctaccaaaaatacaaaaattagccaggcgtggtggcaggcacctgtaatcccagctacttgggaggctaaggcaggagaattgcttgaacctgggaggcagagattgcagtgagctgagattgtgccactgtactccatcctgggcgacagagacagactccgtcaaaaaaaaaaaaaaaagactgtgacaatttgaaaacaccttgccagtttcattataagcaggaagttcagtggagggcaacaactaaaaaacacactaatttcagattttcaaaagtgtttaggaggattatataattatttgatcagaaaagaactggtctctgtctgtgactgtcttaaatatttaggtagtttgttattctcttaggaattatgaattagattaggttaagggatggggccagatttgcagaatgtttcagataatttttataagatgtatcacaatcaagaccagtcttgatatggctaaaagctgcaataaagcattgcagtactggaccactgtagtacttataccactggttggagtactcctgtgctagacataggaaatatgaaaagacataaaagaaagtgatggaagcagggtagtgtttcaagagtgaagtaggaaaactcttaagtgaagaaattaagttttttaaatgttgggttaatacagggtgatcatacttcccacttaggatagtttggcttatttctgctgttctgttgtaattattaacggtgaggtctttaaaaaagtgtcctggttagatgaaaaatgtatacagtcacctagttagaagtggcattttatgaagaatgacttcaaatacccatttggaggcacaaagagggaggggtgataaggttagagggaatttgaatttttagtctttacttcgtttagctgtttttttttaatgtttatgtaataggtaggtgatggattttattaagtggaagaatctgtgtgatgggtagaaaaattttatatttttttgttataatcattctattaatagaagtaaatagagtgtttgagatgattaattttctttttctcctttgctcacagctgtctgtccattctttgtttgtatattttcttatttttagtttatctgacaatgaactacatgggttttaacagttttataatagagctatatttgtttgaacatatgttaaaaagaccctgctcagttttaacttttactctctaatacatcatgatttgtgacagtttgatcatgttagagtgaatataactatgcaaattatttgagattgcttggaagttttttagaacttgaagtaatcacctttttttgttaaccataccaacatttactgatgtacataaaatgattttatgtttacttttttagaaccaaaattttggtttgtataaatattactttttataattgcctagcataatattgggaaaaatcgctgcttatcactgcaaactaatgtgcttactaatgtttaataattagaaatgattagaatttttaaattgcatgctgagggttttaatctgaaaatttgaatttaattttatttctgaacatggttgctttttttaaaaattgctttgctgcagttttagaaagtagttgctttcttcttcag

SEQ ID NO: 73055 - DNA, 1067 bp, Homo sapiens
tcaaaagagcttgcttcctacaggatttctgttgggtttttttgttatgttttatttttgtgtgtgattttattttatatataagaaaagtataggtaaaaagtgtttttactgtattaaaaatatatataaattgcatcagctaaaccattaacaaatattcctggcattttgtaatattcaaatgctacattaaattagtagactatttcaactttaaatgattttaaattgaatattatgaaattacatggcactatgtatcatggtaaggtaggatttcttggttttgataactttagggatcatttgcaattcagattttaacatgaaatgatgtgagaagcaaagcttccttttttaattgtcatttctcccctttctaaatgtcatatgtcatattgtaacattcattcattaccacatttttaagaatttgttttgataccattattaattaaattttttttgtaactgcttctgctattttattcataagtgatggaccagatgataaagatgaagagcatgaggacgaagtagaaggtaatttgatttgtttttcaaagtgttggcatgtgttttgtataaggtttcctagaagagtctttatgcattttcatcagataggctctaggttatcagtgtaaaacattataaatcagggtattcttgaactaattttgtttgtccacttttagatcctttgttgagtagttttatttgattgctacactaatgaaattgtcattggtataaagaaatactgggcaggcacggtggcttacgcctataatcccagcattttgggtggctgaggtgggtggatcgcatgaggccaggaatttgagaccagcctggccaacatggtgaaaccccatctctactgaaaatgcaaaaattagctgggcgtggtggcgggcacctgtaatcccagctatttgagaggctgaggcgcaggattcacttgaacctgggaggcagaggttgcagtgagccgagatcatgccactgcactccagcctgggtaacagagccagagactctgacttaaaaaaaaaaaaaaa

SEQ ID NO: 73056 - DNA, 1050 bp, Homo sapiens
tggggtttcaccatgttgggcaggctggtctcgaactcttggcctcaagcgatctgcccacgtcggcctcccagagtgctgggattacaggcctgagccaccatgcccagcctcatttttatttttattgtaatgatagctttatagttttattttctctctaacccactggtcataatttatatcaaattatggcatttatagaacttgaattcagtatgttaaaatgatgttttatatttttgcaatcaataaatgatcaaagttattcctttgttttacattattttgccctttagaagttttagttgaggttatggtgtggttagaaaaagatggatatttttttcaccattcattagaatcctaagaaccagaaaatatttgtatctacttgacaaccagagtattgagagttaaattgatgagttttactttatattgtttacatttaaatattaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctagtaagtacctaccttacagagtgtgaggatacatttaacagtatatgatgttcttgtcatgtgattggtctaacaagatgcctggtgatggttaaattcttaggctgtagtgtccaacagtttgggttcagacatcagctctgccactttctagcagtataaccagaggcaggttcaccagtctgtctcattgcccctaactgcactatgcaaatgaatatagaatctaccttacaggggtttatgaggattaaatataatgttaaaaaaaatgcttggtctaatgcctggcataacactaagctctcaaaggtagatgctattaataagcattgtgtgtgttcctatgaaaaaattgaattattctctgtatttaattgatttgtaattgtacctaatgattaatatatctgtttctctgataatc

SEQ ID NO: 73057 - DNA, 2990 bp, Homo sapiens
gaaatattcgaattgtggtgttggttgcattcaacttggagaacatactaaaaaccattgactaggacactttgggtgaattgtatgttatgtgagttttatctcaataaagctgtttttaaaaaggttaagcatatatatgttacacaaaattaaagtagtttttcagaatttaacttacagatctttcaaaacttaagagcttttacagaacttagtagaaaaagaaatgaacaaaagcatgtcgtgagtggtgacaacaggatttatttaaacctgtatttatttatttatttatttgttgttttgttgttgaaacattaacattctttaacttagaaagccatgtttccattgaggctagagtgtgtattccagaaaaatgccacactatatgttgtggaaggaaaatccacatccttttattgagtttgacgttgtctttattattttatgtcctaattgagggtgtggcagttgtatttagttaggtgaagaatttcctgtagaaactcagcctctgcatgtccatgcagactatttgcttggtgaggtttgtggagctctgtctccagcgatcccaaagtgtcattctctggaggagatgtgtttataaaggggaagaagggaaaatgtttaatttgggtaaaggggtagcggtttagaggggaagaccttgttataactaggaaacggtatttaattgtaaacagcaggattcttaagtttcagctaatattgaaaataaaaataaaagctttgttataaaattgtttttggttaatgtttgacacatctttctttcttagctttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgt
